United States Patent 8,758,764 (PROTEINS AND NUCLEIC ACIDS FROM MENINGITIS/SEPSIS-ASSOCIATED ESCHERICHIA COLI) - sequence listing, part 3

SEQ ID NO: 7565 - DNA, 876 bp, Escherichia coli
atgaccacactggcgattgatatcggcggtactaaacttgccgccgcgctgattggcgctgacgggcagatccgcgatcgccgagaacttcctacgcctgccagccagactccgcaggcgctgcgtgatgccttatccgcattagtctctccgttgcaagcacatgcgcagcgggttgccatcgcttcaaccggaattattcgcgacggcagcttgttggcgctgaatccgcataatctcggtggattgttacactttccgttagtcaaaacgctggagcaacttaccaatttgccgaccattgccattaatgatgcgcaggccgcagcatgggcggagtatcaggcgctggatggcgatataaccgatatggtttttatcactgtttccaccggcgttggcggcggtgtagtgagcggcggtaaactgcgtaccggccctggcggtctggcggggcatatcgggcatacgcttgccgatccgcatggtccagcctgcggctgtggacgcacaggttgcgtggaagcgattgcttctggtcgcggcattgcaacggcagcgcagggggagttggctggtgcgaatgcgaaaactattttcacgcgcgccgggcagggtgatgagcaggcgcagcaactgattcaccgctccgcacgtacgcttgcaaggctgatcgctgatattaaagccacaactgattgccagtgcgtggtggtcggtggcagcgttggtctggcagaagggtatctggcgctggtggaaacgtatctggcgcaggagccagcggcatttcatgttgatttactggcggcgcactaccgccacgatgcaggtttacttggggctgcgctgttggcccagggagaaatattatga

SEQ ID NO: 7566 - protein, 291 aa, Escherichia coli
MTTLAIDIGGTKLAAALIGADGQIRDRRELPTPASQTPQALRDALSALVSPLQAHAQRVAIASTGIIRDGSLLALNPHNLGGLLHFPLVKTLEQLTNLPTIAINDAQAAAWAEYQALDGDITDMVFITVSTGVGGGVVSGGKLRTGPGGLAGHIGHTLADPHGPACGCGRTGCVEAIASGRGIATAAQGELAGANAKTIFTRAGQGDEQAQQLIHRSARTLARLIADIKATTDCQCVVVGGSVGLAEGYLALVETYLAQEPAAFHVDLLAAHYRHDAGLLGAALLAQGEIL

SEQ ID NO: 7567 - DNA, 732 bp, Escherichia coli
ttgcccggtctctgtaccgggcctttcgctaagggaagatgtatgtcgttacttgcacaactggatcaaaaaatcgctgctaacggtggcctgattgtctcctgccagccggttccggacagcccgctcgataaacccgaaatcgttgccgccatggcattagcggcagagcaggcgggcgcggtcgccattcgtattgaaggtgtggcaaatctgcaagccacgcgtgcggtggtgagcgtgccgattattgggattgtgaagcgcgatctggaggattctccggtacgcatcacggcctatattgaagatgttgatgcgctggcgcaggcgggcgcggacattatcgcgattgacggcaccgaccgaccgcgtccggtgccagttgaaacgctgctggcacgtattcaccatcacggtttactggcgatgaccgactgctcaacgccggaagacggcctggcatgccaaaagctgggagccgaaattattggcactacgctttctggctatactacgcctgaaacgccagaagagccggatctggcgctggtgaaaacgttgagtgacgccggatgccgggtgattgccgaagggcgttacaacacgcctgctcaggcggcggatgcgatgcgccacggcgcgtgggcggtgacggtcggttctgccattacgcgtcttgaacacatttgtcagtggtacaacacagcgatgaaaaaggcggtgctatga

SEQ ID NO: 7568 - protein, 243 aa, Escherichia coli
MPGLCTGPFAKGRCMSLLAQLDQKIAANGGLIVSCQPVPDSPLDKPEIVAAMALAAEQAGAVAIRIEGVANLQATRAVVSVPIIGIVKRDLEDSPVRITAYIEDVDALAQAGADIIAIDGTDRPRPVPVETLLARIHHHGLLAMTDCSTPEDGLACQKLGAEIIGTTLSGYTTPETPEEPDLALVKTLSDAGCRVIAEGRYNTPAQAADAMRHGAWAVTVGSAITRLEHICQWYNTAMKKAVL

SEQ ID NO: 7569 - DNA, 1491 bp, Escherichia coli
atgagtactacaacccagaatatcccgtggtatcgccatcttaaccgcgcacaatggcgggcattttccgctgcctggttgggatatctgcttgacggttttgatttcgttttaatcgccctggtactcaccgaagtacagggtgaattcgggctgacgacggtgcaggcggcaagtctgatctccgcagcctttatctctcgctggttcggcggcctgatgctcggcgctatgggtgaccgctacgggcgtcgtctggcaatggtcaccagcatcgttctcttctcggccgggacgctggcctgcggctttgcgccaggctacatcaccatgtttatcgctcgtctggtcatcggcatggggatggcgggtgaatacggttccagcgccacctatgtcattgaaagctggccaaagcatctgcgtaacaaagccagtggttttctgatttcaggcttctcagtgggggccgtcgttgccgctcaggtctatagtctggtggttccggtctggggctggcgtgcgctgttctttatcggcattttgccaatcatctttgctctctggctgcgtaaaaacatcccggaagcggaagactggaaagagaaacacgggggtaaagcaccagtacgcacgatggtagacattctctaccgtggtgaacatcgcattgccaatatcgtaatgacactggcggcggctactgcgctgtggttctgcttcgccggtaacctgcaaaatgccgcgatcgtcgctgttcttgggctgttatgcgccgcaatttttatcagctttatggtgcagagtacgggcaaacgctggccaacgggcgtaatgctgatggtggtcgtgttgttcgctttcctctactcatggccgattcaggcgctgctgccaacgtatctgaaaaccgatctggcttatgacccgcatactgtcgccaatgtgctgttctttagtggctttggcgcggcggtggggtgctgcgtcgggggcttcctcggtgactggctgggaacccgcaaagcgtacgtttgtagtctgctggcctcgcagctgctgattattccggtatttgcgattggcggcgcaaacgtctgggtgctcggtctgttactgttcttccagcaaatgcttggacaagggatcgccgggatcttaccgaaactgattggcggttatttcgataccgaccagcgtgcagcgggcctgggctttacctacaacgttggcgcattgggcggtgcactggccccaatcctcggcgcgttgatcgctcaacgtctggatctgggtactgcgctggcatcgctctcgttcagtctgacatttgtggtgatcctgctgattggtctggatatgccttctcgtgttcagcgttggctgcgcccggaagcattgcgtactcatgacgctatcgacggcaaaccatttagcggtgccgtgccgtttggcagcgccaaaaacgatttagtcaaaaccaaaagttaa

SEQ ID NO: 7570 - protein, 496 aa, Escherichia coli
MSTTTQNIPWYRHLNRAQWRAFSAAWLGYLLDGFDFVLIALVLTEVQGEFGLTTVQAASLISAAFISRWFGGLMLGAMGDRYGRRLAMVTSIVLFSAGTLACGFAPGYITMFIARLVIGMGMAGEYGSSATYVIESWPKHLRNKASGFLISGFSVGAVVAAQVYSLVVPVWGWRALFFIGILPIIFALWLRKNIPEAEDWKEKHGGKAPVRTMVDILYRGEHRIANIVMTLAAATALWFCFAGNLQNAAIVAVLGLLCAAIFISFMVQSTGKRWPTGVMLMVVVLFAFLYSWPIQALLPTYLKTDLAYDPHTVANVLFFSGFGAAVGCCVGGFLGDWLGTRKAYVCSLLASQLLIIPVFAIGGANVWVLGLLLFFQQMLGQGIAGILPKLIGGYFDTDQRAAGLGFTYNVGALGGALAPILGALIAQRLDLGTALASLSFSLTFVVILLIGLDMPSRVQRWLRPEALRTHDAIDGKPFSGAVPFGSAKNDLVKTKS

SEQ ID NO: 7571 - DNA, 894 bp, Escherichia coli
atggcaacgaatttacgtggcgtaatggctgcactcctgactccttttgaccaacaacaagcactggataaagcgagtctgcgccgcctggttcagttcaatattcagcagggcatcgacggtttgtacgtgggtggttcgacaggcgaagcctttgtacagagcctttcagagcgtgaacaggtactggaaatcgtcgctgaagaggcgaaaggtaagattaaactcatcgcccacgtcggttgcgtcagcaccgccgaaagccaacaacttgcggcatcggctaaacgttatggcttcgatgccgtctccgccgtcacgccgttctactatcctttcagctttgaagaacactgcgatcactatcgggcaattattgattcggcggatgggttgccgatggtggtgtacaacattccagccctgagcggggtaaaactgaccctggatcagattaacactctggttacgctgcctggtgtaggtgcgctgaaacagacctctggcgatctctatcagatggagcagatccgtcgtgaacatcctgatctggtgctctataacggttacgacgaaatcttcgcctctggtcttctggcgggcgcagacggcggtatcggcagcacttacaacatcatgggctggcgttatcaggggatcgtgaaggcgctgaaagaaggcgatatccagaccgcgcagaaactgcaaactgagtgcaacaaagtcattgatttactgatcaaaacgggcgtattccgcggcctgaaaactgtcctgcattatatggatgtcgtttctgtgccgctgtgccgcaaaccgtttggtccggtagatgaaaaatatctgccagaactgaaggcgctggcccagcagttgatgcaagagcgcgggtga

SEQ ID NO: 7572 - protein, 297 aa, Escherichia coli
MATNLRGVMAALLTPFDQQQALDKASLRRLVQFNIQQGIDGLYVGGSTGEAFVQSLSEREQVLEIVAEEAKGKIKLIAHVGCVSTAESQQLAASAKRYGFDAVSAVTPFYYPFSFEEHCDHYRAIIDSADGLPMVVYNIPALSGVKLTLDQINTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYLPELKALAQQLMQERG

SEQ ID NO: 7573 - DNA, 783 bp, Escherichia coli
atgaacgcatttgatccgcaagctgaagattctactaccactatcgggcgcaacttgcgcagccgcccgctggcgcgtaaaaaactctccgaaatggtggaagaagagctggaacagatgatccgccgtcgtgaatttggcgaaggtgaacaattaccgtctgaacgcgaactgatggcgttctttaacgtcgggcgtccttcggtgcgcgaagcgctggcagcgttaaaacgcaaaggtctggtgcaaataaacaacggcgaacgtgcccgcgtctcacgtccttctgcggacaccatcatcggcgagctttccggcatggcgaaagatttcctttctcatcctggtgggattgcccatttcgaacaattacgtctgttctttgaatccagcctggtgcgctatgcggctgaacacgccaccgatgagcaaatcgatttgctggcaaaagcactggaaatcaacagtcagtcgctggataacaacgcagcattcattcgctcagacgttgatttccaccgcgttctggcggagatccccggtaacccaatcttcatggcgatccacgttgccctgctcgactggctaatcgccgcacgtccaaccgtggccgatcaggctctgcatgagcataacaacgttagctatcaacagcatattgcgatcgttgacgcgatccgccgtcatgatcctgacgaagccgatcgcgcgttgcaatcgcatctcaacagcgtctctgctacctggcacgccttcggtcagaccaccaacaaaaagaaataa

SEQ ID NO: 7574 - protein, 260 aa, Escherichia coli
MNAFDPQAEDSTTTIGRNLRSRPLARKKLSEMVEEELEQMIRRREFGEGEQLPSERELMAFFNVGRPSVREALAALKRKGLVQINNGERARVSRPSADTIIGELSGMAKDFLSHPGGIAHFEQLRLFFESSLVRYAAEHATDEQIDLLAKALEINSQSLDNNAAFIRSDVDFHRVLAEIPGNPIFMAIHVALLDWLIAARPTVADQALHEHNNVSYQQHIAIVDAIRRHDPDEADRALQSHLNSVSATWHAFGQTTNKKK

SEQ ID NO: 7575 - DNA, 498 bp, Escherichia coli
atggatttgtcacagctaacaccacgtcgtccctatctgctgcgtgcattctatgagtggttgctggataaccagctcacgccgcacttggtggtggatgtgacgctccctggcgtgcaggttcctatggaatatgcgcgtgacgggcaaatcgtactcaacattgctccgcgagctgtcggcaatctggaactggcgaatgatgaggtgcgctttaacgcgcgctttggtggcattccgcgtcaggtttctgtgccgctggctgccgtgctggctatctacgcccgtgaaaatggtgcaggcacgatgtttgagcctgaagctgcctacgatgaagatgccagcatcatgaatgatgaagaggcatcggcagacaacgaaaccgttatgtcggttatcgatggcgacaagccagatcacgatgatgaaactcatcctgacgatgaacctccgcagccaccacgcggtggtcgaccggcattacgcgttgtgaagtaa

SEQ ID NO: 7576 - protein, 165 aa, Escherichia coli
MDLSQLTPRRPYLLRAFYEWLLDNQLTPHLVVDVTLPGVQVPMEYARDGQIVLNIAPRAVGNLELANDEVRFNARFGGIPRQVSVPLAAVLAIYARENGAGTMFEPEAAYDEDASIMNDEEASADNETVMSVIDGDKPDHDDETHPDDEPPQPPRGGRPALRVVK

SEQ ID NO: 7577 - DNA, 639 bp, Escherichia coli
atggctgtcgctgccaacaaacgttcggtaatgacgctgttttccggtcctactgacatctatagccatcaggtccgcattgtgctggctgagaaaggtgtaagtttcgagatcgaacacgtggaaaaggacaatccgcctcaggatctgattgacctcaacccgaatcagagcgttccgaccctggtggatcgtgagctgaccctgtgggaatctcgcatcattatggaatatctggatgagcgtttcccgcatccgccactgatgcctgtttacccggtagctcgcggtgaaagccgtctgtacatgcatcgcatcgaaaaagactggtacacgctgatgaacaccatcatcaacggttcagcttctgaagcagatgccgcacgtaagcaactgcgcgaagaactgctggcgattgcgccggtcttcggtcagaagccgtacttcctgagcgatgagttcagcctggtcgattgctaccttgctccgctgctgtggcgtctgccgcaactgggcatcgagttcagcggtccgggtgcgaaagagctgaaaggctatatgacccgcgtctttgagcgtgactctttccttgcttctttaactgaagctgaacgtgaaatgcgtctgggccggagttaa

SEQ ID NO: 7578 - protein, 212 aa, Escherichia coli
MAVAANKRSVMTLFSGPTDIYSHQVRIVLAEKGVSFEIEHVEKDNPPQDLIDLNPNQSVPTLVDRELTLWESRIIMEYLDERFPHPPLMPVYPVARGESRLYMHRIEKDWYTLMNTIINGSASEADAARKQLREELLAIAPVFGQKPYFLSDEFSLVDCYLAPLLWRLPQLGIEFSGPGAKELKGYMTRVFERDSFLASLTEAEREMRLGRS

SEQ ID NO: 7579 - DNA, 393 bp, Escherichia coli
atggctgaaaatcaatactacggcactggtcgccgcaaaagttccgcagctcgcgttttcatcaaaccgggcaacggtaaaatcgtaatcaaccaacgttctctggaacagtacttcggtcgtgaaactgcccgcatggtagttcgtcagccgctggaactggtcgacatggttgagaaactggacctgtacatcaccgttaaaggtggtggtatctctggtcaggctggtgcgatccgtcacggtatcacccgcgctctgatggaatacgacgagtccctgcgttctgaactgcgtaaagctggcttcgttactcgtgacgctcgtcaggttgaacgtaagaaagtcggtctgcgtaaagcacgtcgtcgtccgcagttctccaaacgttaa

SEQ ID NO: 7580 - protein, 130 aa, Escherichia coli
MAENQYYGTGRRKSSAARVFIKPGNGKIVINQRSLEQYFGRETARMVVRQPLELVDMVEKLDLYITVKGGGISGQAGAIRHGITRALMEYDESLRSELRKAGFVTRDARQVERKKVGLRKARRRPQFSKR

SEQ ID NO: 7581 - DNA, 483 bp, Escherichia coli
ttgaagacgtttgggtgttcaccaacgtgtaactatttattgggtaagcttttaatgaaaacttttacagctaaaccagaaaccgtaaaacgcgactggtatgttgttgacgcgaccggtaaaactctgggccgtctggctactgaactggctcgtcgcctgcgcggtaagcacaaagcggaatacactccgcacgtagataccggtgattacatcatcgttctgaacgctgacaaagttgctgtaaccggcaacaagcgtactgacaaagtgtactatcaccacaccggccacatcggtggtatcaaacaagcgacctttgaagagatgattgctcgccgtcctgagcgtgtgattgaaatcgcggttaaaggcatgttgccaaaaggcccgctgggtcgtgctatgttccgtaaactgaaagtttacgcgggtaacgagcacaaccacgcggcacagcaaccgcaagttcttgacatctaa

SEQ ID NO: 7582 - protein, 160 aa, Escherichia coli
MKTFGCSPTCNYLLGKLLMKTFTAKPETVKRDWYVVDATGKTLGRLATELARRLRGKHKAEYTPHVDTGDYIIVLNADKVAVTGNKRTDKVYYHHTGHIGGIKQATFEEMIARRPERVIEIAVKGMLPKGPLGRAMFRKLKVYAGNEHNHAAQQPQVLDI

SEQ ID NO: 7583 - DNA, 1128 bp, Escherichia coli
atgcaaagcgttaccccaacatcgcaatacctgaaggcgctcaatgaaggcagccatcaacccgacgacgttcaaaaagaggccgtcagccgcctggaaattatttatcaggaactcatcaatagcacgccaccagcccccaggacgagtgggctaatggcgcgggtcggtaagctgtggggtaaacgcgaagacacaaagcatatgccagtgcgtggcttatatatgtggggcggtgtaggacgcgggaaaacctggctgatggaccttttctatcaaagcctgccgggagagcggaaacagcgcctgcactttcatcgttttatgctgcgggtacatgaagagctaactgctttgcaggggcagaccgatccgctggaaattattgccgatcgctttaaagcagaaactgacgtgctctgttttgacgaattttttgtttctgatattaccgacgccatgctacttggcggcctgatgaaagccctgttcgctcgcggaataacgctggtagcgacgtcaaatattccgccggacgaactttatcgaaatggcctgcaacgtgcgcgttttttgcctgcaatcgatgctattaaacggcattgtgatgtaatgaacgtggacgctggtgttgattatcgactgcgtacactcactcaggcgcatctgtggctttcgcccctcaacgatgaaacccgggcgcaaatggataaactatggttggcgctggcgggggcgaaacgagaaaattcaccgacgttagaaatcaaccatcggccattggcgacaatgggcgtcgagaaccagacgctggcggtttcttttactacgctgtgcgtcgacgcccgcagtcagcatgactatattgcgctctcacgcctctttcacacggtcatgttgtttgatgtaccagttatgacgcggttgatggagagcgaagcgcggcgctttattgcgctggtggatgagttttacgagcgccatgtcaaattagtggtgagtgcagaagtgccgctgtatgaaatttatcagggcgagcggctgaagtttgagttccagcgttgcctgtcacgtctgcaagagatgcaaagcgaagagtatttgaagcgcgagcatttggcggggtaa

SEQ ID NO: 7584 - protein, 375 aa, Escherichia coli
MQSVTPTSQYLKALNEGSHQPDDVQKEAVSRLEIIYQELINSTPPAPRTSGLMARVGKLWGKREDTKHMPVRGLYMWGGVGRGKTWLMDLFYQSLPGERKQRLHFHRFMLRVHEELTALQGQTDPLEIIADRFKAETDVLCFDEFFVSDITDAMLLGGLMKALFARGITLVATSNIPPDELYRNGLQRARFLPAIDAIKRHCDVMNVDAGVDYRLRTLTQAHLWLSPLNDETRAQMDKLWLALAGAKRENSPTLEINHRPLATMGVENQTLAVSFTTLCVDARSQHDYIALSRLFHTVMLFDVPVMTRLMESEARRFIALVDEFYERHVKLVVSAEVPLYEIYQGERLKFEFQRCLSRLQEMQSEEYLKREHLAG

SEQ ID NO: 7585 - DNA, 399 bp, Escherichia coli
atgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcgaaaagctccagtagcctgctgccggaactgtctgcggaagcaaacccgttccgtaatcgtctggcagagtctgaagccagcaacgatcaggcaccggtgcagatgcctcgcgactattctgaaggcgcatccggcctgctgcgtactggcgcgaagcgcgactaa

SEQ ID NO: 7586 - protein, 132 aa, Escherichia coli
MTWEYALIGLVVGIIIGAVAMRFGNRKLRQQQALQYELEKNKAELDEYREELVSHFARSAELLDTMAHDYRQLYQHMAKSSSSLLPELSAEANPFRNRLAESEASNDQAPVQMPRDYSEGASGLLRTGAKRD

SEQ ID NO: 7587 - DNA, 1368 bp, Escherichia coli
atgaaaaaacaaacccagctgttgagtgcattagcgttaagtgtcgggttaactctctcggcgtcatttcaggccgtcgcgtcgattccaggccaggttgccgatcaggcccccctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccaataaaggctatgtgctgaccaacaaccatgtgattaatcaggcacagaaaatcagtattcagctcaatgatgggcgcgagtttgatgcaaaactgattggtagcgatgaccagagcgatatcgccctgttgcaaattcaaaacccgagcaaattaacgcaaatcgctattgccgactccgataaattgcgcgtcggtgattttgccgtggcggtcggtaacccatttggccttgggcaaaccgccacctctggcattatatccgcattaggccgcagcgggttgaatcttgaaggtctggaaaactttatccagacagatgcttccattaaccgcggtaactccggcggtgcactgttaaaccttaacggtgagttaattggcatcaacactgcaatccttgcgcctggcggcggtagcgtcgggattggatttgccattcccagtaatatggcgcgaacactggcgcagcagcttatcgactttggagaaatcaaacgcggcctgttaggcatcaaaggcaccgagatgagtgccgatatcgccaaggccttcaaccttgacgtgcagcgtggcgcgtttgtcagcgaagtgttgccaggttctggctcggcgaaagcgggcgtcaaagcgggcgatattattaccagcctcaacggcaaaccgctgaatagctttgctgagttgcgctctcgtatcgcgaccaccgagccgggcacaaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggtggcaaaggtattaagatcgatgaggttgtcaaaggaagcccagctgctcaggctggcttgcaaaaagacgatgtgatcattggcgtcaaccgcgatcgggtgaactcgattgctgaaatgcgtaaagtgctggcggcaaaaccggccatcattgccctgcaaattgtacgcggcaatgaaagcctctacctactaatgcgttaa

SEQ ID NO: 7588 - protein, 455 aa, Escherichia coli
MKKQTQLLSALALSVGLTLSASFQAVASIPGQVADQAPLPSLAPMLEKVLPAVVSVRVEGTASQGQKIPEEFKKFFGDDLPDQPAQPFEGLGSGVIINANKGYVLTNNHVINQAQKISIQLNDGREFDAKLIGSDDQSDIALLQIQNPSKLTQIAIADSDKLRVGDFAVAVGNPFGLGQTATSGIISALGRSGLNLEGLENFIQTDASINRGNSGGALLNLNGELIGINTAILAPGGGSVGIGFAIPSNMARTLAQQLIDFGEIKRGLLGIKGTEMSADIAKAFNLDVQRGAFVSEVLPGSGSAKAGVKAGDIITSLNGKPLNSFAELRSRIATTEPGTKVKLGLLRNGKPLEVEVTLDTSTSSSASAEMITPALEGATLSDGQLKDGGKGIKIDEVVKGSPAAQAGLQKDDVIIGVNRDRVNSIAEMRKVLAAKPAIIALQIVRGNESLYLLMR

SEQ ID NO: 7589 - DNA, 1068 bp, Escherichia coli
atgtttgtgaagctcttacgttccgttgcgattggattaattgtcggcgctattctgctggttgccatgccttcgctgcgcagccttaacccgctttccactccgcaatttgacagtaccgatgagacgcctgccagctataatctggcggttcgccgcgccgcgccagcggtggttaacgtttataaccgcggtttgaacaccaactctcacaaccagcttgagatccgcaccctgggatctggtgtaatcatggatcaacgcgggtatatcatcaccaataaacacgtgatcaacgacgccgatcagatcatcgtcgccttacaggatggacgtgtatttgaagcattgctggtgggatctgactctctaaccgatctggcggtacttaaaattaatgccactggcggtttacctaccattccaatcaatgcacgtcgcgtaccgcacattggcgacgtggtactggcgatcggtaacccgtacaacctcgggcagaccattacccaggggattattagtgccacgggtcgaattggtctgaacccaaccgggcggcaaaacttcctgcaaactgatgcttccattaaccacggtaactctggcggcgcgctggtgaactcgctgggcgaactgatgggcattaacacgctatcgtttgataagagtaacgatggcgaaacgccggaaggcatcggctttgcgattcctttccagttagcaaccaaaattatggataagctgatccgcgatggtcgcgtgatccgcggctacattggcattggtggacgtgagatcgcaccactgcacgcgcaaggcggtggtatagatcaactgcaagggatcgtggttaatgaagtgtcacctgacggcccagcggcgaatgcgggtattcaggtcaatgatttgattatttcggtggataacaaaccggccatctctgctctggagacgatggatcaggtggcagaaattcgccctggttcggtgatcccggttgtcgtgatgcgtgacgataaacagttaacattgcaggtcaccattcaggaatatccggcgaccaactaa

SEQ ID NO: 7590 - protein, 355 aa, Escherichia coli
MFVKLLRSVAIGLIVGAILLVAMPSLRSLNPLSTPQFDSTDETPASYNLAVRRAAPAVVNVYNRGLNTNSHNQLEIRTLGSGVIMDQRGYIITNKHVINDADQIIVALQDGRVFEALLVGSDSLTDLAVLKINATGGLPTIPINARRVPHIGDVVLAIGNPYNLGQTITQGIISATGRIGLNPTGRQNFLQTDASINHGNSGGALVNSLGELMGINTLSFDKSNDGETPEGIGFAIPFQLATKIMDKLIRDGRVIRGYIGIGGREIAPLHAQGGGIDQLQGIVVNEVSPDGPAANAGIQVNDLIISVDNKPAISALETMDQVAEIRPGSVIPVVVMRDDKQLTLQVTIQEYPATN

SEQ ID NO: 7591 - DNA, 939 bp, Escherichia coli
atgaaagtcgcagtcctcggcgctgctggcggtattggccaggcgcttgcactactgttaaaaacccaactgccttcaggttcagaactctctctgtatgatatcgctccagtgactcccggtgtggctgtcgatctgagccatatccctactgctgtgaaaatcaaaggtttttcaggtgaagatgcgactccggcgctggaaggtgcagatgtcgttcttatctctgcaggcgtagcgcgtaaaccgggtatggatcgttccgacctgtttaacgttaacgccggcatcgtgaaaaacctggtacagcaagttgcgaaaacctgcccgaaagcgtgcattggtattatcactaacccggttaacactacagttgcgattgctgctgaagtgctgaaaaaagccggtgtttatgacaaaaacaaactgttcggcgttaccacgctggatatcattcgttccaacacctttgttgcggaactgaaaggcaaacagccaggcgaagttgaagtgccggttattggtggtcactctggtgttaccattctgccgctgctgtcacaggttcctggcgttagttttaccgagcaggaagtggctgatctgaccaaacgtatccagaacgcgggtactgaggtggttgaagcgaaagccggtggcgggtctgcaaccctgtctatgggccaggcagctgcacgttttggtctgtctctggttcgcgcactgcagggcgaacaaggcgttgtcgaatgtgcctacgttgaaggcgacggtcagtacgctcgtttcttctctcaaccgctgctgctgggtaaaaacggcgtggaagagcgtaaatctatcggtactctgagcgcatttgaacagaacgcgctggaaggtatgctggatacgctgaagaaagatatcgccctgggcgaagagttcgttaataagtaa

SEQ ID NO: 7592 - protein, 312 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGEEFVNK

SEQ ID NO: 7593 - DNA, 471 bp, Escherichia coli
atgcgaagctcggctaagcaagaagaactagttaaagcatttaaagcattacttaaagaagagaaatttagctcccagggcgaaatcgttgccgcgttgcaggagcaaggctttgacaatattaatcagtctaaagtctcgcggatgttgaccaagtttggtgctgtacgtacacgcaatgccaaaatggaaatggtttactgcctgccagctgaactgggtgtaccaaccacctccagtccattgaagaatctggtactggatatcgactacaacgatgcagttgtcgtgattcataccagccctggtgcggcgcagttaattgctcgcctgctggactcactgggcaaagcagaaggtattctgggcaccatcgctggcgatgacaccatctttactacccctgctaacggtttcaccgtcaaagagctgtacgaagcgattttagagctgttcgaccaggagctttaa

SEQ ID NO: 7594 - protein, 156 aa, Escherichia coli
MRSSAKQEELVKAFKALLKEEKFSSQGEIVAALQEQGFDNINQSKVSRMLTKFGAVRTRNAKMEMVYCLPAELGVPTTSSPLKNLVLDIDYNDAVVVIHTSPGAAQLIARLLDSLGKAEGILGTIAGDDTIFTTPANGFTVKELYEAILELFDQEL

SEQ ID NO: 7595 - DNA, 315 bp, Escherichia coli
atgggtcacgaaacaaaggcccagctaaaagattatgtcgaggtaaaaatcatgaaaatcaaaaccactgttgctgcattaagtgtgctttctgttctctctttcggtgcattcgctgccgactccattgatgctgcacaagcacaaaatcgtgaagcaatcgggaccgtatccgtaagtggtgtggcgtcttcgccaatggatatgcgtgaaatgctgaacaaaaaagcggaagagaaaggcgcaacggcctaccagattactgaagctcgtagtggtgacacctggcacgctacggctgaactgtacaaataa

SEQ ID NO: 7596 - protein, 104 aa, Escherichia coli
MGHETKAQLKDYVEVKIMKIKTTVAALSVLSVLSFGAFAADSIDAAQAQNREAIGTVSVSGVASSPMDMREMLNKKAEEKGATAYQITEARSGDTWHATAELYK

SEQ ID NO: 7597 - DNA, 273 bp, Escherichia coli
atgaatatttatacctttgattttgatgagattgagagtcaggaggatttttatcgtgactttagccaaacctttggtctggcgaaagataaggtacgcgatctcgactcactatgggatgtgttaatgaacgatgtcctgccgctaccacttgagattgaatttgttcatctgggagagaaaacgcgtcgccgttttggcgcgttaatattgctgtttgatgaggcagaggaagaactggaagggcatttgcgttttaatgttcgtcattag

SEQ ID NO: 7598 - protein, 90 aa, Escherichia coli
MNIYTFDFDEIESQEDFYRDFSQTFGLAKDKVRDLDSLWDVLMNDVLPLPLEIEFVHLGEKTRRRFGALILLFDEAEEELEGHLRFNVRH

SEQ ID NO: 7599 - DNA, 1968 bp, Escherichia coli
atgggtattttctccattgctaatcaacatattcgctttgcggtaaaactggcgaccgccattgtactggcgctgtttgttggctttcacttccagctggaaacgccacgctgggcggtactgacagcggcgattgttgccgccggtccggcctttgctgcgggaggtgaaccgtattctggcgctattcgctatcgtggctttttgcgcatcatcggcacatttattggctgtattgccggactggtaatcatcattgcgatgatccgagcaccattattgatgattctggtgtgctgtatctgggccggtttttgtacctggatatcctcgctggtacgaatagaaaactcgtatgcgtgggggctggccggttataccgcgctgatcattgtgatcactattcagccggaaccattgcttacgccgcagtttgccgtcgaacgttgtagcgagatcgttatcggtattgtgtgtgcaattatggcggatttgctcttttctccgcgatcgatcaaacaagaagtggatcgagagctggaaagtttgctggtcgcgcaatatcaattaatgcaactctgtatcaagcatggcgatggtgaagttgtcgataaagcctggggcgatctggtgcgacgtactacggcgttacaaggtatgcgcagcaacctgaatatggaatcttcccgctgggcgcgggccaatcgacgtttaaaagcgatcaatacgctatcgctgacgctgattacccaatcctgcgaaacttatcttattcagaatacgcgcccggaattgatcactgatacttttcgcgaattttttgacacaccggtagaaactgcgcaggacgtccacaagcagctcaaacgcctgcggagagttatcgcctggaccggggaacgggaaacgcctgtcaccatttatagctgggtcgcggcggcaacgcgttatcagcttctcaagcgcggcgttatcagtaacacaaaaatcaacgccaccgaagaagagatcctgcaaggcgaaccggaagtaaaagtagagtcagccgaacgtcatcatgcaatggttaacttctggcgaaccacactttcttgcattctgggcacgcttttctggctgtggacgggctggacttccggcagtggtgcaatggtgatgattgcggtagtgacgtcactggcaatgcgtttgccgaatccacgcatggtggcgatcgactttatctacgggacgctggcagcgctaccgttagggctgctctactttttggtgattatccctaatacccaacagagcatgttgctgctgtgtattagcctggcagtgctgggattcttcctcggtatagaagtacagaaacggagattgggctcgatgggggcgttggccagcaccataaacattatcgtgctggataacccgatgactttccatttcagtcagtttctcgacagcgcattagggcaaatcgtcggctgtgtgctcgcgttcaccgttattttgctggtgcgggataaatcgcgcgacaggactggacgtgtactgcttaatcagtttgtttctgccgctgtttccgcgatgactaccaatgtggcacgtcgtaaagagaatcacctcccggcactttatcagcagctgtttttgctgatgaataagttcccaggggatttgccgaaatttcgcctggcgctgacgatgattatcgcgcaccagcgcctgcgtgatgcgccgatcccggttaacgaggatttatcggcgtttcaccgacaaatgcgccgcacagcagaccatgtgatatctgcccgtagcgatgataaacgtcgtcggtactttggccagttgctggaagaactggaaatctaccaggaaaagctacgcatctggcaagcgccaccgcaggtgacggaaccagtacatcggcttacgggtatgctccataagtatcaacatgcgttgaccgatagttaa

SEQ ID NO: 7600 - protein, 655 aa, Escherichia coli
MGIFSIANQHIRFAVKLATAIVLALFVGFHFQLETPRWAVLTAAIVAAGPAFAAGGEPYSGAIRYRGFLRIIGTFIGCIAGLVIIIAMIRAPLLMILVCCIWAGFCTWISSLVRIENSYAWGLAGYTALIIVITIQPEPLLTPQFAVERCSEIVIGIVCAIMADLLFSPRSIKQEVDRELESLLVAQYQLMQLCIKHGDGEVVDKAWGDLVRRTTALQGMRSNLNMESSRWARANRRLKAINTLSLTLITQSCETYLIQNTRPELITDTFREFFDTPVETAQDVHKQLKRLRRVIAWTGERETPVTIYSWVAAATRYQLLKRGVISNTKINATEEEILQGEPEVKVESAERHHAMVNFWRTTLSCILGTLFWLWTGWTSGSGAMVMIAVVTSLAMRLPNPRMVAIDFIYGTLAALPLGLLYFLVIIPNTQQSMLLLCISLAVLGFFLGIEVQKRRLGSMGALASTINIIVLDNPMTFHFSQFLDSALGQIVGCVLAFTVILLVRDKSRDRTGRVLLNQFVSAAVSAMTTNVARRKENHLPALYQQLFLLMNKFPGDLPKFRLALTMIIAHQRLRDAPIPVNEDLSAFHRQMRRTADHVISARSDDKRRRYFGQLLEELEIYQEKLRIWQAPPQVTEPVHRLTGMLHKYQHALTDS

SEQ ID NO: 7601 - DNA, 933 bp, Escherichia coli
gtgaaaacactaataagaaaattctcccgtacggccatcacggtcgtattagtcattctggccttcatcgcaatttttaatgcctgggtctattacaccgaatccccgtggacgcgtgacgcgcgctttagcgctgacgtcgttgcgatcgcgccggacgtttctggactcattacccaggtgaatgttcatgataaccagctggtgaaaaaaggacaggtactgttcaccatcgaccagccgcgctatcaaaaggcgcttgaggaagcgcaagccgatgttgcttattatcaggtactggcacaggagaaacgccaggaggccggacgtcgtaaccgtctcggtgtgcaggcgatgtctcgcgaagagatcgaccaggcgaacaacgtactacaaacagttctgcatcagttagcgaaagcgcaggcgacccgcgatctggcaaaactggatcttgaacgtacagtcatccgcgcgccagcagatggctgggtgaccaacctcaacgtctataccggtgagtttattactcgaggatcaacggcggttgcgctggtgaaacagaactccttctatgtactggcctatatggaagaaactaagctggaaggggtgcgccctgggtatcgtgcggagatcacgccgcttggcagtaacaaagtgctgaaagggactgttgatagtgttgccgcaggggtcaccaatgccagcagcacgcgtgacgacaaagggatggcgaccatcgactctaaccttgaatgggtacgtttggcgcaacgtgttccggtacgtattcgtctcgacaaccagcaagagaacatctggcctgcgggcaccactgctacggtggtagtcactggcaaacaagatcgcgacgaaagtcaggattcgttcttccgtaaaatggctcatcgcctgcgtgagtttggttaa

SEQ ID NO: 7602 - protein, 310 aa, Escherichia coli
MKTLIRKFSRTAITVVLVILAFIAIFNAWVYYTESPWTRDARFSADVVAIAPDVSGLITQVNVHDNQLVKKGQVLFTIDQPRYQKALEEAQADVAYYQVLAQEKRQEAGRRNRLGVQAMSREEIDQANNVLQTVLHQLAKAQATRDLAKLDLERTVIRAPADGWVTNLNVYTGEFITRGSTAVALVKQNSFYVLAYMEETKLEGVRPGYRAEITPLGSNKVLKGTVDSVAAGVTNASSTRDDKGMATIDSNLEWVRLAQRVPVRIRLDNQQENIWPAGTTATVVVTGKQDRDESQDSFFRKMAHRLREFG

SEQ ID NO: 7603 - DNA, 273 bp, Escherichia coli
atgcccttctctgcggcgacagatgctgaaaataataacgcctgctctctctatacaaccaaggtcaacatgagtctgtttcccgttatcgtggtgtttgggctgtccttcccaccgatatttttcgaattgcttttatcactggcgattttctggctggtgcgccgggtacttgtgccaacaggtatttacgactttgtctggcatccggcgttgttcaacaccgcgctctattgctgcttgttttatttgatatcgcgactgttcgtttga

SEQ ID NO: 7604 - protein, 90 aa, Escherichia coli
MPFSAATDAENNNACSLYTTKVNMSLFPVIVVFGLSFPPIFFELLLSLAIFWLVRRVLVPTGIYDFVWHPALFNTALYCCLFYLISRLFV

SEQ ID NO: 7605 - DNA, 126 bp, Escherichia coli
atggacgaaacgctcatctgtagctgtctggcggcggcggtaaaagagccaaattcaactactttggcaaacaccgacatgcgttttagtcgttccattattcactctgacttaaaagtgatttag

SEQ ID NO: 7606 - protein, 41 aa, Escherichia coli
MDETLICSCLAAAVKEPNSTTLANTDMRFSRSIIHSDLKVI

SEQ ID NO: 7607 - DNA, 849 bp, Escherichia coli
atgagcgtttcgtccatcagtcagacggtgtcaaaactggaagatgagttacaggtaaagctgttaaaccgtagtacacgcagcattggcctgactgaagccggcagaatttactaccagggctgccgtcggatgctccatgaagtgcaggatgttcatgagcaactgtatgccttcaataacacccccatcgggacgctgcgcattggctgttcttcaactatggcacaaaatgttctcgccgggctgacggcaaaaatgctgaaagaatacccaggtttgagtgtcaatctggttaccggaattcctgcccccgacctgattgccgacggtctggatgtggtgatccgcgtcggcgcgttgcaagattccagcctgttttcccgccgtctgggcgcgatgccaatggtggtgtgcgccgcaaaaagctatctcacacaatacggcataccagaaaaacccgccgatttaagtagtcattcatggcttgaatacagcgtgcgacccgacaatgaatttgaactgatcgcaccggaagggatctcgactcgcctgatcccgcaagggagatttgtgactaatgatccgatgacgctggtgcgctggctgactgcaggcgctgggatcgcctacgtgccgttgatgtgggtgatcaacgagatcaatcgcggggaactggagatcctgctgccacgttaccagtcagacccacgcccggtttatgcgttatataccgaaaaagataagctgccgctgaaggtacaagtcgtgatcaactcgctaacggattattttgttgaggtcggtaaattgtttcaggagatgcacgggcgcgggaaagagaagtaa

SEQ ID NO: 7608 - protein, 282 aa, Escherichia coli
MSVSSISQTVSKLEDELQVKLLNRSTRSIGLTEAGRIYYQGCRRMLHEVQDVHEQLYAFNNTPIGTLRIGCSSTMAQNVLAGLTAKMLKEYPGLSVNLVTGIPAPDLIADGLDVVIRVGALQDSSLFSRRLGAMPMVVCAAKSYLTQYGIPEKPADLSSHSWLEYSVRPDNEFELIAPEGISTRLIPQGRFVTNDPMTLVRWLTAGAGIAYVPLMWVINEINRGELEILLPRYQSDPRPVYALYTEKDKLPLKVQVVINSLTDYFVEVGKLFQEMHGRGKEK

SEQ ID NO: 7609 - DNA, 1446 bp, Escherichia coli
atgagtcttaacctggtaagtgaacaattgctagcggcgaacggcctgaaacatcaggacttgttcgcgatcctcggtcaactggccgaacgtcgccttgattatggcgatctctattttcagtcgagctatcacgaatcctgggttttagaagaccgcattattaaagatggttcttacaacatcgatcagggcgttggtgtgcgtgcaatcagcggtgaaaaaaccggatttgcttacgctgaccaaatcagcctgctggcgctggaacaaagtgcgcaagcggcgcgcaccatcgtccgtgatagtggtgatggcaaagtacagacgctgggcgcggtagagcatagcccgttgtatacctcggtagatccgctgcaaagcatgagccgtgaagagaagctggatatcctgcgtcgcgtcgataaggttgcccgcgaagcggacaagcgcgtacaagaagtgactgccagcctcagcggcgtttatgaattaattctggttgcggccaccgacggcacgctggcggcggatgttcgtccgctggtgcgtctttccgtgagcgttctggtcgaagaagatggcaaacgcgaacgcggtgccagtggcggcggcggtcgttttggttatgagttcttccttgccgatctcgacggtgaagtccgtgcggatgcatgggcaaaagaagctgtgcgtatggcgctggtcaatctttctgccgtcgccgcaccagcaggcaccatgccggtagtacttggcgcaggttggccgggcgtgctgttgcatgaagcggtgggtcacggtctggaaggcgacttcaaccgccgtggcacttcagtatttagtggacaggtcggggagctggtggcttcagaactgtgtaccgtggttgatgacggtacgatggtcgatcgccgtggttcggtggcgattgatgacgaaggtacgccaggccagtacaacgtgctgattgagaacggcattctgaaaggctacatgcaggataaactcaacgcgcgtttgatggggatgacgccgactggcaacggtcgccgtgaatcctacgcccatctgcccatgccgcgtatgaccaacacctatatgctgccgggtaaatcgaccccgcaggaaattattgaatccgttgagtacggtatctatgcaccgaactttggtggcggtcaggtggatatcacctccggcaaattcgttttctccacttcagaagcgtatctgattgaaaacggtaaagtaacgaagccggtgaaaggcgcaacgttgattggttccggtatcgaaaccatgcagcagatttcgatggttggcaacgacctgaaactggataacggcgtgggtgtctgcggtaaagaagggcaaagtttgccggttggcgtgggccagccaacgctgaaagttgataacctgactgttggcggtactgcgtaa

SEQ ID NO: 7610 - protein, 481 aa, Escherichia coli
MSLNLVSEQLLAANGLKHQDLFAILGQLAERRLDYGDLYFQSSYHESWVLEDRIIKDGSYNIDQGVGVRAISGEKTGFAYADQISLLALEQSAQAARTIVRDSGDGKVQTLGAVEHSPLYTSVDPLQSMSREEKLDILRRVDKVAREADKRVQEVTASLSGVYELILVAATDGTLAADVRPLVRLSVSVLVEEDGKRERGASGGGGRFGYEFFLADLDGEVRADAWAKEAVRMALVNLSAVAAPAGTMPVVLGAGWPGVLLHEAVGHGLEGDFNRRGTSVFSGQVGELVASELCTVVDDGTMVDRRGSVAIDDEGTPGQYNVLIENGILKGYMQDKLNARLMGMTPTGNGRRESYAHLPMPRMTNTYMLPGKSTPQEIIESVEYGIYAPNFGGGQVDITSGKFVFSTSEAYLIENGKVTKPVKGATLIGSGIETMQQISMVGNDLKLDNGVGVCGKEGQSLPVGVGQPTLKVDNLTVGGTA

SEQ ID NO: 7611 - DNA, 3801 bp, Escherichia coli
gtgaggcgattgccggggattttactgcttactggagccgcgctcgttgtgatcgctgccctgctggttagcggcctgcgtattgctttaccgcatcttgacgcctggcgtccggaaatcctcaacaaaatagaatccgcgactggcatgccggtagaagccagtcagctctcagccagctggcagaattttggtccgacgcttgaagcgcacgacatccgtgcagaactaaaagatggcggcgaattttcggttaaacgcgttactcttgcgctggatgtctggcagagcctgttacatatgcgctggcagtttcgcgacctcactttctggcagctgcgctttcgcaccaacactcctatcaccagcggcggtggtaatgatagcctggaagccagtcacatcagcgatctgtttcttcgtcaatttgaccatttcgatctccgcgacagtgaagtcagtttcctgacgccatccggtcagcgcgccgagctggcgatcccacagctcacctggctgaacgatccacgtcgacaccgtgcggaaggcctggtaagcctctccagccttaccggacagcacggcgtgatgcaggtgcgtatggatttgcgcgatgatgaggggttgttaagcaatggtcgcgtctggctccaggcggatgacatcgacctgaagccgtggctcggtaaatggatgcaggacaatattgcgctggaaacggcacagttctcccttgaaggctggatgacgatcgacaaaggcgatgtaaccggcggtgacgtctggctgaaacagggcggtgccagctggttgggcgagaaggaaacacatacgctgtcggtggataatctgactgcgcatattacgcgtgaaaatccgggatggcagttctctattcccgatacacggatcacgatggacggcaaaccctggccgagcggagcattgacgctggcctggataccggaacaggacgttggcggcaaagacaataaacgcagtgacgaactccggattcgcgccagtaatctggagctggcaggcctggagggcgtacgcccgctggtcgcgaaactttcacctgcactgggtgatgtttggcgctccacacaaccgagcggcaagattaacactctggcgctggatatcccgcttcaggcggcagacaagacccgttttcaggcatcgtggagcgatctggcctggaagcaatggaaattattaccgggtgcggaacacttctccgggacgctttccggcagcgtagaaaatggtttgcttactgcgtcgatgaagcaggcaaagatgccttacgaaacggtattccgtgcgccactggaaatcgccgacggccaggcaacgataagctggctgaacaatgacaaaggtttccagctggatgggcgtaatattgacgttaaagccaaagccgtccatgcgcgcggcggttttcgttacctgcaacctgctaacgatgaaccctggctgggtattctggctggcatcagtaccgatgatggttcacaagcctggcgctatttcccggaaaacttgatgggtaaagacctggttgattacttaagtggcgcgattcagggcggtgaagcggataacgcgacgctggtttatggtggcaatccgcaactcttcccctataaacacaacgaaggtcagtttgaagtgctggtgccgctgcgcaacgcgaagtttgccttccagccggactggcctgcattaactaaccttgatattgaactggactttattaacgacggtttatggatgaaaaccgatggcgttaatctgggcggcgtgcgcgcgagtaatctcaccgcagtgatccctgactactcaaaagaaaaactgctgattgacgctgacattaaaggtccgggtaaagccgttggcccttactttgatgagacaccgctgaaagattccctgggtgcgaccctgcaagaactccagctcgacggcgatgtgaatgctcgcttacatcttgatatcccgctgaacggcgagttggtaaccgcgaaaggtgaagtgacgctgcgtaataacagtctgtttatcaaaccactcgacagcaccctgaaaaatttgagcggtaaattcagctttatcaatggcgatctgcaaagtgaaccactgacagcaagctggtttaatcagccgttgaacgtggatttttccaccaaggaaggggcaaaagcctaccaggtagcggtaaacctcaacggtaactggcaaccggcgaaaaccggcgttctgcctgtagcggtgaacgaagcattgagtggcagcgtggcgtgggatggtaaagtgggcattgatctgccttatcatgctggcgcgacctataacgtagagctgaacggcgatttgaagaatgtgagcagtcacttaccttcaccgttagccaaacctgcgggtgaaccactagcggtaaacgttaaggttgatggcaatctcaacagctttgaattaaccggacaggctggtgcggataaccatttcaatagccgctggttgctcggtcaaaagctgacgctcgatcgtgctatttgggcggcagacagtaaaacgctcccgccgttgccggaacaaagtggcgttgaactcaatatgccgccgatgaatggtgccgagtggctggccctgttccagaaaggcgcggcggagagtgtcggtggtgcagcgagtttcccacaacacataacgttacgtacgcctatgttgtcgctgggaaatcagcaatggaataacctgagtattgtttcgcaaccgacggcaaatggcaccctggttgaggcgcaagggcgtgaaatcaacgccacgctggcgatgcgtaataacgcaccgtggctggcgaatatcaaatatctttattacaacccaagcgtggcgaaaactcgtggtgattcaacacagtcatcacctttcccgacaacggaacgcattaacttccgtggctggccagacgcacaaatacgatgcgcagagtgctggttctgggggcaaaaattcggtcgtattgacagtgatatcaccatttctggcgatacgttaacgctgactaatggactgattgatactggtttttcgcggctcactgccgatggtgaatgggttaacaatccggggaatgaacgtacctcgctgaaaggaaaactgcgcgggcagaaaattgatgccgccgcagaattttttggtgtcacgacgcccatacgccagtcgtcatttaatgtggattacgatttacactggcgcaaagcaccctggcagccagatgaggcgacgttgaatggcatcattcatactcaactgggtaaaggcgaaattaccgaaatcaataccggacatgccgggcaattgctgcgcttattgagcgtagatgccctgatgcgtaagctgcgttttgatttcagagacacttttggcgaagggttctattttgactccattcgcagcaccgcgtggattaaagacggcgttatgcacaccgacgacacgctggtggatggcctggaagcggacatcgctatgaaagggtcggtaaatctggtacgtcgcgacctgaatatggaagcggttgtcgcaccagagatttctgcgacggtcggcgtggctgcggcctttgcggttaaccccattgttggcgcggcagtgtttgccgccagtaaagtgctgggaccgctgtggagcaaagtctccattttgcgctatcacatttcgggtccgctggacgatccgcaaatcaacgaagtgttgcgacaaccgcgcaaagaaaaagcgcaatga

SEQ ID NO: 7612 - protein, 1266 aa, Escherichia coli
MRRLPGILLLTGAALVVIAALLVSGLRIALPHLDAWRPEILNKIESATGMPVEASQLSASWQNFGPTLEAHDIRAELKDGGEFSVKRVTLALDVWQSLLHMRWQFRDLTFWQLRFRTNTPITSGGGNDSLEASHISDLFLRQFDHFDLRDSEVSFLTPSGQRAELAIPQLTWLNDPRRHRAEGLVSLSSLTGQHGVMQVRMDLRDDEGLLSNGRVWLQADDIDLKPWLGKWMQDNIALETAQFSLEGWMTIDKGDVTGGDVWLKQGGASWLGEKETHTLSVDNLTAHITRENPGWQFSIPDTRITMDGKPWPSGALTLAWIPEQDVGGKDNKRSDELRIRASNLELAGLEGVRPLVAKLSPALGDVWRSTQPSGKINTLALDIPLQAADKTRFQASWSDLAWKQWKLLPGAEHFSGTLSGSVENGLLTASMKQAKMPYETVFRAPLEIADGQATISWLNNDKGFQLDGRNIDVKAKAVHARGGFRYLQPANDEPWLGILAGISTDDGSQAWRYFPENLMGKDLVDYLSGAIQGGEADNATLVYGGNPQLFPYKHNEGQFEVLVPLRNAKFAFQPDWPALTNLDIELDFINDGLWMKTDGVNLGGVRASNLTAVIPDYSKEKLLIDADIKGPGKAVGPYFDETPLKDSLGATLQELQLDGDVNARLHLDIPLNGELVTAKGEVTLRNNSLFIKPLDSTLKNLSGKFSFINGDLQSEPLTASWFNQPLNVDFSTKEGAKAYQVAVNLNGNWQPAKTGVLPVAVNEALSGSVAWDGKVGIDLPYHAGATYNVELNGDLKNVSSHLPSPLAKPAGEPLAVNVKVDGNLNSFELTGQAGADNHFNSRWLLGQKLTLDRAIWAADSKTLPPLPEQSGVELNMPPMNGAEWLALFQKGAAESVGGAASFPQHITLRTPMLSLGNQQWNNLSIVSQPTANGTLVEAQGREINATLAMRNNAPWLANIKYLYYNPSVAKTRGDSTQSSPFPTTERINFRGWPDAQIRCAECWFWGQKFGRIDSDITISGDTLTLTNGLIDTGFSRLTADGEWVNNPGNERTSLKGKLRGQKIDAAAEFFGVTTPIRQSSFNVDYDLHWRKAPWQPDEATLNGIIHTQLGKGEITEINTGHAGQLLRLLSVDALMRKLRFDFRDTFGEGFYFDSIRSTAWIKDGVMHTDDTLVDGLEADIAMKGSVNLVRRDLNMEAVVAPEISATVGVAAAFAVNPIVGAAVFAASKVLGPLWSKVSILRYHISGPLDDPQINEVLRQPRKEKAQ

SEQ ID NO: 7613 - DNA, 1470 bp, Escherichia coli
atgacggctgaattgttggtaaacgtaacgccttcggaaactcgagtggcgtatattgatggcggtattctgcaggaaattcatattgaacgtgaggcgcgacgcggaatagtaggcaatatctacaagggtcgtgtaagtcgtgtacttccgggtatgcaggcggcttttgtagatattgggctggataaagccgcgtttcttcatgcatctgacatcatgccgcacactgaatgtgtggcgggtgaagaacaaaagcaattcacggtgcgcgacatctcggaactggtccgtcaggggcaagatctgatggtgcaggtggtgaaagatccgcttggcactaaaggtgcgcgcctgaccaccgatatcacgctgccttctcgctatctggtgtttatgccaggggcttctcacgttggggtatcccaacgaattgaaagcgaatcagaacgtgaacgcctgaaaaaagtggtcgcagagtattgcgacgagcagggcgggtttatcatccgtactgcagcggaaggggttggcgaggctgaactggcctccgatgccgcttatctgaaacgcgtctggaccaaagttatggagcgtaaaaaacgcccgcagacccgttatcagctgtacggagaactggcgctggcgcagcgtgttctgcgtgatttcgccgacgccgaactcgaccgcattcgcgttgactcacgcctgacttacgaagcattgctggagtttacctcggagtacattcccgagatgaccagcaagctggagcattacaccggacgccagccgattttcgatctctttgatgtcgaaaacgaaattcagcgagcgctggaacgcaaagtagaactgaaatccggtggttatctgattatcgaccagaccgaagcgatgaccaccgtggacatcaataccggagcgtttgtcggtcatcgcaatctggacgacaccattttcaataccaatattgaagcgacgcaggctatcgctcgccagttacggttgcgcaatctgggcgggattatcattattgatttcatcgatatgaataatgaagatcaccgtcgccgcgtgctgcactcgctggagcaggcgctgagcaaagatcgggtgaaaaccagcgttaatggtttttcggcgctggggctggtggagatgacgcgtaaacgcacccgcgaaagcattgagcacgtactgtgtaacgaatgcccaacctgccacggtcgcggaacggtgaaaaccgtggaaacggtatgctatgaaatcatgcgcgagattgttcgtgtccaccatgcttacgactccgaccgtttcctggtctatgcttctccggcagtagccgaagccttgaaaggcgaagagtcacactcgctggcggaagtggaaattttcgttggcaaacaggttaaagtacaaattgaaccgctctataaccaggagcagtttgacgtcgtaatgatgtaa

SEQ ID NO: 7614 - protein, 489 aa, Escherichia coli
MTAELLVNVTPSETRVAYIDGGILQEIHIEREARRGIVGNIYKGRVSRVLPGMQAAFVDIGLDKAAFLHASDIMPHTECVAGEEQKQFTVRDISELVRQGQDLMVQVVKDPLGTKGARLTTDITLPSRYLVFMPGASHVGVSQRIESESERERLKKVVAEYCDEQGGFIIRTAAEGVGEAELASDAAYLKRVWTKVMERKKRPQTRYQLYGELALAQRVLRDFADAELDRIRVDSRLTYEALLEFTSEYIPEMTSKLEHYTGRQPIFDLFDVENEIQRALERKVELKSGGYLIIDQTEAMTTVDINTGAFVGHRNLDDTIFNTNIEATQAIARQLRLRNLGGIIIIDFIDMNNEDHRRRVLHSLEQALSKDRVKTSVNGFSALGLVEMTRKRTRESIEHVLCNECPTCHGRGTVKTVETVCYEIMREIVRVHHAYDSDRFLVYASPAVAEALKGEESHSLAEVEIFVGKQVKVQIEPLYNQEQFDVVMM

SEQ ID NO: 7615 - DNA, 531 bp, Escherichia coli
gtgacctttgaacgtattgttacgggcattgaggagcagcgtcagccgcaggagagcgcgcagcagtatgttgtgcgtctggcgcgcgagaaagcacaggcgggtgtcgcgcaaacggcgcaggatctcccggtgctgggtgcggatactatcgttatcctgaacggagaagtgctcgagaaaccgcgcgacgcagagcatgcggcgcagatgttgcgcaaattatcgggtcagacccatcaggtgatgacggcagtggcgttggctgacagccagcacattctcgattgcctggtggtcaccgatgtgactttcagaacgttaacagacgaagacatcgcgggctatgtcgccagcggcgaaccgttagataaagcaggtgcatacggtattcaggggctgggtggctgttttgtcaggaagataaatggcagctttcacgccgtagtcggcttaccgctggttgaaacgtatgaattattaagtaattttaacgcactgcgtgagaaaagggataaacatgacggctga

SEQ ID NO: 7616 - protein, 176 aa, Escherichia coli
MTFERIVTGIEEQRQPQESAQQYVVRLAREKAQAGVAQTAQDLPVLGADTIVILNGEVLEKPRDAEHAAQMLRKLSGQTHQVMTAVALADSQHILDCLVVTDVTFRTLTDEDIAGYVASGEPLDKAGAYGIQGLGGCFVRKINGSFHAVVGLPLVETYELLSNFNALREKRDKHDG

SEQ ID NO: 7617 - DNA, 489 bp, Escherichia coli
gtggcgagctatcgtagccagggacgctgggtaatctggctctctttcctcattgcgctgttgctgcaaatcatgccctggccggataatctgattgttttccggccaaactgggtgttactcatcttgttgtattggatcctggccttgccccatcgcgtaaatgtgggcacaggttttgtgatgggtgccatactggatctgatcagcggctcgacgcttggcgtacgcgtattggcgatgagcatcattgcttacctggtggcgctgaaataccagcttttccgcaacctcgcattatggcagcaggcgctggtcgtcatgttgctttcgctggtggtggatattattgttttctgggcagagtttttagtgattaacgtctctttcagaccggaagtgttctggagtagtgtagtcaatggggtgctctggccgtggattttcttgctgatgcgtaaagtccgtcagcagtttgcagtgcaataa

SEQ ID NO: 7618 - protein, 162 aa, Escherichia coli [sequence omitted]

SEQ ID NO: 7619 - DNA, 924 bp, Escherichia coli
atggcgtatcgcagacgctgggcctcgcgtgaccaactagaacttgaaaaccgggcgttacgtcaggaactgttgctgaaaaacagtgaactgctgatgcttggacaatacaaacaggagaacgcgcgtctgcgcgagctgctgggttccccgctgcgtcaggatgagcagaaaatggtgactcaggttatctccacggttaacgatccttatagcgatcaagttgttatcgataaaggtagcgttaatggcgtttatgaaggccagccggtcatcagcgacaaaggtgttgttggtcaggtggtggccgtcgctaaactgaccagccgcgtgctgctgatttgtgatgcgacccacgcgctgccaatccaggtgctgcgcaacgatatccgcgtaattgcagccggtaacggttgtacggatgatttgcagcttgagcatctgccagcgaatacggatattcgtgttggtgatgtgctggtgacttccggtctgggcggtcgtttcccggaaggctatccggtcgcggttgtctcttccgtaaaactcgatacccagcgcgcttatactgtgattcaggcgcgtccgactgcaggactgcaacgtttgcgttatctgctgctgctgtggggcgcggatcgtaacggcgctaacccgatgacgccggaagaggtgcatcgtgttgctaatgaacgtttgatgcagatgatgccgcaggtattgccttcgccagacgcgatggggccaaagttacctgaaccggcaacggggatcactcagccgactccgcagcaaccggcgacaggaaatgcagttactgcgcctgctgcgcccacacagcccgctgctaatcgctctccacaaagggctacgccgccgcaaagtggtgctcaaccgcctgcgcgtgcgccgggaggacaatag

SEQ ID NO: 7620 - protein, 307 aa, Escherichia coli
MAYRRRWASRDQLELENRALRQELLLKNSELLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPKLPEPATGITQPTPQQPATGNAVTAPAAPTQPAANRSPQRATPPQSGAQPPARAPGGQ

SEQ ID NO: 7621 - DNA, 213 bp, Escherichia coli
atgaagccaatttttagccgtggcccgtcgctacagattcgccttattctggcggtgctggtggcgctcggcattattattgccgacagccgcctggggacgttcagtcaaatccgtacttatatggataccgccgtcagtcctttctactttgtttccaatgctcctcgtgaattgctggatggcgtatcgcagacgctgggcctcgcgtga

SEQ ID NO: 7622 - protein, 70 aa, Escherichia coli
MKPIFSRGPSLQIRLILAVLVALGIIIADSRLGTFSQIRTYMDTAVSPFYFVSNAPRELLDGVSQTLGLA

SEQ ID NO: 7623 - DNA, 1119 bp, Escherichia coli
ttgtcgctgctgcgtgtggttggtaaagtaagcggattttcttttccgccccagctttcaggattatcccttagtatgttgaaaaaatttcgtggcatgttttccaatgacttgtccattgacctgggtactgcgaataccctcatttatgtaaaaggacaaggcatcgtattgaatgagccttccgtggtggccattcgtcaggatcgtgccggttcaccgaaaagcgtagctgcagtaggtcatgacgcgaagcagatgctgggccgtacgccgggcaatattgctgccattcgcccaatgaaagacggcgttatcgccgacttcttcgtgactgaaaaaatgctccagcacttcatcaaacaagtgcacagcaacagctttatgcgtccaagcccgcgcgttctggtttgtgtgccggttggcgcgacccaggttgaacgccgcgcaattcgtgaatccgcgcagggcgctggtgcccgtgaagtcttcctgattgaagaaccgatggctgccgcaattggtgctggcctgccggtttctgaagcgaccggttctatggtggttgatatcggtggtggtaccactgaagttgctgttatctccttgaacggcgtggtttactcctcttccgtgcgcattggtggtgaccgtttcgacgaagctatcatcaactatgtacgtcgtaattacggttctctgatcggtgaagccaccgcagaacgtatcaagcacgaaatcggttcggcttacccgggcgatgaagtccgtgaaatcgaagttcgtggccgtaaccttgcagaaggtgttccacgcggttttaccctgaactccaacgaaatcctcgaagcactgcaggaaccgctgaccggtattgtgagcgcggtaatggttgcactggaacagtgcccgccggaactggcttccgatatctccgagcgcggcatggtgctcaccggtggtggcgcactgctgcgtaaccttgaccgtttgttaatggaagaaaccggcattccagtcgttgttgctgaagacccgctgacctgtgtggcgcgcggtggcggcaaagcgctggaaatgatcgacatgcacggcggcgacctgttcagcgaagagtaa

SEQ ID NO: 7624 - protein, 372 aa, Escherichia coli
MSLLRVVGKVSGFSFPPQLSGLSLSMLKKFRGMFSNDLSIDLGTANTLIYVKGQGIVLNEPSVVAIRQDRAGSPKSVAAVGHDAKQMLGRTPGNIAAIRPMKDGVIADFFVTEKMLQHFIKQVHSNSFMRPSPRVLVCVPVGATQVERRAIRESAQGAGAREVFLIEEPMAAAIGAGLPVSEATGSMVVDIGGGTTEVAVISLNGVVYSSSVRIGGDRFDEAIINYVRRNYGSLIGEATAERIKHEIGSAYPGDEVREIEVRGRNLAEGVPRGFTLNSNEILEALQEPLTGIVSAVMVALEQCPPELASDISERGMVLTGGGALLRNLDRLLMEETGIPVVVAEDPLTCVARGGGKALEMIDMHGGDLFSEE

SEQ ID NO: 7625 - DNA, 1941 bp, Escherichia coli
atgagattaacgacgaaattttcggcctttgtcacgctgctcaccgggttaacaatttttgtgactttgctgggctgttcgctaagtttctacaacgccattcagtataagtttagtcatcgtgttcaggcggtggcgacggcgattgatacccacctagtgtcgaatgacttcagcacattaaggccacaaattaccgaattaatgatgtcggcagatatcgttcgtgtagacctgctccatggtgataagcaggtttataccctggccagaaatggtagttatcgtccggttggcaccaacgatctgtttcgtgaactgagcgttccgttgataaagcatccggggatgtcgctgcgtctggtttatcaggatccgatgggcaactatttccattctttaatgactaccgcgccgctcacgggggcgattggctttatcattcttatgctcttcctggcggtacgctggttacaacggcaacttgccgggcaagaattgctggaaacccgggctactcgtatcttaaacggtgagcgtggctctaatgtgttgggaaccatctatgaatggccgcccagaaccagcagtgcgctggatacgctgctttgtgaaattcagaacgcacgcgaacaacacagccgtcttgatacgctgatccgctcttatgccgcccaggacatgaaaaccggcctcaataaccgactctttttcgataatcagttagcaacgttactggaagatcaagagaaagtaggtacccacgggatcgtgatgatgattcgtctgccggatttcaatatgttgagtgatacctgggggcacagccaggttgaagaacagttcttctctctgacgaatctgctatcgacatttatgatgcgctaccctggcgcactgctggcgcgttaccaccgcagtgattttgctgcgctgttaccgcaccggacgttaaaagaggcagagagcatcgccagtcagttaatcaaagccgtcgataccttgccgaacaataaaatgctcgatcgcgacgatatgatccacattggtatctgtgcctggcgtagtggtcaggataccgagcaggtaatggaacatgcagagtctgccacgcgtaatgcgggattgcagggcggcaatagctgggctatttacgatgactcgttgcctgaaaaaggacgcggtaatgttcgctggcgtacgcttatcgagcaaatgctcagtcgcggcggcccgcgcctttatcaaaaaccggcggttactcgcgaaggccgggttcatcatcgtgaactcatgtgccgcatcttcgatggtaatgaagaggttagctcggcagagtatatgccgatggtcttgcagtttggtttatcggaagagtatgaccgcctgctaatcagccgtcttattccactattgcgttactggccagaggaaaatctggcgattcaggttaccgttgagtcgctgattcgcccgcgttttcagcgttggctgcgcgatccgttaatgcaatgtgaaaaatcgcaacgaagacgcataattattgaacttgcagaggccgatgtaggtcaacatatcagtcgcttacaacctgttattcgtttagtgaatgctttaggggtacgggtagccgtcaaccaggctggtttgacgctggtaagcaccagttggatcaaagaacttaatgttgagttactcaagctccatccggggctggtcagaaacattgagaagcgaacggagaaccagctgctggttcaaagcctggtggaagcctgctccgggaccagcacccaggtttacgccaccggcgtacgttcgcgaagcgagtggcagaccctgattcagcgcggtgttacaggtgggcaaggggattttttcgcgtcctcacagccacttgatactaacgtgaaaaaatattcacaaagatactcggtttaa

SEQ ID NO: 7626 - protein, 646 aa, Escherichia coli
MRLTTKFSAFVTLLTGLTIFVTLLGCSLSFYNAIQYKFSHRVQAVATAIDTHLVSNDFSTLRPQITELMMSADIVRVDLLHGDKQVYTLARNGSYRPVGTNDLFRELSVPLIKHPGMSLRLVYQDPMGNYFHSLMTTAPLTGAIGFIILMLFLAVRWLQRQLAGQELLETRATRILNGERGSNVLGTIYEWPPRTSSALDTLLCEIQNAREQHSRLDTLIRSYAAQDMKTGLNNRLFFDNQLATLLEDQEKVGTHGIVMMIRLPDFNMLSDTWGHSQVEEQFFSLTNLLSTFMMRYPGALLARYHRSDFAALLPHRTLKEAESIASQLIKAVDTLPNNKMLDRDDMIHIGICAWRSGQDTEQVMEHAESATRNAGLQGGNSWAIYDDSLPEKGRGNVRWRTLIEQMLSRGGPRLYQKPAVTREGRVHHRELMCRIFDGNEEVSSAEYMPMVLQFGLSEEYDRLLISRLIPLLRYWPEENLAIQVTVESLIRPRFQRWLRDPLMQCEKSQRRRIIIELAEADVGQHISRLQPVIRLVNALGVRVAVNQAGLTLVSTSWIKELNVELLKLHPGLVRNIEKRTENQLLVQSLVEACSGTSTQVYATGVRSRSEWQTLIQRGVTGGQGDFFASSQPLDTNVKKYSQRYSV

SEQ ID NO: 7627 - DNA, 975 bp, Escherichia coli
atgcaggcgttacttttagaacagcaggacggcaaaactctcgcatcagtacagactctggacgaaagtcgccagccggaaggcgatgtcacggttgatgttcactggtcgagcctgaactacaaagatgcgctggcgattaccggtaagggaaaaatcatccgtaattttccgatgattcctgggatcgattttgccggaactgtacgcaccagcgaagatccgcgttttcatgccggtcaggaggtgttactcactggctggggcgttggtgaaaaccactggggtgggctggcggaacaggcgcgagtgaaaggtgactggctggttgccatgccgcaagggctggacgcgcgtaaagcaatgattatcggtactgccggttttaccgccatgctgtgtgtgatggcgctggaagatgccggtgttcgcccgcaggatggggagattgtcgtgacgggtgccagtggtggcgtcggcagtaccgccgtggcgctgctgcataagttgggttatcaggtcgttgctgtttccggtcgcgaaagtacccatgaatatctgaaaagtttaggtgccagccgtattcttcctcgcgatgagtttgctgaatcccgtcctctggaaaaacaagtctgggctggggcaattgacaccgttggcgacaaagtgctggcaaaagtgctggcgcaaatgaattacggcggctgcgtggcggcctgtggtctggcgggtggttttactctgccaaccacggtcatgccatttattctgcgtaatgtccgtttgcaaggggtggattcagtaatgacgccaccagcacgccgcgcacaagcctggcagcgactggtcgccgatttaccggaatcattctatacccaggcggcaaaagagatatctctggcagaggcaccgaagtttgccgaggccatcattaataaccagatccagggtcgcacgctggtgaaggttaactaa

SEQ ID NO: 7628 - protein, 324 aa, Escherichia coli
MQALLLEQQDGKTLASVQTLDESRQPEGDVTVDVHWSSLNYKDALAITGKGKIIRNFPMIPGIDFAGTVRTSEDPRFHAGQEVLLTGWGVGENHWGGLAEQARVKGDWLVAMPQGLDARKAMIIGTAGFTAMLCVMALEDAGVRPQDGEIVVTGASGGVGSTAVALLHKLGYQVVAVSGRESTHEYLKSLGASRILPRDEFAESRPLEKQVWAGAIDTVGDKVLAKVLAQMNYGGCVAACGLAGGFTLPTTVMPFILRNVRLQGVDSVMTPPARRAQAWQRLVADLPESFYTQAAKEISLAEAPKFAEAIINNQIQGRTLVKVN

SEQ ID NO: 7629 - DNA, 471 bp, Escherichia coli
atggatattcgtaagattaaaaaactgatcgagctggttgaagaatcaggcatctccgaactggaaatttctgaaggtgaagagtcagtacgcattagccgtgcagctcctgccgcaagtttccctgtgatgcaacaagcttacgctgcacctatgatgcagcagccagctcaatctaacgcagccgctccggcgaccgttccttccatggaagcgccagcagcagcggaaatcagtggtcacatcgtacgttccccgatggttggtactttctaccgcaccccaagcccggacgcaaaagcgttcatcgaagtgggtcagaaagtcaacgtgggcgataccctgtgcatcgttgaagccatgaaaatgatgaaccagatcgaagcggacaaatccggtaccgtgaaagcaattctggtcgaaagtggacaaccggtagaatttgacgagccgctggtcgtcatcgagtaa

SEQ ID NO: 7630 - protein, 156 aa, Escherichia coli
MDIRKIKKLIELVEESGISELEISEGEESVRISRAAPAASFPVMQQAYAAPMMQQPAQSNAAAPATVPSMEAPAAAEISGHIVRSPMVGTFYRTPSPDAKAFIEVGQKVNVGDTLCIVEAMKMMNQIEADKSGTVKAILVESGQPVEFDEPLVVIE

SEQ ID NO: 7631 - DNA, 1350 bp, Escherichia coli
atgctggataaaattgttattgccaaccgcggcgagattgcattgcgtattcttcgtgcctgtaaagaactgggcatcaagactgtcgctgtgcactccagtgcggatcgcgatctaaaacacgtattactggcagatgaaacggtctgtatcggccctgctccgtcagtaaaaagttatctgaacatcccggcaatcatcagcgccgctgaaatcaccggcgcagtagcaatccatccgggttacggcttcctctccgagaacgccaattttgccgagcaggttgaacgctccggctttatcttcatcggcccgaaagcagaaaccattcgcctgatgggcgacaaagtatccgcaatcgcggcgatgaaaaaagcaggcgttccttgcgtaccgggttctgacggcccgctgggcgacgatatggataaaaaccgcgccattgctaaacgcattggttatccggtgattatcaaagcctccggcggcggcggtggtcgcggtatgcgcgtagtgcgcagcgacgctgaactggcacaatccatctccatgacccgtgcggaagcgaaagcagctttcagcaacgatatggtttacatggagaaatacctggaaaatcctcgccacgtcgagattcaggtactggctgacggtcagggcaacgctatctatctggcggaacgtgactgctccatgcagcgccgccaccagaaagtggtcgaagaagcaccggcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttactgaaatgatcaccggcgttgacctgatcaaagaacaactgcgtatcgctgccggtcaaccgctgtcgatcaagcaagaagaagttcacgttcgcggccatgcggtggaatgccgtatcaacgccgaagatccgaacaccttcctgccaagtccgggcaaaatcacccgtttccacgcacctggtggttttggcgtacgttgggagtctcatatctacgcgggctacaccgtaccgccgtactatgactcaatgatcggtaagctgatttgctacggtgaaaaccgtgacgtggcgattgctcgcatgaagaatgcgctgcaggagctgatcatcgacggtatcaaaaccaacgttgatctgcagatccgcatcatgaatgacgaaaacttccagcatggtggcactaatatccactatctggagaaaaaactcggtcttcaggaaaaataa

SEQ ID NO: 7632 - protein, 449 aa, Escherichia coli
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKAETIRLMGDKVSAIAAMKKAGVPCVPGSDGPLGDDMDKNRAIAKRIGYPVIIKASGGGGGRGMRVVRSDAELAQSISMTRAEAKAAFSNDMVYMEKYLENPRHVEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVHVRGHAVECRINAEDPNTFLPSPGKITRFHAPGGFGVRWESHIYAGYTVPPYYDSMIGKLICYGENRDVAIARMKNALQELIIDGIKTNVDLQIRIMNDENFQHGGTNIHYLEKKLGLQEK

SEQ ID NO: 7633 - DNA, 429 bp, Escherichia coli
ttgctgtcggctaaaagcataacgccacgaactccgcatgcggcggaagggttagccagtcatctggagatttgtaccccacagcccggttttgacgagcaggtttactatctcacgttgaatagcgacagtcaggggatgagtaaagttgcgctggtgaacgccgaactggggtggggaatttacgagaaattcgacaccatgcagctacccaactttatccagtggaaaaatttaggcgcgggtgaatatgttatggggctggaggtcagcaatagttttcctgacggtcgtgataaagaacgagcgcaggggcgtctgccctttatagagccaggggaaacaaagacatactgctttgagctgggaattgttgatggcgatgctgaaattagcgcgttgaaagcggaaattgcaagctaccgttag

SEQ ID NO: 7634 - protein, 142 aa, Escherichia coli
MLSAKSITPRTPHAAEGLASHLEICTPQPGFDEQVYYLTLNSDSQGMSKVALVNAELGWGIYEKFDTMQLPNFIQWKNLGAGEYVMGLEVSNSFPDGRDKERAQGRLPFIEPGETKTYCFELGIVDGDAEISALKAEIASYR

SEQ ID NO: 7635 - DNA, 633 bp, Escherichia coli
atgaaaaacgaaatttggtcgtggattggcgatctctcgcaggttgccggaattaaacactatgagttacgtagtggcagagcaaagggtacagaagcgtttgatgtccgtactggtgcgggactggcatttacggtggtaaaagatcgcgcgctggatattgcatgggccagctacaaggacactgcgctctcttttatcacccccaacggtgttgtcgcccccgctttttttgagtctcagggcaacgggtttttacgtagcttttacgcggggttactgactacctgcggacttagctacattggcacgccctgtgaggatgaaggagaaacgctggggttacacgggcgtttggctgcgactccagcagaagaggtggggtatcgcacagaacggaccgacgacagcattgaatttgtcatcaatggcaaagtacgggaaacacgattgttcggtgaaaatctgacgctggaaaggaccattcgctgccgttatggcgaaaatgtaatgcgcattgaagacaaggtgactaatcatggtttcacccgccagccgctgcaaattctttatcactttaattacggctggccctttattatcgccacaggcagaaatcttgctgtcggctaa

SEQ ID NO: 7636 - protein, 210 aa, Escherichia coli
MKNEIWSWIGDLSQVAGIKHYELRSGRAKGTEAFDVRTGAGLAFTVVKDRALDIAWASYKDTALSFITPNGVVAPAFFESQGNGFLRSFYAGLLTTCGLSYIGTPCEDEGETLGLHGRLAATPAEEVGYRTERTDDSIEFVINGKVRETRLFGENLTLERTIRCRYGENVMRIEDKVTNHGFTRQPLQILYHFNYGWPFIIATGRNLAVG

SEQ ID NO: 7637 - DNA, 963 bp, Escherichia coli
atgagtaaggtcttcacaattggagaaattctggttgaaattatggcgagtaaaatcggccagccatttgatcaaccaggtatctggaacggcccttatcccagtggtgcgcccgctatttttatcgaccaggtgacacgtcttggcgtcccgtgcggcatcattagctgcgtggggaatgatggctttggtgatattaatatacatcgtctggctgctgacggtgtggacatcagggggatttcagtcttacctctggaagccaccggtagtgcctttgttacttatcataactctggcgatcgcgattttatttttaatatcaagaatgccgcttgcggtaaattatcggcacagcatgttgatgaaaatattctgaaggattgtacccattttcatattatgggttcatccctgttttcattccatatggtagacgcagtaaaaaaagcagtaaccatcgttaaagcaaatggtggcgttatttctttcgacccgaatattcgtaaagaaatgcttgatattccagaaatgcgcgatgccctccactttgttcttgagttaacggatatctatatgcccagtgagggggaagtgttgctcttgtcgccacactcgacgccggagcgtgcaatcgctggttttcttgaagaaggtgttaaagaggtgattgtgaagcgcggcaatcaaggagccagttactactccgcgaatgagcagtttcatgttgagagctatccggtggaagaagttgacccgaccggtgcgggagactgttttggtggcgcatggattgcctgccgccagctagggtttgacgcccatcgggcattacaatatgccaacgcctgcggtgcactggcggtaacccgacgtggcccaatggagggaacgtctcgccttatggaaatagaaacgttcatccagcgccatgacatgtccattcgggaagcagcacaatga

SEQ ID NO: 7638 - protein, 320 aa, Escherichia coli
MSKVFTIGEILVEIMASKIGQPFDQPGIWNGPYPSGAPAIFIDQVTRLGVPCGIISCVGNDGFGDINIHRLAADGVDIRGISVLPLEATGSAFVTYHNSGDRDFIFNIKNAACGKLSAQHVDENILKDCTHFHIMGSSLFSFHMVDAVKKAVTIVKANGGVISFDPNIRKEMLDIPEMRDALHFVLELTDIYMPSEGEVLLLSPHSTPERAIAGFLEEGVKEVIVKRGNQGASYYSANEQFHVESYPVEEVDPTGAGDCFGGAWIACRQLGFDAHRALQYANACGALAVTRRGPMEGTSRLMEIETFIQRHDMSIREAAQ

SEQ ID NO: 7639 - DNA, 990 bp, Escherichia coli
atgacagagaaaactcttgccagtccgaaaccttcggaaattcccattgcaaataattttaaaaaagtcttcaggcaatatggtggtatcctcagtggaatggtggtgttaatcattctgttcagttttattaatgacagtttttttaccgccaataacattactaatattattcttcaggtttcgataattgcaattaccgcctatggaatgacttatgtgcttttgcttggcgatattgatttatcggtcggttcaaccattgcattgattggcacatttgctgcgcttggggcttcatggggaattccatttgttttattggtcccattatccattattgcagcactgactctggggatgataaatggtggcttgacggctatagcggggatcccgtcgtttattgtcaccgttgctactatggggatcttccgtggtatcgcttatatagtgaccgatggtatgcccatcatgattaaagatgatgcctttctggcgctggggaatggagaatttctctatatacctattccaatctggatattaattatcttattgctgattaaccatttcattcttactaaaacaacctttggacgaaagatttatatcactggtggtaataaagaagcggcaatttattcagggataaatgtcacccgcttgaaaattaaagtctttatgattacagccgtgctggcaggtatcagcgggatgatccttgcctcacgcctctattccgggcaaccgaattccgcgttgagctacgaactggatgctattgccgcggctgtactgggaggcaccagcctgaacggcggctatggaaccgtggtggggacggtgatcggcgcattaaccatcggcgttattaataatggcatgaacttaatgaatgttccttatttttaccagatggtggttaaaggattagtcattcttgtagccgtttattttgacgtaagaaataaaagaaaacgcagctaa

SEQ ID NO: 7640 - protein, 329 aa, Escherichia coli
MTEKTLASPKPSEIPIANNFKKVFRQYGGILSGMVVLIILFSFINDSFFTANNITNIILQVSIIAITAYGMTYVLLLGDIDLSVGSTIALIGTFAALGASWGIPFVLLVPLSIIAALTLGMINGGLTAIAGIPSFIVTVATMGIFRGIAYIVTDGMPIMIKDDAFLALGNGEFLYIPIPIWILIILLLINHFILTKTTFGRKIYITGGNKEAAIYSGINVTRLKIKVFMITAVLAGISGMILASRLYSGQPNSALSYELDAIAAAVLGGTSLNGGYGTVVGTVIGALTIGVINNGMNLMNVPYFYQMVVKGLVILVAVYFDVRNKRKRS

SEQ ID NO: 7641 - DNA, 1530 bp, Escherichia coli
ttggcgttttgttgtgacaccgaggtcattatgacggatgttattcttgatgtttcgcatattgcgaagacatttggtcatgttcaggcattaaaagatattacactctctttacgtaaagggcgggtgcatactttattaggcgagaatggtgccggtaaatcgacattaatgaaaatactggccggtgtttatccgccaacccagggaacgataacactacgtggtgaaaccatcaccattaataatccgcagcattctcgccagttagggattgcgattatttttcaggaactgagcctgagtaataatatgaccgtggcggaaaatatttatgccaataatgaaccgcgacgttttggcatcattaacgataaaaaaatgctcgcagattgccagaatctcctcgcggacctgggcataccactagacccactggaaatggtcggcaatatgtcgatggcacataggcaactggtagaaattgctaaagccttaagctatgcagcggatgtcgtgattatggatgaaccgacatcctcgctaagtgataatgaagcggagatcctgtttaacattattgaaaaattaaagcagcgaggctgtgcggttatttatatctctcatcgcatggatgaaattatgcggatttcagatgatatttcggtgatccgcgacggtgagtatatcgctacgcatgaaaagaaaaacagtgatatccagcacttgattgcccaaatggttggtcgggaaatgaaaaatatttggccagcacgtcttggggaaaaaccggatgaaaatgttcctgcaaaactggaagtaaaaaatctttcccatccttcgctttttaaagaggtcagtttcgctgtgcgtccgggggaagtcctcggattttttggcctggtgggggccgggcgttccgatgtgatgaaggcgctatttggcctcgtttcgtatcacgggactgtgttgattgatggtaaggaagtcaggatcgctaatcccaaacaggctattgatcatggcattgcttttgtgaccgaaaaccgcaaggaagaagggttagtgctgatgcacgacgtcaatatgaacacgcaccatgtggcgtttcaatataacgcttcgcggatgggactcatcaatcaccgacaagaagaggcgaagacgctgcaatcaattgccagaatgaacactaaagtgagttctgtgcatcaggcagtgggagcaatgagcggcggtaatcaacagaaaatcgtgttatcgaagtggctggagaaaactccgcgtattttattgctcgatgagccaacgcgcggagtggatgtcggcgcaaaatttgaaatctataacgtgatacgtcaactggctgcggcagggacagcaattattctggtgtcctctgaactgccagaagtcatggcacttagcgatcgtctggtggtaatgcgtaataaaacgattgccgatatttattcatgtgaaaatttaacgcagatacaggtaatgaccgctgcaacaggagtacgttaa

SEQ ID NO: 7642 - protein, 509 aa, Escherichia coli
MAFCCDTEVIMTDVILDVSHIAKTFGHVQALKDITLSLRKGRVHTLLGENGAGKSTLMKILAGVYPPTQGTITLRGETITINNPQHSRQLGIAIIFQELSLSNNMTVAENIYANNEPRRFGIINDKKMLADCQNLLADLGIPLDPLEMVGNMSMAHRQLVEIAKALSYAADVVIMDEPTSSLSDNEAEILFNIIEKLKQRGCAVIYISHRMDEIMRISDDISVIRDGEYIATHEKKNSDIQHLIAQMVGREMKNIWPARLGEKPDENVPAKLEVKNLSHPSLFKEVSFAVRPGEVLGFFGLVGAGRSDVMKALFGLVSYHGTVLIDGKEVRIANPKQAIDHGIAFVTENRKEEGLVLMHDVNMNTHHVAFQYNASRMGLINHRQEEAKTLQSIARMNTKVSSVHQAVGAMSGGNQQKIVLSKWLEKTPRILLLDEPTRGVDVGAKFEIYNVIRQLAAAGTAIILVSSELPEVMALSDRLVVMRNKTIADIYSCENLTQIQVMTAATGVR

SEQ ID NO: 7643 - DNA, 891 bp, Escherichia coli
atgaaaaatattaaattacttggttcagctatgttggtgagcctggcattgttctcgcaaagttcgttggcaaaagagtataaaattggtgcgtcattattaacacaacaacatccattctatattgatcttgcgaatgccatgaaagaagaggcaaaaaaagacaatgtcaatttaagtgtctctattgccaaccaggatttaaacaaacaactttctgatgttgaggattttattactaaaaaagtggatgccattattgtctctccggtcgattcgaaaggcgtccaggcagcgataattaaagccgataaggccggtattcccgttatcaccgtcgacgtcgctgcggaaggcgttccggtcgtatcgcatgttgcgaccgataactatgcgggaggcgttgaagcaggcaagttaatgggtaaacttttgcatggtaaaggtactgtagccattatttcttatccggcactacaatcggtggttgcgcgcgttgatggttttaagaaagggttaagcgatacaccggatattaaaattgttgctgaacagcctggtattacgcgggctgaagcgttaacgactgcgcaaaacattatgcaggcaaacgccaacctgaatggtctgtttggctttggtgatgatgcggcgctggcagcggttatcgcagcaaaatctgcgcataacgacaacatcaaaatcattggttttgacggcatgaaagaagcgtgtgatgctgttgacagtgaaaaaacgtttgcggccgtgattcggcaatatcccgatcaaatgggggctaaagccattgatgccgctgttgatcacctcaatggtaaaccggtagaaaaaatgatcccggtacaacccggcgtttatacaggtaaatag

SEQ ID NO: 7644 - protein, 296 aa, Escherichia coli
MKNIKLLGSAMLVSLALFSQSSLAKEYKIGASLLTQQHPFYIDLANAMKEEAKKDNVNLSVSIANQDLNKQLSDVEDFITKKVDAIIVSPVDSKGVQAAIIKADKAGIPVITVDVAAEGVPVVSHVATDNYAGGVEAGKLMGKLLHGKGTVAIISYPALQSVVARVDGFKKGLSDTPDIKIVAEQPGITRAEALTTAQNIMQANANLNGLFGFGDDAALAAVIAAKSAHNDNIKIIGFDGMKEACDAVDSEKTFAAVIRQYPDQMGAKAIDAAVDHLNGKPVEKMIPVQPGVYTGK

SEQ ID NO: 7645 - DNA, 855 bp, Escherichia coli
atgtatattatttcaagcaaaaacatgctgaaaaaagcccagtcagagggatatgccgtccctgctttcaacattcataaccttgaaactttacaggtagttgttgagagcgctgcacaacttcgctctcccgttatgctggcgggaacacccggtacatatcgttatggtggcgtgggaagtttaatttcgttagtacaatcgctggctcgcgagtacaacctgccgttagtcctgcatctcgaccatcatgaagagagtgatgacatttttaacaaggttcgcgcagggatccgttctgtcatgattgatggctcccatttgccatttgaagacaacattgcgcgagtgcaagaagttaccaccttttgccatcgctttgatgttagcgttgaggccgagctagggcgtcttggcggccaggaggacgatctgcgggtggatgaaaaagattccgcttatacctcaccagccgcagctgcagagtttgttcaacgtacccaaattgactccctggcggtagcaatcggcacagcacatggtttatatgcgcatgaaccacgactggattttgtgcggctggaacagattcgtcagcgagtggagattccgctggtgttgcatggtgcttcgggcttatcggaacaggacgttcagcactgtattcgtcgcggtatttgtaaagtaaatgtcgcgacagaattgaaaattgcgtttgccgatgcgttaaaaggatatttctacaacaatcctgcggcaaatgatccacgtcactatatgcagcccgcaaaggccgccatgaaagaagtcgtaattcgtattattggcgtctgtggtagtgaaggaaaaatttaa

SEQ ID NO: 7646 - protein, 284 aa, Escherichia coli
MYIISSKNMLKKAQSEGYAVPAFNIHNLETLQVVVESAAQLRSPVMLAGTPGTYRYGGVGSLISLVQSLAREYNLPLVLHLDHHEESDDIFNKVRAGIRSVMIDGSHLPFEDNIARVQEVTTFCHRFDVSVEAELGRLGGQEDDLRVDEKDSAYTSPAAAAEFVQRTQIDSLAVAIGTAHGLYAHEPRLDFVRLEQIRQRVEIPLVLHGASGLSEQDVQHCIRRGICKVNVATELKIAFADALKGYFYNNPAANDPRHYMQPAKAAMKEVVIRIIGVCGSEGKI

SEQ ID NO: 7647 - DNA, 129 bp, Escherichia coli
atgtttttgcttgaaataatatacatcgcagctcctgttatttgtcgttcgccttacaaaatgaagaaagagaatcttcactttcattttgaaagcaaactagcacagcaaaagcagcaaaaagcgtga

SEQ ID NO: 7648 - protein, 42 aa, Escherichia coli
MFLLEIIYIAAPVICRSPYKMKKENLHFHFESKLAQQKQQKA

SEQ ID NO: 7649 - DNA, 831 bp, Escherichia coli
atgaagagtgttaacgtgccgagaaaatcgtctaacctactgaaacgcagattaaaaattgcagaaattgttgccgcccagggtgaaatcaaagttgatgacttatctgcgcaacttggtgtctctggcgtgacgatccgcggcgatctcagttatctggagcaacagggatatttaaagcgatcatttggcggtgctattgcgacaccactctcctctgaaccagaagcgatacaaccgatcgcgccattgtctctggcacaacaaatggaaatagcacgacattgcgcacggttaattcgcgatcgtgacacgctatttcttggacatgggacaatctgccgtaagatcattccattgctcagcgaagtgaaaaaactgcgtctgatcaccaacgatcccgaacatgcgctgctggcaaatcagtttattgatggcgaaataatactggctggcagtgaaatgctgcgccccgacaccgcactggccggaaaaccgcttgaacaggcacttcagcatttcaccattacacatagcattctggaaatcagccatctggatgctgatggtactttaaatatcaacgttcccagactcgccgctgcctggcagctctgtttcgatcatgcccagaataagacggttatcgttgccgccgatcctgcgccatcaacggctgctatcgggcatttgcatcaggcagaaaatgtgatcgtcagccgcagcattaacgaacaatatcagcaacaattgcagtcggctgatttcgttatcctttataccagtaatgagtgctttacctggtccaatcgcgaaaggcttcaggaatga

SEQ ID NO: 7650 - protein, 276 aa, Escherichia coli
MKSVNVPRKSSNLLKRRLKIAEIVAAQGEIKVDDLSAQLGVSGVTIRGDLSYLEQQGYLKRSFGGAIATPLSSEPEAIQPIAPLSLAQQMEIARHCARLIRDRDTLFLGHGTICRKIIPLLSEVKKLRLITNDPEHALLANQFIDGEIILAGSEMLRPDTALAGKPLEQALQHFTITHSILEISHLDADGTLNINVPRLAAAWQLCFDHAQNKTVIVAADPAPSTAAIGHLHQAENVIVSRSINEQYQQQLQSADFVILYTSNECFTWSNRERLQE

SEQ ID NO: 7651 - DNA, 957 bp, Escherichia coli
gtgacaataactatctgcgctatgggcgaattgctggccgagtttttgtcccgcaacccacatcaaaaattcactcagcctggggagtttatcgggccatttcccagcggtgcgccagcaatttttgctgctcaggtggcaaaactgtcccatcgggccatcttctttggatgtgttggtaatgatgattttgcccgactcattatagagcgtctccgtcatgaaggtgtcattaccgatgggatccatgttatgaacaatgccgtcacaggtacggcgttcgtgagttatcaaaatccccagcagcgggatttcgtctttaatatccctaacagcgcctgcggtttgtttactgccgagcacattgataaggatctgcttaaacagtgtaaccatctgcatattgtgggctcatcgttgttctcatttcgcatgatcgatgtcatgcgtaaagcaataacgacgatcaaatcggctggcggcaccgtttctttcgatcccaatattcgcaaagagatgctgagcattcctgaaatggcgcaggctctcgattatttgattgaatatacggatatttttatccccagcgaaagcgaactccctttcttcgcgcgtcacaaaaatctgtcagaggaacagattgttagcgatcttctccacggcggcgtaaaacatgtggcgataaaacgcgcccagcgtggggccagctattacaagcttaaaaacggtacattacacgcccagcatgttgcaggtcacgatatcgaaattatcgatccaacgggtgcaggcgactgctttggcgcaacgtttatcactcttttcttatccggtttcccggcacacaaggcgctgcaatatgcaaatgccagtggcgcgctcgccgtaatgcggcaaggtccgatggaagggatatcctcactggcagacattgaagactttttgcagcagcactga

SEQ ID NO: 7652 - protein, 318 aa, Escherichia coli
MTITICAMGELLAEFLSRNPHQKFTQPGEFIGPFPSGAPAIFAAQVAKLSHRAIFFGCVGNDDFARLIIERLRHEGVITDGIHVMNNAVTGTAFVSYQNPQQRDFVFNIPNSACGLFTAEHIDKDLLKQCNHLHIVGSSLFSFRMIDVMRKAITTIKSAGGTVSFDPNIRKEMLSIPEMAQALDYLIEYTDIFIPSESELPFFARHKNLSEEQIVSDLLHGGVKHVAIKRAQRGASYYKLKNGTLHAQHVAGHDIEIIDPTGAGDCFGATFITLFLSGFPAHKALQYANASGALAVMRQGPMEGISSLADIEDFLQQH

SEQ ID NO: 7653 - DNA, 243 bp, Escherichia coli
gtggacactcgttttgttcaggcccataaagaggcgcgctgggcgctggggctgacccttttgtatctggcggtatggttagtagccgcttacttacctggcgttgcccccggttttaccggctttccgcgctggtttgagatggcctgcatcctgacgccgctgctgtttattggactgtgctgggcgatggtgaaatttatctatcgcgatatcccgctggaggatgacgatgcagcttga

SEQ ID NO: 7654 - protein, 80 aa, Escherichia coli
MDTRFVQAHKEARWALGLTLLYLAVWLVAAYLPGVAPGFTGFPRWFEMACILTPLLFIGLCWAMVKFIYRDIPLEDDDAA

SEQ ID NO: 7655 - DNA, 1452 bp, Escherichia coli
atgcagcttgaagtgattctaccgctggtcgcctatctggtggtggtgttcggtatctctgtttatgcgatgcgtaaacggagcactggcaccttccttaatgagtatttcctcggcagccgctctatgggcggtattgtgctggcgatgacgctcaccgcgacctatatcagtgccagttcgtttatcggcgggcctggagctgcttataaatacggcctgggctgggtattgctagcgatgattcagcttcctgcagtctggctttcgctcggtattctcggcaagaagttcgcaattcttgcgcgccgctacaatgcggtgacgctgaacgatatgctgtttgcccgctaccagagtcgtcttctggtatggctggcgagtttgagtttgctggttgcgttcgttggtgcgatgaccgtgcagtttatcggcggtgcgcgcctgctggaaaccgcggcgggtattccttatgaaaccgggctgctgattttcggtatcagcattgcgttgtataccgcctttggcggctttcgcgccagcgtgctgaacgacaccatgcaagggctggtgatgctgattggcaccgttgtgctgcttattggcgtggtacatgccgcaggtggtttaagtaatgcggtagacacgctgcaaaccatcgatccgcaactggttacgccacaaggcgctgacgatattctgtcgcctgcctttatgacgtcgttctgggtactggtgtgctttggcgttataggcctgccgcatactgcggtgcgctgtatctcttataaagacagcaaagccgtacatcgggggatcattatcggtacgattgtagtcgcaatcctgatgttcggtatgcatctggccggagcgttaggtcgggcggtgatccccgatctcaccgtaccggatctggtgatcccgacgttaatggtaaaagtgctgccaccgtttgccgccgggatcttcctggctgcaccgatggctgcgatcatgtcgacaattaacgcccaactgctgcaaagttccgctacgatcattaaagatctctatctgaatatccgtccggatcaaatgcaaaacgagacgcgtctgaagcggatgtcggcggtgatcacgttggttctcggtgcgttgctgctgcttgccgcctggaagccgccagaaatgatcatctggctgaatttgctggccttcggtgggctggaagccgttttcctgtggccgctggtgctgggtctttactgggaacgtgccaacgccaaaggcgcgctaagtgcgatgatcgttggcggcgtgctgtatgccgtactcgcgaagctgaatattcagtacctgggcttccaccctatcgtgccctcgttactactaagtttgctggctttcctggtcggaaaccgtttcggtacatccgtcccgcaagctaccgttttgactactgataaataa

SEQ ID NO: 7656 - protein, 483 aa, Escherichia coli
MQLEVILPLVAYLVVVFGISVYAMRKRSTGTFLNEYFLGSRSMGGIVLAMTLTATYISASSFIGGPGAAYKYGLGWVLLAMIQLPAVWLSLGILGKKFAILARRYNAVTLNDMLFARYQSRLLVWLASLSLLVAFVGAMTVQFIGGARLLETAAGIPYETGLLIFGISIALYTAFGGFRASVLNDTMQGLVMLIGTVVLLIGVVHAAGGLSNAVDTLQTIDPQLVTPQGADDILSPAFMTSFWVLVCFGVIGLPHTAVRCISYKDSKAVHRGIIIGTIVVAILMFGMHLAGALGRAVIPDLTVPDLVIPTLMVKVLPPFAAGIFLAAPMAAIMSTINAQLLQSSATIIKDLYLNIRPDQMQNETRLKRMSAVITLVLGALLLLAAWKPPEMIIWLNLLAFGGLEAVFLWPLVLGLYWERANAKGALSAMIVGGVLYAVLAKLNIQYLGFHPIVPSLLLSLLAFLVGNRFGTSVPQATVLTTDK

SEQ ID NO: 7657 - DNA, 882 bp, Escherichia coli
atgccttggatccaactgaaactgaacactaccggcgcgaacgcggaagatcttagcgatgcgctgatggaagcgggtgccgtttctatcacttttcaggatacccacgatacgccagtatttgagccgctgccgggcgaaacgcgcctgtggggcgacaccgatgtgattggtctgttcgacgctgaaaccgatatgaacgacgtggtggcgattctggaaaaccatccgctgctcggcgcgggcttcgcgcataaaatcgaacaactggaagataaagactgggagcgcgaatggatggataatttccacccgatgcgctttggtgaacggctgtggatctgcccaagctggcgtgatgtgccggacgaaaacgccgtcaacgtgatgttagacccagggctggcgtttggtacgggtacccatccaactacctctctgtgcctgcaatggctcgacagcctcgatttaaccggtaaaacagtcatcgactttggctgcggttccggcattctggctatcgcggcgctgaaactgggtgcagcaaaagccattggtattgatattgatccgcaggcgattcaggccagccgcgacaacgctgaacgtaatggcgtttctgatcgtctggaactctacttaccgaaagatcagccagaagaaatgaaagccgacgtggtggtcgctaacatccttgcaggtccattacgtgaactggcaccgttaatcagcgtcctgccagtttcaggcggtttgctgggcctttccggtattctggcaagccaggcagagagcgtttgcgaagcttatgccgacagcttcgctctggacccggtcgtggaaaaagaagagtggtgccgcattaccggtcgtaagaattaa

SEQ ID NO: 7658 - protein, 293 aa, Escherichia coli
MPWIQLKLNTTGANAEDLSDALMEAGAVSITFQDTHDTPVFEPLPGETRLWGDTDVIGLFDAETDMNDVVAILENHPLLGAGFAHKIEQLEDKDWEREWMDNFHPMRFGERLWICPSWRDVPDENAVNVMLDPGLAFGTGTHPTTSLCLQWLDSLDLTGKTVIDFGCGSGILAIAALKLGAAKAIGIDIDPQAIQASRDNAERNGVSDRLELYLPKDQPEEMKADVVVANILAGPLRELAPLISVLPVSGGLLGLSGILASQAESVCEAYADSFALDPVVEKEEWCRITGRKN

SEQ ID NO: 7659 - DNA, 861 bp, Escherichia coli
ttgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaaaattcgcactggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggtgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaa

SEQ ID NO: 7660 - protein, 286 aa, Escherichia coli
MTVSEMMSSNPQVWESDKSRLRMVHIDEPGIRTVQIAGSDPKEMADAARINVESGAQIIDINMGCPAKKVNRKLAGSALLQYPDVVKSILTEVVNAVDVPVTLKIRTGWAPEHRNCEEIAQLAEDCGIQALTIHGRTRACLFNGEAEYDSIRAVKQKVSIPVIANGDITDPLKARAVLDYTGADALMIGRAAQGRPWIFREIQHYLDTGELLPPLPLAEVKRLLCAHVRELHDFYGPAKGYRIARKHVSWYLQEHAPNDQFRRTFNAIEDASEQLEALEAYFENFA

SEQ ID NO: 7661 - DNA, 297 bp, Escherichia coli
atgttcgaacaacgcgtaaattctgacgtactgaccgtttctaccgttaactctcaggatcaggtaacccaaaaacccctgcgtgactcggttaaacaggcactgaagaactattttgctcaactgaatggtcaggatgtgaatgacctctatgagctggtactggctgaagtagaacagcccctgttggacatggtgatgcaatacacccgtggtaaccagacccgtgctgctctgatgatgggcatcaaccgtggtacgctgcgtaaaaaattgaaaaaatacggcatgaactaa

SEQ ID NO: 7662 - protein, 98 aa, Escherichia coli [sequence omitted]

SEQ ID NO: 7663 - DNA, 885 bp, Escherichia coli
atgagaacaggatgtgaaccgacccgatttggtaatgaagcaaagaccatcatccagggtgatgcattaaccgaacttaaaaagctccccgccgaaagtgtcgatctgatctttgccgacccaccgtataacatcggtaaaaattttgatggtctgatcgaagcctggaaagaagatctgtttatcgactggctgtttgaagtgattgcagagtgccatcgcgttctgaaaaagcagggcagcatgtacatcatgaatagcacggaaaacatgccctttatcgatctccagtgccgcaagctttttaccatcaaaagtcgcatcgtctggtcatatgacagttctggagtgcaggcgaaaaaacactacggctccatgtacgaacccatcctgatgatggtgaaagacgcaaagaactacacgttcaacggtgatgctattctggtagaagccaaaaccggatcgcagcgcgcgttgatcaattatcgcaaaaatcctccacagccttacaatcatcaaaaagtaccgggtaacgtctgggattttccgcgcgtgcgttatttgatggatgaatatgaaaaccacccgacgcaaaaaccggaagccttgctgaaacgcattattctcgcctcttccaacccaggcgatatcgttctcgacccgtttgccggtagctttactaccggtgccgtagccgtcgccagcgggcgaaaattcattggtattgagatcaacagcgagtacatcaaaatggggcttcgacggctggatgtcgcgtcgcattactctgcggaagaactggcgaaagtgaaaaaaagaaagaccggcaacctgtcaaaacgaagccggttaagcgaagttgaccccgatctcattgcaaagtaa

SEQ ID NO: 7664 - protein, 294 aa, Escherichia coli
MRTGCEPTRFGNEAKTIIQGDALTELKKLPAESVDLIFADPPYNIGKNFDGLIEAWKEDLFIDWLFEVIAECHRVLKKQGSMYIMNSTENMPFIDLQCRKLFTIKSRIVWSYDSSGVQAKKHYGSMYEPILMMVKDAKNYTFNGDAILVEAKTGSQRALINYRKNPPQPYNHQKVPGNVWDFPRVRYLMDEYENHPTQKPEALLKRIILASSNPGDIVLDPFAGSFTTGAVAVASGRKFIGIEINSEYIKMGLRRLDVASHYSAEELAKVKKRKTGNLSKRSRLSEVDPDLIAK

SEQ ID NO: 7665 - DNA, 207 bp, Escherichia coli
ttggttaaacatgcacaggctcaggtaatgattcgcaagtattggtggctcgtcgttttcgctgtcttcgtttttctgtttgatactttactgatgcagtggattgaactgctggcaacagaaacagacaaatgccgcaatatgaactcagttaatccactaaaactggttaactgtgacgaactgaattttcaggacagaatgtga

SEQ ID NO: 7666 - protein, 68 aa, Escherichia coli
MVKHAQAQVMIRKYWWLVVFAVFVFLFDTLLMQWIELLATETDKCRNMNSVNPLKLVNCDELNFQDRM

SEQ ID NO: 7667 - DNA, 663 bp, Escherichia coli
atggcaaaaagaaccaaagctgaagccctgaagacccggcaagaactgattgaaactgccatcgcccagtttgcgcagcatggcgtaagcaagacgacgctcaacgacattgccgacgctgctaacgttacgcgtggcgctatctactggcacttcgaaaacaagactcaactgtttaatgagatgtggttgcaacagccttcattgcgggagttaatccaggatcacttgaccgctgggttagagcatgacccgtttcagcaattgcgtgaaaaattgattgtcggtttgcaatatattgccaaaattccccgccagcaggcgttgctgaaaatcttatatcacaaatgtgaatttaatgatgagatgctggccgagggagtgatacgcgaaaagatgggctttaatccgcagactctccgcgaagtattgcaggcgtgtcagcaacaaggttgtgtagcaaataatctcgatttagatgttgtgatgattattattgatggtgccttcagcggaattgttcaaaactggttaatgaatatggcgggttatgatctttataaacaagcccccgctctggtcgataacgtattaagaatgttcatgccagatgaaaacataacgaaattaattcataaaacgaatgaattaagtgtcatataa

SEQ ID NO: 7668 - protein, 220 aa, Escherichia coli
MAKRTKAEALKTRQELIETAIAQFAQHGVSKTTLNDIADAANVTRGAIYWHFENKTQLFNEMWLQQPSLRELIQDHLTAGLEHDPFQQLREKLIVGLQYIAKIPRQQALLKILYHKCEFNDEMLAEGVIREKMGFNPQTLREVLQACQQQGCVANNLDLDVVMIIIDGAFSGIVQNWLMNMAGYDLYKQAPALVDNVLRMFMPDENITKLIHKTNELSVI

SEQ ID NO: 7669 - DNA, 1158 bp, Escherichia coli
atgacgaaacatgccaggtttttcctcctgccctcctttattctgatctccgcggctttaatcgccggttgtaacgataagggagaagagaaagctcacgtcggtgaaccgcaggttaccgttcatattgtgaaaacggccccgttagaagttaagactgaattaccaggccgcaccaatgcttaccgtatagccgaagttcgcccacaggttagcgggatcgtactgaatcgcaatttcactgaaggcagcgatgtgcaagcaggccagtccctgtaccagatcgatcccgcgacctatcaggcaagttatgacagcgcgaaaggcgaactggcgaaaagtgaagccgccgccgccatcgcgcatttgacggtaaaacgttacgttccgctcgtgggtacgaaatacatcagtcagcaggagtacgaccaggccattgctgatgctcgccaggccgatgccgccgtgattgccgcaaaagccacagtcgaaagcgctcgcatcaatctcgcttataccaaagtgactgcgccaattagcggacgtatcggcaaatcgaccgtgaccgaaggcgctcttgtcactaatgggcaaacgactgaactggcgactgtccagcagctcgatcctatctacgttgatgtgacccaatccagcaacgattttatgaggctgaagcaatccgtagagcaaggaaatttgcataaggaaaacgccaccagcaacgtagagttggtcatggagaacggtcaaacctatcccctgaaaggtacgctgcaattctccgatgtgaccgttgatgaaagcaccggctccataaccctacgtgctgtcttccctaacccgcaacatacgcttttgccgggtatgtttgtgcgcgcacggattgatgaaggcgtccaacctgacgccattcttatcccgcaacaaggcgttagccgcacaccacgtggtgatgcaaccgtgctgattgttaacaataaaagtcaggttgaagcgcgccctgtcgttgccagtcaggcgattggcgataaatggttgattagcgaaggtctgaaatctggcgatcaagtcattgtcagcggcctgcaaaaagcgcgtccgggagagcaggttaaagccactaccgatacccccgcagatactgcatcgaagtaa

SEQ ID NO: 7670 - protein, 385 aa, Escherichia coli
MTKHARFFLLPSFILISAALIAGCNDKGEEKAHVGEPQVTVHIVKTAPLEVKTELPGRTNAYRIAEVRPQVSGIVLNRNFTEGSDVQAGQSLYQIDPATYQASYDSAKGELAKSEAAAAIAHLTVKRYVPLVGTKYISQQEYDQAIADARQADAAVIAAKATVESARINLAYTKVTAPISGRIGKSTVTEGALVTNGQTTELATVQQLDPIYVDVTQSSNDFMRLKQSVEQGNLHKENATSNVELVMENGQTYPLKGTLQFSDVTVDESTGSITLRAVFPNPQHTLLPGMFVRARIDEGVQPDAILIPQQGVSRTPRGDATVLIVNNKSQVEARPVVASQAIGDKWLISEGLKSGDQVIVSGLQKARPGEQVKATTDTPADTASK

SEQ ID NO: 7671 - DNA, 3105 bp, Escherichia coli
atggcaaacttttttattcgacgaccgatatttgcatgggtgctggccattattctgatgatggcgggcgcactggcgatcctacaattgcccgtcgcccagtatccaaccattgcgccgcctgcggtttctgtttcggcaaactatccgggtgctgatgcgcagaccgtgcaggatacagtgacgcaggttatcgaacagaatatgaacggtatcgataacctgatgtatatgtcctccaccagcgattccgccggtagcgtgacaattacccttaccttccagtccgggaccgatcctgatatcgcgcaagtacaggtgcagaacaaactccagctcgccacgccgttgctgccgcaggaggttcagcagcaggggatcagtgttgaaaagtccagtagcagctatttgatggtggcgggctttgtctctgataaccctggcaccacacaggacgatatctcggactatgtggcctctaacgttaaagatacgcttagccgtctgaatggcgtcggtgacgtacagcttttcggcgcacagtatgcgatgcgtatctggctggacgccgatctgctaaacaaatataaactgacaccggttgatgtgattaaccagttgaaggtacagaacgatcagatcgctgccggacagttgggcggaacgccagcgttaccagggcaacagttgaacgcctcgattattgctcagacgcggttaaaaaatccggaagaattcggcaaagtgaccctgcgcgtaaacagtgacggctcggtggtgcgtctgaaagatgtcgcacgggttgaacttggcggtgaaaactataacgttatcgctcgcatcaacggaaaaccggcggcgggcctggggattaagctggcaaccggcgcgaatgctctcgataccgcgaaagccattaaggcaaaactggcggaattacagccattcttcccgcagggaatgaaggttctttacccttatgacaccacgcctttcgtccagctttctatccaggaagtggtgaaaacgctgttcgaagccattatgctggtgttcctggtgatgtatctgttcttgcagaacatgcgggcaacattgatacccaccattgctgtacctgtcgtgttgttagggacatttgccatactcgccgcttttggttactccatcaatacgctaacgatgtttgggatggtacttgccatcggacttcttgttgatgatgcgatagtcgttgtggagaacgtcgagcgcgtaatgatggaggataaactcccccccagagaagcgacggaaaaatcgatgtcgcaaatccagggcgcgctggtaggtatcgcgatggtactgtcggcggtatttattccgatggcattcttcggtggctcaacaggggcaatttatcgccagttctctatcactattgtttcagcaatggcgctttcagtactggttgcgctgattctcacccccgcgttatgtgcaacattgctgaaaccagtctctgccgagcatcacgaaaataagggaggattcttcggctggtttaacaccactttcgatcatagcgttaatcactacaccaatagcgttggcaaaatcctcggttccacagggcgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagtgacggattactatctgaagaacgagaaagcgaacgttgaaagtgtctttacagttaacggctttagcttcagcggccaggcacaaaacgccggtatggccttcgtcagtctgaaaccgtgggaagagcgtagtggtgacgaaaacagtgcggaagcagtaatccatcgtgccaaaatggaattgggcaagatccgcgacggttttgtcattccatttaatatgccagccattgttgaactaggcacggcaacgggtttcgactttgagttaattgatcaggctgggctgggtcacgatgccctgacccaggcccgtaaccagttgcttggcatggcggcgcaacatcctgccagcttagtcagcgtgcgccctaatggcctggaagacaccgcgcagtttaaactggaagttgaccaggaaaaggcgcaggcattaggtgtttcactttctgacatcaatcagaccatttcaacggcgttgggtgggacttacgttaacgacttcatcgaccgtggtcgcgtgaaaaaggtgtatgttcaggcggatgccaaattccgtatgctgccagaagatgtcgataaactttatgtccgcagcgccaacggcgaaatggtgccattctctgcctttaccacttcacattgggtgtatggctctccgcgactggaacgctacaacggtctgccgtcaatggagattcagggggaagccgcgccaggaaccagttccggcgatgctatggcgttgatggaaaaccttgcgtcaaaattaccggcgggcattggttatgactggacgggtatgtcatatcaggaacgtttatcgggaaaccaggctcccgctctggtagcaatttcctttgtggttgttttcctgtgccttgctgcactctatgaaagctggtcaattcctgtctcggttatgttggtcgtgccgttagggattgtcggcgtgctactggcggcaacactctttaatcaaaaaaatgacgtctactttatggtgggcttgctaacgacaattggcttgtcggccaaaaacgctattttgattgttgagttcgctaaagatctcatggagaaagagggtaaaggtgttgttgaagcgacactaatggcagtacgtatgcgtctgcgtcctatcctgatgacctctctcgcctttattctcggcgtattaccgctggctatcagtaacggggccggcagtggcgcgcaaaacgcagtcggtatcggggtaatgggcggaatggtctctgcaacgttgctggcaatcttcttcgtgccagtgttctttgtggtgatccgtcgatgctttaaaggataa

SEQ ID NO: 7672 - protein, 1034 aa, Escherichia coli
MANFFIRRPIFAWVLAIILMMAGALAILQLPVAQYPTIAPPAVSVSANYPGADAQTVQDTVTQVIEQNMNGIDNLMYMSSTSDSAGSVTITLTFQSGTDPDIAQVQVQNKLQLATPLLPQEVQQQGISVEKSSSSYLMVAGFVSDNPGTTQDDISDYVASNVKDTLSRLNGVGDVQLFGAQYAMRIWLDADLLNKYKLTPVDVINQLKVQNDQIAAGQLGGTPALPGQQLNASIIAQTRLKNPEEFGKVTLRVNSDGSVVRLKDVARVELGGENYNVIARINGKPAAGLGIKLATGANALDTAKAIKAKLAELQPFFPQGMKVLYPYDTTPFVQLSIQEVVKTLFEAIMLVFLVMYLFLQNMRATLIPTIAVPVVLLGTFAILAAFGYSINTLTMFGMVLAIGLLVDDAIVVVENVERVMMEDKLPPREATEKSMSQIQGALVGIAMVLSAVFIPMAFFGGSTGAIYRQFSITIVSAMALSVLVALILTPALCATLLKPVSAEHHENKGGFFGWFNTTFDHSVNHYTNSVGKILGSTGRYLLIYALIVAGMVVLFLRLPSSFLPEEDQGVFLTMIQLPAGATQERTQKVLDQVTDYYLKNEKANVESVFTVNGFSFSGQAQNAGMAFVSLKPWEERSGDENSAEAVIHRAKMELGKIRDGFVIPFNMPAIVELGTATGFDFELIDQAGLGHDALTQARNQLLGMAAQHPASLVSVRPNGLEDTAQFKLEVDQEKAQALGVSLSDINQTISTALGGTYVNDFIDRGRVKKVYVQADAKFRMLPEDVDKLYVRSANGEMVPFSAFTTSHWVYGSPRLERYNGLPSMEIQGEAAPGTSSGDAMALMENLASKLPAGIGYDWTGMSYQERLSGNQAPALVAISFVVVFLCLAALYESWSIPVSVMLVVPLGIVGVLLAATLFNQKNDVYFMVGLLTTIGLSAKNAILIVEFAKDLMEKEGKGVVEATLMAVRMRLRPILMTSLAFILGVLPLAISNGAGSGAQNAVGIGVMGGMVSATLLAIFFVPVFFVVIRRCFKG

SEQ ID NO: 7673 - DNA, 222 bp, Escherichia coli
atgaaaagattaattcctgtgacattgctcaccgcattgctggcgggctgtgctcacgattcgccctgcgttccggtttatgacgatcagggtcgtctggttcacaccaatacctgtatgaaaggcacgactcaggataactgggaaacggctggggctattgccggcggggcagcagctgttgctggcctgacgatggggatcatcgctctgtcgaaataa

SEQ ID NO: 7674 - protein, 73 aa, Escherichia coli
MKRLIPVTLLTALLAGCAHDSPCVPVYDDQGRLVHTNTCMKGTTQDNWETAGAIAGGAAAVAGLTMGIIALSK

SEQ ID NO: 7675 - DNA, 1026 bp, Escherichia coli
atgaaaaagatgatgatagccacactggctgccgccagcgtgctgcttgccgttgcaaatcaggcgcatgctggcgcgacgcttgatgccgttcagaaaaaaggttttgtgcaatgcgggatcagtgatggattacctgggttctcttatgccgatgctgacggtaagttttcaggtattgatgtagatgtttgtcgtggtgttgccgctgctgtattcggtgacgatacgaaagtgaaatataccccgctcactgcaaaagaacgcttcaccgctttacagtcaggggaggtggatttgctctcccgtaatacgacctggacttcatctcgcgatgccgggatgggaatggcatttactggcgtcacttattacgacggcattggcttcctgacgcacgataaagcggggctaaaaagcgcgaaagaactggatggcgctaccgtctgtattcaggcggggactgataccgaactcaacgtcgccgattacttcaaggcaaataatatgaagtacacgccagtaaccttcgatcgctcagacgaatcagcgaaagctctggaatcaggccgctgtgatactctggcctcggatcaatcacaactgtatgccctacgcatcaaattaagcaacccagctgaatggattgtcttaccggaagttatctctaaagaaccacttgggccggtagttcgtcgtggcgatgatgaatggttctcgattgtacgctggacgcttttcgccatgctgaatgctgaagagatgggcatcaattcccagaacgtcgatgaaaaagcggctaatccagcaacgcctgatatggcacatctgctgggtaaagaaggcgattacggcaaggatctgaagctggataataaatgggcctttaacatcatcaaacaggtgggtaactactcggaaattttcgagcgtaacgtaggttcagaaagcccgctgaaaattaaacgtgggcaaaataatctctggaataacggcggtattcagtacgcgccgcccgtgcgttaa

SEQ ID NO: 7676 - protein, 341 aa, Escherichia coli
MKKMMIATLAAASVLLAVANQAHAGATLDAVQKKGFVQCGISDGLPGFSYADADGKFSGIDVDVCRGVAAAVFGDDTKVKYTPLTAKERFTALQSGEVDLLSRNTTWTSSRDAGMGMAFTGVTYYDGIGFLTHDKAGLKSAKELDGATVCIQAGTDTELNVADYFKANNMKYTPVTFDRSDESAKALESGRCDTLASDQSQLYALRIKLSNPAEWIVLPEVISKEPLGPVVRRGDDEWFSIVRWTLFAMLNAEEMGINSQNVDEKAANPATPDMAHLLGKEGDYGKDLKLDNKWAFNIIKQVGNYSEIFERNVGSESPLKIKRGQNNLWNNGGIQYAPPVR

SEQ ID NO: 7677 - DNA, 1200 bp, Escherichia coli
atgctttccgaggtttctatgtctcatcgccgctcaaccgttaaaggctcactctcttttgccaaccctacggttcgcgcctggttattccagatccttgccgttgttgctgttgtcggcattattggttggttatttcacaacactgtaacgaatctcagtaatcgcggcataacatcaggatttgcttttcttgaccgcggggccggttttggcatcgttcagcatttgattgattatcagcaaggcgacacttacggacgcgtttttattgtcggcctgctcaatacgctactggtttctgcattgtgtattgtgttcgcttctgttttgggcttctttatcggtctggcgagactttcggataactggctgctacgaaagctttccacaatttatattgagatcttccgtaatattccgccattgctgcaaatcttcttctggtactttgccgtgttgcgcaatttgcccgggccacgccaggcagtgagcgcactggatttggtgtttctgagcaatcgtgggctttatattccgtcgccgcagctgggagatgggtttcttgcgtttatcctggctgttgttatagctatagtcctttctgttgggctattccgctttaataaaacacaccagataaagaccggacaactgcgccgcacctggccgattgccgcagtgttgatcattggtttgcctttactggcgcaatggctttttggcgcagcactacactgggatgtcccagcccttcgaggctttaatttccgcggcgggatggttttaattcctgaactggcagccttaacgctagcactttcgatttatacctctgcatttatcgccgagattatccgcgcagggatccaggcagtgccttatggtcaacatgaagcggctcgatcactgggattacccaacccggtaacgctacgccgggtcattattccccaggcattgcgggtgattattccaccgttaaccagccagtatctcaacatcgtcaagaactcctctcttgccgccgctattggctatcccgatatggtttcgctgtttgctggcaccgtgctgaaccaaacggggcaagccatcgagacgatagccatgaccatgtcggtctatctgattatcagcctgactatctcgctgctgatgaatatctataaccgccgcatcgcgatcgttgaacgctaa

SEQ ID NO: 7678 - protein, 399 aa, Escherichia coli
MLSEVSMSHRRSTVKGSLSFANPTVRAWLFQILAVVAVVGIIGWLFHNTVTNLSNRGITSGFAFLDRGAGFGIVQHLIDYQQGDTYGRVFIVGLLNTLLVSALCIVFASVLGFFIGLARLSDNWLLRKLSTIYIEIFRNIPPLLQIFFWYFAVLRNLPGPRQAVSALDLVFLSNRGLYIPSPQLGDGFLAFILAVVIAIVLSVGLFRFNKTHQIKTGQLRRTWPIAAVLIIGLPLLAQWLFGAALHWDVPALRGFNFRGGMVLIPELAALTLALSIYTSAFIAEIIRAGIQAVPYGQHEAARSLGLPNPVTLRRVIIPQALRVIIPPLTSQYLNIVKNSSLAAAIGYPDMVSLFAGTVLNQTGQAIETIAMTMSVYLIISLTISLLMNIYNRRIAIVER

SEQ ID NO: 7679 - DNA, 1104 bp, Escherichia coli
atgacaaaagtattgctgtctcatcccccgcgcctggcgagccataactcaagccgcgcgatggtgtgggtgcgaaaaaatctgttctccagctggagcaatagcctgctgactattggctgcatatggttgatgtgggaactgatcccaccgttgctgaactgggtatttttgcaggctaactgggttggctcaacgcgtgccgactgcacaaaatccggtgcctgttgggtcttcatccacgaacgatttggtcagtttatgtatggactttacccacacgaccaacgctggcgaattaacctggcattactgattggccttgtttctatcgcaccaatgttctggaaaatacttccgcatcgcagtcgctatattgcggtctgggcggtgatttacccactggttgtctggtggctgatgtatggtgggtttcttggtcttgatcgggttgaaacccggcaatggggcgggttgacgctaactttaattattgcatcagttgggattgcgggggcgctaccgtgggggatcttactggcgttaggtcgccgctcccatatgccgattgtgcgtatcttatcggtcatttttatcgagttctggcgcggcgtaccgctgattaccgtattgtttatgtcttcggtcatgctgccgttgtttatggcagaaggcaccagtatcgacaaactgatccgcgcgctggttggcgtgatcctatttcagtcagcatatgttgcggaagtcgtgcgaggcggattgcaggcgctgcctaaagggcaatatgaagcggcagagtcgctggcattgggttactggaaaactcaggggctggttattctgccacaggcgttgaagctggtaattcctgggctggtaaataccatcatcgcactcttcaaagataccagtctggtgatcatcatcgggttgttcgatcttttcagtagcgttcagcaggcaaccgttgatcccgcctggttgggtatgtcgacggaagggtatgttttcgccgcgctgatctactggatcttctgtttcagcatgtcacgttatagccaacatctggaaaaacgttttaacaccgggcgtacaccgcattga

SEQ ID NO: 7680 - protein, 367 aa, Escherichia coli
MTKVLLSHPPRLASHNSSRAMVWVRKNLFSSWSNSLLTIGCIWLMWELIPPLLNWVFLQANWVGSTRADCTKSGACWVFIHERFGQFMYGLYPHDQRWRINLALLIGLVSIAPMFWKILPHRSRYIAVWAVIYPLVVWWLMYGGFLGLDRVETRQWGGLTLTLIIASVGIAGALPWGILLALGRRSHMPIVRILSVIFIEFWRGVPLITVLFMSSVMLPLFMAEGTSIDKLIRALVGVILFQSAYVAEVVRGGLQALPKGQYEAAESLALGYWKTQGLVILPQALKLVIPGLVNTIIALFKDTSLVIIIGLFDLFSSVQQATVDPAWLGMSTEGYVFAALIYWIFCFSMSRYSQHLEKRFNTGRTPH

SEQ ID NO: 7681 - DNA, 759 bp, Escherichia coli
atgagccaaattttactgcaacctgctaacgcgatgattacgctggaaaacgtcaataaatggtatggacaattccatgttttgaaaaatataaatttaatcgtgcaaccgggcgaacggatcgttctgtgtggcccttcaggttccggtaaatcgacaaccattcgttgtattaatcatctggaagaacatcaacagggacggatcgtggtagatggcatcgaacttaatgaagatatccgcaatattgagcgcgtcaggcaggaagtgggaatggtctttcagcatttcaatctcttccctcatctgaccgtgttgcagaactgtaccctggcaccgatttgggtacgcaagatgccaaagaaagaggctgaagctctggcgatgcattaccttgagcgggtgagaattgccgaacatgcccagaagtttcccggacagatttctggtggtcagcagcaacgtgttgccatagcacgttcgctgtgtatgaagccgaaaattatgttgtttgatgagccaacgtcggcgctcgatcctgagatggtgaaagaggtgctggatacgatgattgggctggcgcagtcgggtatgacaatgttgtgtgtaacacatgagatggggtttgcacgaaccgtcgctgaccgggtgatttttatggatcgtggggaaatagtggagcaagctgcacctaatgaattttttgcgcatcctaaatcagagcgtacgaggacatttttatcgcaggtaatccattaa

SEQ ID NO: 7682 - protein, 252 aa, Escherichia coli
MSQILLQPANAMITLENVNKWYGQFHVLKNINLIVQPGERIVLCGPSGSGKSTTIRCINHLEEHQQGRIVVDGIELNEDIRNIERVRQEVGMVFQHFNLFPHLTVLQNCTLAPIWVRKMPKKEAEALAMHYLERVRIAEHAQKFPGQISGGQQQRVAIARSLCMKPKIMLFDEPTSALDPEMVKEVLDTMIGLAQSGMTMLCVTHEMGFARTVADRVIFMDRGEIVEQAAPNEFFAHPKSERTRTFLSQVIH

SEQ ID NO: 7683 - DNA, 1356 bp, Escherichia coli
  n 9, 10, 11, 12, 13: n is any nucleotide
atggaatgnnnnncaaaggccatttctactatcgcagaatcaaaacgatttccgctgcacgaaatgcgcgatgatgttgcatttcagattatcaatgatgaattatatcttgatggcaacgctcgtcagaacctggccactttctgccagacctgggacgacgaaaacgtccataaattgatggatttgtcgatcaataaaaactggatcgacaaagaagaatatccgcaatccgctgcaatcgacctgcgttgcgtaaacatggttgccgatctgtggcatgcgcctgcaccgaaaaatggtcaggccgttggcaccaacaccattggttcttccgaggcctgtatgctcggcgggatggcgatgaaatggcgttggcgcaagcgtatggaagctgcaggtaagccgactaacaaaccgaacctggtgtgcggtccggtacaaatctgctggcataaattcgcccgctactgggatgtggagttgcgtgagatccctatgcgccccggtcagttgtttatggacccgaaacgcatgattgaagcctgcgacgaaaacaccatcggcgtggtgccgactttcggcgtgacctacaccggtaactatgagttcccgcagccgctgcacgatgcgctggataaattccaggccgacaccggtatcgacatcgacatgcacatcgacgccgccagcggtggcttcctggcaccgttcgtcgccccggatatcgtctgggacttccgcctgccgcgtgtgaaatcgatcagtgcttcaggccataaattcggtctggctccgctgggctgcggctgggttatctggcgtgatgaagaagcgctgccgcaggaactggtgttcaacgttgactacctcggcggtcagattggtactttcgccatcaacttctcccgcccggcgggtcaggtgattgcacagtactatgaattcctgcgcctcggtcgtgaaggctataccaaagtacagaacgcttcctaccaggttgctgcttatctggcggatgaaatcgccaaactggggccgtatgagttcatctgtacgggtcgcccggacgaaggcatcccggcggtttgcttcaaactgaaagatggtgaagatccgggatacactctgtatgacctctctgaacgtctgcgtctgcgcggctggcaggttccggccttcactctcggcggtgaagccaccgacatcgtggtgatgcgcattatgtgtcgtcgcggcttcgaaatggactttgctgaactgttgctggaagactacaaagcctccctgaaatatctcagcgaccacccgaaactgcagggtattgcccagcagaacagctttaaacacacctga

SEQ ID NO: 7684 - protein, 451 aa, Escherichia coli
  Xaa 3, 4, 5: Xaa is any amino acid
MEXXXKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 7685 - DNA, 1356 bp, Escherichia coli; identical to SEQ ID NO: 7683
  n 9, 10, 11, 12, 13: n is any nucleotide

SEQ ID NO: 7686 - protein, 451 aa, Escherichia coli; identical to SEQ ID NO: 7684
  Xaa 3, 4, 5: Xaa is any amino acid

SEQ ID NO: 7687 - DNA, 258 bp, Escherichia coli
gtgaatcaggccatccagtttccggatagggaagagtgggacgagaataaaagatgtgtatgttttcccgctctcgtgaatggtatgcaactgacatgtgcgatctctggcgagagtctggcgtatcgctttactggagatacgccagaacagtggttagcgagttttcgtcagcatcgctgggacctggaagaagaagcggaaaacttaattcaggaacaaagtgaagatgatcaaggttgggtctggttaccttga

SEQ ID NO: 7688 - protein, 85 aa, Escherichia coli
MNQAIQFPDREEWDENKRCVCFPALVNGMQLTCAISGESLAYRFTGDTPEQWLASFRQHRWDLEEEAENLIQEQSEDDQGWVWLP

SEQ ID NO: 7689 - DNA, 813 bp, Escherichia coli
  n 12, 13, 14, 15, 16: n is any nucleotide
atgaatgaatgnnnnntttctctttgttgttacgaccatcttgtgaagtgtttcacgttgtcgtctcaacggaggcgcattatagggatcccaattttttgcacaagtacttttttgatctttttttctgtttgttgctttttcaccctttttgctgcattcgcacacaaaacggtgcttttttgcatgctaaaagacttgcacaaggccaataatgcacccaaagtcattagtaaatcatttattgttgaggtgagtatgtctgatgttttacgcccataccgcgatctttttccacaaatcggtcagcgcgtaatgatcgacgatagcagcgtcgtgattggtgacgttcgtttggctgatgatgtggggatctggccgctcgttgtgattcgtggagatgtacattatgtacagatcggagcacgcaccaatatccaggatggcagtatgttgcatgtcactcataaatcctcgtacaacccagatggcaacccattaaccattggcgaagatgtcactgttggtcacaaggtgatgctccacggctgcaccattggcaatcgagttttggttgggatgggctcaattttacttgatggcgcaatagtagaagatgatgtgatgattggtgcgggtagcctggtcccacaaaataaacggctggagagcggatatctgtatctcggtagccccgtcaaacagatccgcccgttaagtgatgaagagaaggctgggttacgctattccgcaaataactacgtgaaatggaaggacgaatatctggatcaaggtaaccagacccaaccttga

SEQ ID NO: 7690 - protein, 270 aa, Escherichia coli
  Xaa 4, 5, 6: Xaa is any amino acid
MNEXXXSLCCYDHLVKCFTLSSQRRRIIGIPIFCTSTFLIFFSVCCFFTLFAAFAHKTVLFCMLKDLHKANNAPKVISKSFIVEVSMSDVLRPYRDLFPQIGQRVMIDDSSVVIGDVRLADDVGIWPLVVIRGDVHYVQIGARTNIQDGSMLHVTHKSSYNPDGNPLTIGEDVTVGHKVMLHGCTIGNRVLVGMGSILLDGAIVEDDVMIGAGSLVPQNKRLESGYLYLGSPVKQIRPLSDEEKAGLRYSANNYVKWKDEYLDQGNQTQP

SEQ ID NO: 7691 - DNA, 819 bp, Escherichia coli
atggaaacctatgctgtttttggtaatccgatagcccacagcaaatcgccattcattcatcagcaatttgctcagcaactgaatattgaacatccctatggacgcgtgttggcacccatcaatgatttcatcaacacactgaacgctttctttagtgctggtggtaaaggtgcgaatgtgacggtaccttttaaagaagaggcttttgccagagcggatgagcttactgaacgggcagcgttggctggtgctgttaataccctcaagcggttagaagatggacgcctgctgggtgacaataccgatggtataggtttgttaagcgatctggaacgtctgtcttttatccgtcctggtttacgtattctgctcattggcgctggtggagcatctcgcggcgtactactgccactcctttccctggactgtgcggtgacaatcactaatcggacggtatctcgcgcagaagagttgactaaattgtttgcgcacactggcagtattcaggcgttgggtatggacgaactggaaggtcatgagtttgatctcattattaatgcaacatccagtggcatcagtggtgatattccggcgatcccgtcatcgctcattcatccaggcatttattgctatgacatgttctatcagaaaggaaaaactccttttctggcatggtgtgagcagcgaggctcaaagcgtaatgctgatggtttaggaatgctggtggcacaggcggctcatgccttccttctttggcatggcgttctgcctgatgtagaaccggtcatcaaactattgcaacaggaattgtcagcgtga

SEQ ID NO: 7692 - protein, 272 aa, Escherichia coli
METYAVFGNPIAHSKSPFIHQQFAQQLNIEHPYGRVLAPINDFINTLNAFFSAGGKGANVTVPFKEEAFARADELTERAALAGAVNTLKRLEDGRLLGDNTDGIGLLSDLERLSFIRPGLRILLIGAGGASRGVLLPLLSLDCAVTITNRTVSRAEELTKLFAHTGSIQALGMDELEGHEFDLIINATSSGISGDIPAIPSSLIHPGIYCYDMFYQKGKTPFLAWCEQRGSKRNADGLGMLVAQAAHAFLLWHGVLPDVEPVIKLLQQELSA

SEQ ID NO: 7693 - DNA, 618 bp, Escherichia coli
gtgccagtaaacaatgtggaaagccgatttcggcggaataataacgtgaataataacctgcaaggagacgctatcgcagctgcgatagatgtcctcaatgaagaacgtgtcatcgcctatccaacggaagccgttttcggtgtcgggtgcgatcctgatagcgaaacagcagtgatgcgactgttggagttaaaacagcgtccggttgataaggggctgattctaatcgccgcaaattacgagcagcttaaaccctatattgatgacaccatgctgactgacgcgcagcgtgaaactatattttctcgctggccaggtcctgtcacctttgtttttcccgcgcctgcgacaacaccgcgctggttgacgggccgctttgattcgcttgctgtacgagtcaccgaccatccgttggtggttgctttgtgccaggcttatggtaaaccgctggtttctaccagtgccaacttgagtggattgccaccttgtcgaacagtagacgaagttcgcgcacaatttggcgcggcgttcccggttgtgcctggtgaaacgggggggcgtttaaatccttcagaaatccgcgatgccctgacgggtgaactgtttcgacaggggtaa

SEQ ID NO: 7694 - protein, 205 aa, Escherichia coli
MPVNNVESRFRRNNNVNNNLQGDAIAAAIDVLNEERVIAYPTEAVFGVGCDPDSETAVMRLLELKQRPVDKGLILIAANYEQLKPYIDDTMLTDAQRETIFSRWPGPVTFVFPAPATTPRWLTGRFDSLAVRVTDHPLVVALCQAYGKPLVSTSANLSGLPPCRTVDEVRAQFGAAFPVVPGETGGRLNPSEIRDALTGELFRQG

SEQ ID NO: 7695 - DNA, 474 bp, Escherichia coli
atgttcgacgtactaatgtatttgtttgaaacctatattcacacagaagctgagttgcgtgtggatcaagacaaacttgaacaggatcttaccgacgcaggatttgatcgagaagatatctacaatgccctgctttggctggaaaagcttgcggattatcaggaaggactggcagaaccgatgcaactggcctctgatccactctccatgcgtatttatacccctgaagagtgtgaaagactggatgccagctgtcgtggttttctgcttttccttgagcaaattcaggtgcttaaccttgaaacccgtgaaatggtgatagagcgagtgctcgcgctggataccgctgagttcgacctggaagacctgaaatgggtaatcctgatggtgttgttcaatattccgggctgcgaaaatgcgtaccagcaaatggaagaattactctttgaagtgaatgaaggtatgctgcattaa

SEQ ID NO: 7696 - protein, 157 aa, Escherichia coli
MFDVLMYLFETYIHTEAELRVDQDKLEQDLTDAGFDREDIYNALLWLEKLADYQEGLAEPMQLASDPLSMRIYTPEECERLDASCRGFLLFLEQIQVLNLETREMVIERVLALDTAEFDLEDLKWVILMVLFNIPGCENAYQQMEELLFEVNEGMLH

SEQ ID NO: 7697 - DNA, 1125 bp, Escherichia coli
atggttgatacagaaatttggctgcgtttaattagcatcagcagcttgtatggcgatgatatggtccgtatagctcactggctggcaaaacagtcgcatattgatgcggttgtattgcagcaaacagggcttacattgcggcaggcacaacgctttctttcatttccgcgaaagagtatcgaaagctcactttgttggttggagcaacccaaccatcatttaatccctgcggacagcgaattttatcctcctcaacttctggcgacgacagattaccccggcgcactgtttgttgaaggagaactgcacgcgttgcattcatttcagcttgccgtagtggggagtcgggcgcattcatggtatggcgagcgatggggacgattattttgcgaaactctggcgacgcgtggagtgacaattacgagtggactggcgcgtggaatcgatggtgtggcgcataaagcggccttacaggtaaatggcgttagcattgctgtattggggaatggacttaataccattcatccccgccgccatgctccactggctgccagtctacttgagcaaggtggtgctctcgtctcggaatttcccctcgatgttccaccccttgcttacaatttcccacgaagaaatcgcattatcagtggtctaagtaaaggtgtactggtggtggaagcggctttgcgcagtggttcgctggtgacagcacgttgtgcgcttgagcaggggcgtgaagtttttgctttgccaggtccaatagggaatccgggaagcgaagggcctcactggttaataaaacaaggtgcgattcttgtgacggaaccggaagaaattctggaaaacttgcaatttggattgcactggttgccagacgcccctgaaaattcattttattcaccagatcaggaagacgtggcattgccatttcctgagctcctggctaacgtaggagatgaggtaacacctgttgacgtcgtcgctgaacgtgccggccaacctgtgccagaggtagttactcaactactcgaactggagttagcaggatggatcgcagctgtacccggcggctatgtccgattgaggagggcatgccatgttcgacgtactaatgtatttgtttga

SEQ ID NO: 7698 - protein, 374 aa, Escherichia coli
MVDTEIWLRLISISSLYGDDMVRIAHWLAKQSHIDAVVLQQTGLTLRQAQRFLSFPRKSIESSLCWLEQPNHHLIPADSEFYPPQLLATTDYPGALFVEGELHALHSFQLAVVGSRAHSWYGERWGRLFCETLATRGVTITSGLARGIDGVAHKAALQVNGVSIAVLGNGLNTIHPRRHAPLAASLLEQGGALVSEFPLDVPPLAYNFPRRNRIISGLSKGVLVVEAALRSGSLVTARCALEQGREVFALPGPIGNPGSEGPHWLIKQGAILVTEPEEILENLQFGLHWLPDAPENSFYSPDQEDVALPFPELLANVGDEVTPVDVVAERAGQPVPEVVTQLLELELAGWIAAVPGGYVRLRRACHVRRTNVFV

SEQ ID NO: 7699 - DNA, 510 bp, Escherichia coli
atgtcagttttgcaagtgttacatattccggacgagcggcttcgcaaagttgctaaaccggtagaagaagtgaatgcagaaattcagcgtatcgtcgatgatatgttcgagacgatgtacgcagaagaaggtattggcctggcggcaacccaggttgatatccatcaacgtatcattgtaattgatgtttcggaaaaccgtgacgaacggctggtgttaatcaatccggagcttttagaaaaaagcggcgaaacaggcattgaagaaggttgcctgtcgatccctgaacaacgtgctttagtgccacgcgcagagaaagttaaaattcgcgccctggaccgcgacggtaaaccatttgaactggaagcagacggtctgttagccatctgtattcagcatgagatggatcacctggtcggcaaactgtttatggattatctgtcaccgctgaaacaacaacgtattcgtcagaaagttgaaaaactggatcgtctgaaagcccgggcttaa

SEQ ID NO: 7700 - protein, 169 aa, Escherichia coli
MSVLQVLHIPDERLRKVAKPVEEVNAEIQRIVDDMFETMYAEEGIGLAATQVDIHQRIIVIDVSENRDERLVLINPELLEKSGETGIEEGCLSIPEQRALVPRAEKVKIRALDRDGKPFELEADGLLAICIQHEMDHLVGKLFMDYLSPLKQQRIRQKVEKLDRLKARA

SEQ ID NO: 7701 - DNA, 948 bp, Escherichia coli
gtgtcagaatcactacgtattatttttgcgggtacacctgactttgcagcgcgtcatctcgacgcgctgttgtcttctggtcataacatcgttggcgtgtttacccagccagaccgaccggcaggacgcggtaaaaaactgatgcccagcccggttaaagttctggctgaggacaaaggtctgcccgtttttcaacctgtttccctgcgtccacaagaaaaccagcaactggtcgccgatctgcaggctgatgttatggtcgtcgtcgcctatggtttaattctgcctaaagctgtgctggagatgccgcgtcttggctgtatcaacgttcatggttcactgctgccacgctggcgcggtgctgcaccaatccaacgctcactatgggcgggtgatgcagaaactggtgtgaccattatgcaaatggatgttggtttagacaccggtgacatgctttataagctctcctgcccgattactgcagaagataccagtggtacgctgtacgacaaactggcagagcttggcccacaagggcttattactacgttgaaacaactggcagacggcacggcgaaaccagaagttcaggacgaaactcttgtcacttacgccgaaaagttgagtaaagaagaagcgcgtattgactggtcactttcggcagcacagcttgaacgttgcattcgcgctttcaatccatggccaatgagctggctggaaattgaagggcagccggttaaagtctggaaagcatctgtcatcgatacgacaacaaaggctgcgccaggaacaatccttgaagccaataaacaaggcattcaggtagcgacaggtgatggcatcctgaatctgctctcaatgcaacctgcaggtaagaaagcgatgagcgtgcaagacctcctgaattctcgtcgggaatggtttgtaccgggcaaccgtctggcctga

SEQ ID NO: 7702 - protein, 315 aa, Escherichia coli
MSESLRIIFAGTPDFAARHLDALLSSGHNIVGVFTQPDRPAGRGKKLMPSPVKVLAEDKGLPVFQPVSLRPQENQQLVADLQADVMVVVAYGLILPKAVLEMPRLGCINVHGSLLPRWRGAAPIQRSLWAGDAETGVTIMQMDVGLDTGDMLYKLSCPITAEDTSGTLYDKLAELGPQGLITTLKQLADGTAKPEVQDETLVTYAEKLSKEEARIDWSLSAAQLERCIRAFNPWPMSWLEIEGQPVKVWKASVIDTTTKAAPGTILEANKQGIQVATGDGILNLLSMQPAGKKAMSVQDLLNSRREWFVPGNRLA

SEQ ID NO: 7703 - DNA, 1290 bp, Escherichia coli
atgaaaaaacaacgtaatttacgtagcatggcggcccaggccattgaacaagtcgttgagcaagggcaatcactgagcaacattctgccaccgctccagcaaaaagtttccgataaagataaagctcttctccaggagttatgctttggcgtactgcgtacgctctcacagttagactggctgattaataagctaatggcccgtccgatgacaggcaaacagcgtactgttcattacctgattatggttggtttgtatcaactgctttatacccgcattccacctcatgccgcgctggctgaaacggttgaaggcgcagttgcaattaagcgcccgcaacttaagggattgattaacggtgtattacgtcagttccagcgtcagcaagatgagttattagccgagtttaatgccagtgatgcacgttatctgcatccttcctggttgctgaagcgtctgcaaaaggcgtatcccgagcagtggcaatccatcgtcgaagccaataaccagcgtccgccaatgtggctgcgcgttaatcgtacgcatcattcccgcgacagctggcttgcattgctggatgaagcaggaatgaaaggtttcccgcatgcggattaccctgatgctgtacagctggaaacacctgcacctgttcatgcgctacccggttttgaagaaggatgggttaccgttcaggatgcttcagcacaaggttgcatgacctggcttgctccacaaaatggtgaacacattctggatctttgcgccgccccaggcggtaaaacaacgcatattcttgaggttgctccagaggcgcaagttctggcggtcgatattgatgagcagcgcctctctcgcgtttacgacaatttaaaacgccttggtatgaaggcaaccgtaaaacaaggtgatggccgttacccttcccaatggtgtggtgagcaacagttcgatcgcattttattagatgcaccttgttcggcaactggtgtaattcgtcgccatccggatattaaatggttacgccgcgatcgcgatatcccagaactcgcgcagttgcagtctgaaattctcgacgccatctggtcgcatttaaaatccggaggaaccctggtctatgccacctgttcgatgttaccggaagagaatagcctgcagattaaagcctttttgcaacgtaccgctgatgccgaactttgcgaaacaggaacaccagagcaaccgggtaaacaaaatttgcccggtgccgaagagggcgacggcttcttttacgctaagctaatcaaaaagtga

SEQ ID NO: 7704 - protein, 429 aa, Escherichia coli
MKKQRNLRSMAAQAIEQVVEQGQSLSNILPPLQQKVSDKDKALLQELCFGVLRTLSQLDWLINKLMARPMTGKQRTVHYLIMVGLYQLLYTRIPPHAALAETVEGAVAIKRPQLKGLINGVLRQFQRQQDELLAEFNASDARYLHPSWLLKRLQKAYPEQWQSIVEANNQRPPMWLRVNRTHHSRDSWLALLDEAGMKGFPHADYPDAVQLETPAPVHALPGFEEGWVTVQDASAQGCMTWLAPQNGEHILDLCAAPGGKTTHILEVAPEAQVLAVDIDEQRLSRVYDNLKRLGMKATVKQGDGRYPSQWCGEQQFDRILLDAPCSATGVIRRHPDIKWLRRDRDIPELAQLQSEILDAIWSHLKSGGTLVYATCSMLPEENSLQIKAFLQRTADAELCETGTPEQPGKQNLPGAEEGDGFFYAKLIKK

SEQ ID NO: 7705 - DNA, 1377 bp, Escherichia coli
atgaaaattatcattctgggtgccggccaggttggcggcacactggcggaaaacctggttggcgagaacaacgatattactgttgtcgataccaacggtgagcgtctgcggaccttacaggataaatttgacctgcgagtcgtgcaagggcatggctctcatccacgcgtattgcgggaggcaggtgccgacgacgccgatatgctggttgctgtaaccagttcagatgaaaccaatatggttgcctgccaggtagcctactcacttttcaacacccctaatcgcatcgctcgtatccgctcaccagactacgtgcgcgatgccgataagctatttcattcagatgctgttccgattgatcatctgatcgcaccagagcagttggttatcgataatatttaccgactgattgagtatcccggcgcattgcaggtggtgaacttcgctgagggtaaagtcagcctggctgtggttaaagcctattatggcggcccgctgattggtaatgcactttcgaccatgcgcgaacatatgccacatatcgatactcgtgtggcagcaattttccgccacgatcgccccattcgtccgcaaggttcgaccattgttgaagctggtgatgaagtgttctttattgccgcttcacagcatatccgcgcggtgatgagtgaattacagcgactggaaaaaccgtataagcggatcatgctggttggtggcggtaatatcggtgcagggctggcgcgtcgtctggaaaaagattacagcgttaaactcatcgaacgtaatcagcagcgcgctgccgaactggcggaaaagttgcagaatacgatcgtcttttttggtgatgcgtcggatcaagaactgctggccgaagaacatatcgatcaagttgatctgtttattgccgtcaccaacgatgacgaggccaatatcatgtccgccatgcttgccaaacgtatgggtgcgaaaaaggtgatggtattgatccaacgtcgcgcttatgtggatctggttcaggggagcgtgatcgatattgcgatttcaccacaacaagcaactatttctgcgttgcttagccatgtgcgaaaagcagatattgttggtgtttcctcattacgccgcggcgtagcagaagctattgaagccgttgctcacggtgatgaaagcacctcacgcgttgtcggcagagtcattgacgaaatcaagctaccgccaggaacgattattggagcggtggtacgtggaaacgatgtgatgattgccaatgacaatctgcgcattgagcaaggcgatcacgtaattatgttcctcacagataaaaagtttattaccgacgtcgaaagactcttccagccaagtcctttcttcttgtaa

SEQ ID NO: 7706 - protein, 458 aa, Escherichia coli
MKIIILGAGQVGGTLAENLVGENNDITVVDTNGERLRTLQDKFDLRVVQGHGSHPRVLREAGADDADMLVAVTSSDETNMVACQVAYSLFNTPNRIARIRSPDYVRDADKLFHSDAVPIDHLIAPEQLVIDNIYRLIEYPGALQVVNFAEGKVSLAVVKAYYGGPLIGNALSTMREHMPHIDTRVAAIFRHDRPIRPQGSTIVEAGDEVFFIAASQHIRAVMSELQRLEKPYKRIMLVGGGNIGAGLARRLEKDYSVKLIERNQQRAAELAEKLQNTIVFFGDASDQELLAEEHIDQVDLFIAVTNDDEANIMSAMLAKRMGAKKVMVLIQRRAYVDLVQGSVIDIAISPQQATISALLSHVRKADIVGVSSLRRGVAEAIEAVAHGDESTSRVVGRVIDEIKLPPGTIIGAVVRGNDVMIANDNLRIEQGDHVIMFLTDKKFITDVERLFQPSPFFL

SEQ ID NO: 7707 - DNA, 414 bp, Escherichia coli
atgagcattattaaagaatttcgcgaatttgcgatgcgcgggaacgtggtggatttggcagtgggtgtcattatcggagcggcattcgggaagattgtatcttcactggttgccgatatcatcatgccacctctgggcttattaattggcgggatcgactttaaacagtttgctgtcacgctacgcgaggcccaaggggatatccctgctgttgtgatgcattacggtgtcttcattcaaaacgtctttgattttctgatagtagcctttgccatctttatggcgattaagctaatcaacaaactgaatcggaaaaaagaagaaccagcagcagcaacacctgcaccaactaaagaagaagtattactgacagaaattcgtgatttgctgaaagagcagaataaccgctcttaa

SEQ ID NO: 7708 - protein, 137 aa, Escherichia coli
MSIIKEFREFAMRGNVVDLAVGVIIGAAFGKIVSSLVADIIMPPLGLLIGGIDFKQFAVTLREAQGDIPAVVMHYGVFIQNVFDFLIVAFAIFMAIKLINKLNRKKEEPAAATPAPTKEEVLLTEIRDLLKEQNNRS

SEQ ID NO: 7709 - DNA, 204 bp, Escherichia coli
catactaaagggcagataaaggataatgcgatagaagcattactacatgatcccttattccgacagcgagtagagaaaaataagaaagggaaaggcagttacatgcgaaaaggaaaacatggcaatcgggggaactgggaggccagtggcaagaaagtaaatcacttttttaccactggccttctgctttcagacgcttgttaa

SEQ ID NO: 7710 - protein, 67 aa, Escherichia coli
HTKGQIKDNAIEALLHDPLFRQRVEKNKKGKGSYMRKGKHGNRGNWEASGKKVNHFFTTGLLLSDAC

SEQ ID NO: 7711 - DNA, 426 bp, Escherichia coli
atgtatcgcattggtgagctggcaaaaatggcggaagtaacacccgacacgattcgttattacgaaaagcagcagatgatggagcatgaagtacgcaccgaaggtgggtttcgcctgtataccgaaagcgatctccagcgattgaaatttatccgccatgccagacaactaggtttcagtctggagtcgatccgcgagttgctgtcgatccgtatcgatccggaacaccatacctgtcaggagtcaaaaggcattgtgcaggaacgattgcaggaagtcgaagctcgtatagccgagttgcagagtatgcagcgttccttgcaacgccttaatgatacctgttgtgggaccgcccatagcagtgtttattgctcgattcttgaagctcttgaacaaggggcgagtggcgttaagagtggctgttga

SEQ ID NO: 7712 - protein, 141 aa, Escherichia coli
MYRIGELAKMAEVTPDTIRYYEKQQMMEHEVRTEGGFRLYTESDLQRLKFIRHARQLGFSLESIRELLSIRIDPEHHTCQESKGIVQERLQEVEARIAELQSMQRSLQRLNDTCCGTAHSSVYCSILEALEQGASGVKSGC

SEQ ID NO: 7713 - DNA, 369 bp, Escherichia coli
atgtggttacttgaccagtgggcagagcgtcatatagcagaagcgcaagcgaaaggtgagtttgataacctggtaggtagcggcgaaccattgatactggatgatgattctcatgtgccaccggaattacgtgcggggtatcgcttgctgaagaatgctggttgcttaccgccagaacttgagcataggagggaagcaatacagcttctggatattctcaaaggtatccgtcatgatgatccgcaatatcaagaggttagtcgtcgattgtcattactggaattgaagctgcgacaagctggattgagtaccgattttttacgcggcgattatgctgacaagttgttgaacaaaatcaacgataactag

SEQ ID NO: 7714 - protein, 122 aa, Escherichia coli
MWLLDQWAERHIAEAQAKGEFDNLVGSGEPLILDDDSHVPPELRAGYRLLKNAGCLPPELEHRREAIQLLDILKGIRHDDPQYQEVSRRLSLLELKLRQAGLSTDFLRGDYADKLLNKINDN

SEQ ID NO: 7715 - DNA, 384 bp, Escherichia coli
atgcgccatcgtaagagtggtcgtcaactgaaccgcaacagcagccatcgccaggctatgttccgcaatatggcaggttcactggttcgtcatgaaatcatcaagacgactctgcctaaagcgaaagagctgcgccgcgtagttgagccgctgattactcttgccaagactgatagcgttgctaatcgtcgtctggcattcgcccgtactcgtgataacgagatcgtggcaaaactgtttaacgaactgggcccgcgtttcgcgagccgtgccggtggttacactcgtattctgaagtgtggcttccgtgcaggcgacaatgcgccgatggcttacatcgagctggttgatcgttcagagaaagcagaagctgctgcagagtaa

SEQ ID NO: 7716 - protein, 127 aa, Escherichia coli [sequence omitted]

SEQ ID NO: 7717 - DNA, 990 bp, Escherichia coli
atgcagggttctgtgacagagtttctaaaaccgcgcctggttgatatcgagcaagtgagttcgacgcacgccaaggtgacccttgagcctttagagcgtggctttggccatactctgggtaacgcactgcgccgtattctgctctcatcgatgccgggttgcgcggtgaccgaggttgagattgatggtgtactacatgagtacagcaccaaagaaggcgttcaggaagatatcctggaaatcctgctcaacctgaaagggctggcggtgagagttcagggcaaagatgaagttattcttaccttgaataaatctggcattggccctgtgactgcagccgatatcacccacgacggtgatgtcgaaatcgtcaagccgcagcacgtgatctgccacctgaccgatgagaacgcgtctattagcatgcgtatcaaagttcagcgcggtcgtggttatgtgccggcttctacccgaattcattcggaagaagatgagcgcccaatcggccgtctgctggtcgacgcatgctacagccctgtggagcgtattgcctacaatgttgaagcagcgcgtgtagaacagcgtaccgacctggacaagctggtcatcgaaatggaaaccaacggcacaatcgatcctgaagaggcgattcgtcgtgcggcaaccattctggctgaacaactggaagctttcgttgacttacgtgatgtacgtcagcctgaagtgaaagaagagaaaccagagttcgatccgatcctgctgcgccctgttgacgatctggaattgactgtccgctctgctaactgccttaaagcagaagctatccactatatcggtgatctggtacagcgtaccgaggttgagctccttaaaacgcctaaccttggtaaaaaatctcttactgagattaaagacgtgctggcttcccgtggactgtctctgggcatgcgcctggaaaactggccaccggcaagcatcgctgacgagtaa

SEQ ID NO: 7718 - protein, 329 aa, Escherichia coli [sequence omitted]

SEQ ID NO: 7719 - DNA, 621 bp, Escherichia coli
atggcaagatatttgggtcctaagctcaagctgagccgtcgtgagggcaccgacttattccttaagtctggcgttcgcgcgatcgataccaagtgtaaaattgaacaagctcctggccagcacggtgcgcgtaaaccgcgtctgtctgactatggtgtgcagttgcgtgaaaagcaaaaagttcgccgtatctatggtgtgctggagcgtcagttccgtaactactacaaagaagcagcacgtctgaaaggcaacaccggtgaaaacctgttggctctgctggaaggtcgtctggacaacgttgtataccgtatgggcttcggtgccactcgtgcagaagcacgtcagctggttagccataaagcaattatggtaaacggtcgtgttgttaacatcgcttcttatcaggttagtccgaatgacgttgtaagcattcgtgagaaagcgaagaagcagtctcgcgtgaaagccgctctggagctggctgagcagcgtgaaaagccaacctggctggaagttgatgctggcaagatggaaggtacgtttaagcgtaagccggagcgttctgatctgtctgcggacattaacgaacacctgatcgtcgagctttactccaagtaa

SEQ ID NO: 7720 - protein, 206 aa, Escherichia coli
MARYLGPKLKLSRREGTDLFLKSGVRAIDTKCKIEQAPGQHGARKPRLSDYGVQLREKQKVRRIYGVLERQFRNYYKEAARLKGNTGENLLALLEGRLDNVVYRMGFGATRAEARQLVSHKAIMVNGRVVNIASYQVSPNDVVSIREKAKKQSRVKAALELAEQREKPTWLEVDAGKMEGTFKRKPERSDLSADINEHLIVELYSK

SEQ ID NO: 7721 - DNA, 390 bp, Escherichia coli
atggcaaaggcaccaattcgtgcacgtaaacgtgtaagaaaacaagtctctgacggcgtggctcatatccatgcttctttcaacaacaccatcgtgactatcactgatcgtcagggtaacgcgttgggttgggcaacagccggtggttccggtttccgtggttctcgcaaatccactccgtttgcagcacaggttgcagcagagcgttgcgctgacgccgtgaaagaatacggcatcaagaatctggaagttatggttaaaggtccgggtccaggccgcgaatctactattcgtgctctgaacgccgcaggtttccgcatcactaacattactgatgtgactccgatccctcataacggttgtcgtccgccgaaaaaacgtcgcgtataa

SEQ ID NO: 7722 - protein, 129 aa, Escherichia coli
MAKAPIRARKRVRKQVSDGVAHIHASFNNTIVTITDRQGNALGWATAGGSGFRGSRKSTPFAAQVAAERCADAVKEYGIKNLEVMVKGPGPGRESTIRALNAAGFRITNITDVTPIPHNGCRPPKKRRV

SEQ ID NO: 7723 - DNA, 357 bp, Escherichia coli
gtggcccgtatagcaggcattaacattcctgatcataagcatgccgtaatcgcattaacttcgatttatggcgtcggcaagacccgttctaaagccatcctggctgcagcgggtatcgctgaagatgttaagatcagtgagctgtctgaaggacaaatcgacacgctgcgtgacgaagttgccaaatttgtcgttgaaggtgatctgcgccgtgaaatcagcatgagcatcaagcgcctgatggatcttggttgctatcgcggtttgcgtcatcgtcgtggtctcccggttcgcggtcagcgtaccaagaccaacgcacgtacccgtaagggtccgcgcaaaccgatcaagaaataa

SEQ ID NO: 7724 - protein, 118 aa, Escherichia coli
MARIAGINIPDHKHAVIALTSIYGVGKTRSKAILAAAGIAEDVKISELSEGQIDTLRDEVAKFVVEGDLRREISMSIKRLMDLGCYRGLRHRRGLPVRGQRTKTNARTRKGPRKPIKK

SEQ ID NO: 7725 - DNA, 117 bp, Escherichia coli
atgaaagttcgtgcttccgtcaagaaattatgccgtaactgcaaaatcgttaagcgtgatggtgtcatccgtgtgatttgcagtgccgagccgaagcataaacagcgccaaggctga

SEQ ID NO: 7726 - protein, 38 aa, Escherichia coli [sequence omitted]

SEQ ID NO: 7727 - DNA, 690 bp, Escherichia coli
gtgcacttcctcgtgttgctgttggttgcagtattagtatttgcagtgacgttctttgttgtatttgttgagcgtggtcaacgccgcattgtggtaaactacgcgaaacgtcagcaaggtcgtcgtgtctatgctgcacagagcacacatttaccgctgaaagtgaatatggcgggggtaatcccggcaatcttcgcttccagtattattctgttcccggcgaccatcgcgtcatggttcgggggcggtactggttggaactggctgacaacaatttcgctgtatttgcagcctgggcaaccgctttatgtgttactctatgcgtctgcaatcatcttcttctgtttcttctacacggcgttggttttcaacccgcgtgaaacagcagataacctgaagaagtccggtgcatttgtaccaggaattcgtccgggagagcaaacggcgaagtatatcgataaagtaatgacccgcctgaccttggttggtgcgctgtacattacctttatctgcctgatcccggagttcatgcgtgatgcaatgaaagtaccgttctacttcggtgggacctcactgcttatcgttgttgtcgtgattatggactttatggctcaagtgcaaactctgatgatgtccagtcagtatgagtctgcattgaagaaggcgaacctgaaaggctacggccgataa

SEQ ID NO: 7728 - protein, 229 aa, Escherichia coli
MHFLVLLLVAVLVFAVTFFVVFVERGQRRIVVNYAKRQQGRRVYAAQSTHLPLKVNMAGVIPAIFASSIILFPATIASWFGGGTGWNWLTTISLYLQPGQPLYVLLYASAIIFFCFFYTALVFNPRETADNLKKSGAFVPGIRPGEQTAKYIDKVMTRLTLVGALYITFICLIPEFMRDAMKVPFYFGGTSLLIVVVVIMDFMAQVQTLMMSSQYESALKKANLKGYGR

SEQ ID NO: 7729 - DNA, 486 bp, Escherichia coli
atggctaaacaaccgggattagattttcaaagtgccaaaggtggcttaggcgagctgaaacgcagactgctgtttgttatcggtgcgctgattgtgttccgtattggctcttttattccgatccctggtattgatgccgctgtacttgccaaactgcttgagcaacagcgaggcaccatcattgagatgtttaacatgttctctggtggtgctctcagccgtgcttctatctttgctctggggatcatgccgtatatttcggcgtcgatcattatccagctactgacggtggttcatccaacgttggcagaaattaagaaagaaggggagtctggtcgtcgtaagatcagccagtacacccgctacggtactctggtgctggcaatattccagtcgatcggtattgctaccggtctgccgaatatgcctggtatgcaaggcctggtcattaacccgggctttgcattctacttcaccgctgtgtaa

SEQ ID NO: 7730 - protein, 161 aa, Escherichia coli
MAKQPGLDFQSAKGGLGELKRRLLFVIGALIVFRIGSFIPIPGIDAAVLAKLLEQQRGTIIEMFNMFSGGALSRASIFALGIMPYISASIIIQLLTVVHPTLAEIKKEGESGRRKISQYTRYGTLVLAIFQSIGIATGLPNMPGMQGLVINPGFAFYFTAV

SEQ ID NO: 7731 - DNA, 435 bp, Escherichia coli
atgcgtttaaatactctgtctccggccgaaggctccaaaaaggcgggtaaacgcctgggtcgtggtatcggttctggcctcggtaaaaccggtggtcgtggtcacaaaggtcagaaatctcgttctggcggtggcgtacgtcgcggtttcgagggtggtcagatgcctctgtaccgtcgtctgccgaaattcggcttcacttctcgtaaagcagcgattacagccgaagttcgtctgtctgacctggctaaagtagaaggcggtgttgtagacctgaacacgctgaaagcggctaacattatcggtatccagatcgagttcgcgaaagtgatcctggctggcgaagtaacgactccggtaactgttcgtggcctgcgtgttactaaaggcgctcgtgctgctatcgaagctgctggcggtaaaatcgaggaataa

SEQ ID NO: 7732 - protein, 144 aa, Escherichia coli
MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE

SEQ ID NO: 7733 - DNA, 180 bp, Escherichia coli
atggcaaagactattaaaattactcaaacccgcagtgcaatcggtcgtctgccgaaacacaaggcaacgctgcttggcctgggtctgcgtcgtattggtcacaccgtagagcgcgaggatactcctgctattcgcggtatgatcaacgcggtttccttcatggttaaagttgaggagtaa

SEQ ID NO: 7734 - protein, 59 aa, Escherichia coli [sequence omitted]

SEQ ID NO: 7735 - DNA, 504 bp, Escherichia coli
atggctcacatcgaaaaacaagctggcgaactgcaggaaaagctgatcgcggtaaaccgcgtatctaaaaccgttaaaggtggtcgtattttctccttcacagctctgactgtagttggcgatggtaacggtcgcgttggttttggttacggtaaagcgcgtgaagttccagcagcgatccagaaagcgatggaaaaagcccgtcgcaatatgattaacgtcgcgctgaataacggtactctgcaacaccctgttaaaggtgttcatacgggttctcgcgtattcatgcagccggcttccgaaggtaccggtatcatcgccggtggtgcaatgcgcgccgttctggaagtcgctggggttcataacgttctggctaaagcgtatggttccaccaacccgattaacgtggttcgtgcaactatcgatggcctggaaaatatgaattctccagaaatggtcgctgccaagcgtggtaaatccgttgaagaaattctggggaaataa

SEQ ID NO: 7736 - protein, 167 aa, Escherichia coli
MAHIEKQAGELQEKLIAVNRVSKTVKGGRIFSFTALTVVGDGNGRVGFGYGKAREVPAAIQKAMEKARRNMINVALNNGTLQHPVKGVHTGSRVFMQPASEGTGIIAGGAMRAVLEVAGVHNVLAKAYGSTNPINVVRATIDGLENMNSPEMVAAKRGKSVEEILGK

SEQ ID NO: 7737 - DNA, 354 bp, Escherichia coli
atggataagaaatctgctcgtatccgtcgtgcgacccgcgcacgccgcaagctccaggagctgggcgcaactcgcctggtggtacatcgtaccccgcgtcacatttacgcacaggtaattgcaccgaacggttctgaagttctggtagctgcttctactgtagaaaaagctatcgctgaacaactgaagtacaccggtaacaaagacgcggctgcagctgtgggtaaagctgtcgctgaacgcgctctggaaaaaggcatcaaagatgtatcctttgaccgttccgggttccaatatcatggtcgtgtccaggcactggcagatgctgcccgtgaagctggccttcagttctaa

SEQ ID NO: 7738 - protein, 117 aa, Escherichia coli [sequence omitted]

SEQ ID NO: 7739 - DNA, 534 bp, Escherichia coli
atgtctcgtgttgctaaagcaccggtcgttgttcctgccggcgttgacgtaaaaatcaacggtcaggttattacgatcaaaggtaaaaacggcgagctgactcgtactctcaacgatgctgttgaagttaaacatgcagataataccctgaccttcggtccgcgtgatggttacgcagacggttgggcacaggctggtaccgcgcgtgccctgctgaactcaatggttatcggtgttaccgaaggcttcactaagaagctgcagctggttggtgtaggttaccgtgcagcggttaaaggcaatgtgattaacctgtctctgggtttctctcatcctgttgaccatcagctgcctgcgggtatcactgctgaatgtccgactcagactgaaatcgtgctgaaaggcgctgataagcaggtgatcggccaggttgcagcggatctgcgcgcctaccgtcgtcctgagccttataaaggcaagggtgttcgttacgccgacgaagtcgtgcgtaccaaagaggctaagaagaagtaa

SEQ ID NO: 7740 - protein, 177 aa, Escherichia coli [sequence omitted]

SEQ ID NO: 7741 - DNA, 624 bp, Escherichia coli
atgatattggaacccggaacggtcaaaggatacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattga

SEQ ID NO: 7742 - protein, 207 aa, Escherichia coli
MILEPGTVKGYIFDAFFQSAFSDSFTHSCSRVFVTGVLQLFSDSFFYSRSSYQNFRTVRCNYLCVNVTRGTMYHQASCAQLLELAACAGRTTDTSRFLIHSVTLLLLSLFGTHDFVGVTNTLAFIRLRTTVGAQIRCNLADHLLISAFQHDFSLSRTFSSDTRRQLMVNRMRETQRQVNHIAFNRCTVTYTNQLQLLSEAFGNTDNH

SEQ ID NO: 7743 - DNA, 393 bp, Escherichia coli
atgagcatgcaagatccgatcgcggatatgctgacccgtatccgtaacggtcaggccgcgaacaaagctgcggtcaccatgccttcctccaagctgaaagtggcaatcgccaacgtgctgaaggaagaaggttttattgaagattttaaagttgaaggcgacaccaagcctgaactggaacttactctgaagtatttccagggcaaagctgttgtagaaagcattcagcgtgtcagccgcccaggtctgcgcatctataaacgtaaagatgagctgccgaaagttatggcgggtctgggtatcgcagttgtttctacctctaaaggtgttatgactgatcgtgcagcgcgccaggctggtcttggtggcgaaattatctgctacgtagcctaa

SEQ ID NO: 7744 - protein, 130 aa, Escherichia coli
MSMQDPIADMLTRIRNGQAANKAAVTMPSSKLKVAIANVLKEEGFIEDFKVEGDTKPELELTLKYFQGKAVVESIQRVSRPGLRIYKRKDELPKVMAGLGIAVVSTSKGVMTDRAARQAGLGGEIICYVA

SEQ ID NO: 7745 - DNA, 306 bp, Escherichia coli
atggctaagcaatcaatgaaagcacgcgaagtaaaacgcgtagctttagctgataaatacttcgcgaaacgcgctgaactgaaagcgatcatctctgatgtgaacgcttccgacgaagatcgttggaacgctgttctcaagctgcagactctgccgcgtgattccagcccgtctcgtcagcgtaaccgctgccgtcaaacaggtcgtccgcatggtttcctgcggaagttcgggttgagccgtattaaggtccgtgaagccgctatgcgcggtgaaatcccgggtctgaaaaaggctagctggtaa

SEQ ID NO: 7746 - protein, 101 aa, Escherichia coli
MAKQSMKAREVKRVALADKYFAKRAELKAIISDVNASDEDRWNAVLKLQTLPRDSSPSRQRNRCRQTGRPHGFLRKFGLSRIKVREAAMRGEIPGLKKASW

SEQ ID NO: 7747 - DNA, 540 bp, Escherichia coli
atggcgaaactgcatgattactacaaagacgaagtagttaaaaaactcatgactgagtttaactacaattctgtcatgcaagtccctcgggtcgagaagatcaccctgaacatgggtgttggtgaagcgatcgctgacaaaaaactgctggataacgcagcagcagacctggcagcaatctccggtcaaaaaccgctgatcaccaaagcacgcaaatctgttgcaggcttcaaaatccgtcagggctatccgatcggctgtaaagtaactctgcgtggcgaacgcatgtgggagttctttgagcgcctgatcactattgctgtacctcgtatccgtgacttccgtggcctgtccgctaagtctttcgacggtcgtggtaactacagcatgggtgtccgtgagcagatcatcttcccagaaatcgactacgataaagtcgaccgcgttcgtggtttggatattaccattaccactactgcgaaatctgacgaagaaggccgcgctctgctggctgcctttgacttcccgttccgcaagtaa

SEQ ID NO: 7748 - protein, 179 aa, Escherichia coli [sequence omitted]

SEQ ID NO: 7749 - DNA, 315 bp, Escherichia coli
atggcagcgaaaatccgtcgtgatgacgaagttatcgtgttaaccggtaaagataaaggtaaacgcggtaaagttaagaatgtcctgtcttccggcaaggtcattgttgaaggtatcaacctggttaagaaacatcagaagccggttccggccctgaaccaaccgggtggcatcgttgaaaaagaagccgctattcaggtttccaacgtagcaatcttcaatgcgacaaccggcaaggctgaccgtgtaggctttagattcgaagacggtaaaaaagtccgtttcttcaagtctaacagcgaaactatcaagtaa

SEQ ID NO: 7750 - protein, 104 aa, Escherichia coli
MAAKIRRDDEVIVLTGKDKGKRGKVKNVLSSGKVIVEGINLVKKHQKPVPALNQPGGIVEKEAAIQVSNVAIFNATTGKADRVGFRFEDGKKVRFFKSNSETIK

SEQ ID NO: 7751 - DNA, 372 bp, Escherichia coli
atgatccaagaacagactatgctgaacgtcgccgacaactccggtgcacgtcgcgtaatgtgtatcaaggttctgggtggctcgcaccgtcgctacgcaggcgtaggcgacatcatcaagatcaccatcaaagaagcaattccgcgtggtaaggtcaaaaaaggtgatgtgctgaaggcggtagtggtgcgcaccaagaagggtgttcgtcgcccggacggttctgtcattcgcttcgatggtaatgcttgtgttcttctgaacaacaacagcgagcagcctatcggtacgcgtatttttgggccggtaactcgtgagcttcgtagtgagaagttcatgaaaattatctctctggcaccagaagtactctaa

SEQ ID NO: 7752 - protein, 123 aa, Escherichia coli [sequence omitted]

SEQ ID NO: 7753 - DNA, 255 bp, Escherichia coli
atgaccgataaaatccgtactctgcaaggtcgcgttgttagcgacaaaatggagaaatccattgttgttgctatcgaacgttttgtgaaacacccgatctacggtaaattcatcaagcgtacgaccaaactgcacgtacatgacgagaacaacgaatgcggtatcggtgacgtggttgaaatccgcgaatgccgtccgctgtccaagactaaatcctggacgctggttcgcgttgtagagaaagcggttctgtaa

SEQ ID NO: 7754 - protein, 84 aa, Escherichia coli
MTDKIRTLQGRVVSDKMEKSIVVAIERFVKHPIYGKFIKRTTKLHVHDENNECGIGDVVEIRECRPLSKTKSWTLVRVVEKAVL

SEQ ID NO: 7755 - DNA, 192 bp, Escherichia coli
atgaaagcaaaagagctgcgtgagaagagcgttgaagagctgaacaccgagctgctgaacctgctgcgtgagcagttcaacctgcgtatgcaggctgcaagtggccagctgcaacagtctcacctgttgaagcaagtgcgtcgcgatgtcgcacgcgttaagactttactgaacgagaaggcgggtgcgtaa

SEQ ID NO: 7756 - protein, 63 aa, Escherichia coli [sequence omitted]

SEQ ID NO: 7757 - DNA, 411 bp, Escherichia coli
atgttacaaccaaagcgtacaaaattccgtaaaatgcacaaaggccgtaaccgcggtctggcgcagggtacggatgttagcttcggcagcttcggtctgaaagctgttggccgtggtcgtctgactgcacgtcagatcgaagcagcacgtcgtgctatgacccgtgcagttaagcgtcaaggtaagatctggatccgtgtgttcccggacaaaccgatcactgaaaagccgctggcagtgcgtatgggtaaaggtaaaggtaacgtggagtattgggttgccttgattcagccgggtaaagtcctgtatgaaatggacggtgttccggaagagctggcccgtgaagcattcaagctggcagcagcgaaactgccgattaaaaccacctttgtaactaagacggtgatgtaa

SEQ ID NO: 7758 - protein, 136 aa, Escherichia coli [sequence omitted]

SEQ ID NO: 7759 - DNA, 702 bp, Escherichia coli
atgggtcagaaagtacatcctaatggtattcgcctgggtattgtaaaaccatggaactctacctggtttgcgaacaccaaagaattcgctgacaacctggacagcgattttaaagtacgtcagtacctgactaaggaactggctaaagcgtccgtatctcgtatcgttatcgagcgtccggctaagagcatccgtgtaaccattcacactgctcgcccgggtatcgttatcggtaaaaaaggtgaagacgtagaaaaactgcgtaaggtcgtagcggacatcgctggcgttcctgcacagatcaacatcgccgaagttcgtaagcctgaactggacgcaaaactggttgctgacagcatcacttctcagctggaacgtcgcgttatgttccgtcgtgctatgaagcgtgctgtacagaacgcaatgcgtctgggcgctaaaggtattaaagttgaagttagcggccgtctgggcggcgcggaaatcgcacgtaccgaatggtaccgcgaaggtcgcgtaccgctgcacactctgcgtgctgacatcgactacaacacctctgaagcgcacaccacttacggtgtaatcggcgttaaagtgtggatcttcaaaggcgagatcctgggtggtatggctgctgttgaacaaccggaaaaaccggctgctcagcctaaaaagcagcagcgtaaaggccgtaaataa

SEQ ID NO: 7760 - protein, 233 aa, Escherichia coli
MGQKVHPNGIRLGIVKPWNSTWFANTKEFADNLDSDFKVRQYLTKELAKASVSRIVIERPAKSIRVTIHTARPGIVIGKKGEDVEKLRKVVADIAGVPAQINIAEVRKPELDAKLVADSITSQLERRVMFRRAMKRAVQNAMRLGAKGIKVEVSGRLGGAEIARTEWYREGRVPLHTLRADIDYNTSEAHTTYGVIGVKVWIFKGEILGGMAAVEQPEKPAAQPKKQQRKGRK

SEQ ID NO: 7761 - DNA, 333 bp, Escherichia coli
atggaaactatcgctaaacatcgccatgctcgttcttctgctcagaaggttcgccttgttgctgacctgattcgcggtaagaaagtgtcgcaggctctggatattttgacctacaccaacaagaaagcggctgtactggtcaagaaagttctggaatctgccattgctaacgctgaacacaacgatggcgctgacattgacgatctgaaagttacgaaaattttcgtagacgaaggcccgagcatgaagcgcattatgccgcgtgcaaaaggtcgtgcagatcgcatcctgaagcgcaccagccacatcactgtggttgtgtccgatcgctga

SEQ ID NO: 7762 - protein, 110 aa, Escherichia coli [sequence omitted]

SEQ ID NO: 7763 - DNA, 279 bp, Escherichia coli
atgccacgttctctcaagaaaggtccttttattgacctgcacttgctgaagaaggtagagaaagcggtggaaagcggagacaagaagcccctgcgcacttggtcccgtcgttcaacgatctttcctaacatgatcggtttgaccatcgctgtccataatggtcgtcagcacgttccggtatttgtaaccgacgaaatggtcggtcacaaactgggtgaattcgcaccgactcgtacttatcgcggccacgctgctgataaaaaagcgaagaagaaataa

SEQ ID NO: 7764 - protein, 92 aa, Escherichia coli
MPRSLKKGPFIDLHLLKKVEKAVESGDKKPLRTWSRRSTIFPNMIGLTIAVHNGRQHVPVFVTDEMVGHKLGEFAPTRTYRGHAADKKAKKK

SEQ ID NO: 7765 - DNA, 822 bp, Escherichia coli
atggcagttgttaaatgtaaaccgacatctccgggtcgtcgccacgtagttaaagtggttaaccctgagctgcacaagggcaaaccttttgctccgttgctggaaaaaaacagcaaatccggtggtcgtaacaacaatggccgtatcaccactcgtcatatcggtggtggccacaagcaggcttaccgtattgttgacttcaaacgcaacaaagacggtatcccggcagttgttgaacgtcttgagtacgatccgaaccgttccgcgaacatcgcgctggttctgtacaaagacggtgaacgccgttacatcctggcccctaaaggcctgaaagctggcgaccagattcagtctggcgttgatgctgcaatcaaaccaggtaacaccctgccgatgcgcaacatcccggttggttctactgttcataacgtagaaatgaaaccaggtaaaggcggtcagctggcacgttccgctggtacttacgttcagatcgttgctcgtgatggtgcttatgtcaccctgcgtctgcgttctggtgaaatgcgtaaagtagaagcagactgccgtgcaactctgggcgaagttggcaatgctgagcatatgctgcgcgttctgggtaaagcaggtgctgcacgctggcgtggtgttcgtccgaccgttcgcggtaccgcgatgaacccggtagaccacccacatggtggtggtgaaggtcgtaactttggtaagcacccggtaactccgtggggcgttcagaccaaaggtaagaagacccgcagcaacaagcgtactgataaattcatcgtacgtcgccgtagcaaataa

SEQ ID NO: 7766 - protein, 273 aa, Escherichia coli [sequence omitted]

SEQ ID NO: 7767 - DNA, 303 bp, Escherichia coli
atgattcgtgaagaacgtctgctgaaggtgctgcgtgcaccgcacgtttctgaaaaagcgtctactgcgatggaaaaatccaacaccatcgtactcaaagttgctaaagacgcgaccaaagcagaaatcaaagctgctgtgcagaaactgtttgaagtcgaagtcgaagtcgttaacaccctggtagttaaagggaaagttaaacgtcacggacagcgtatcggtcgtcgtagcgactggaaaaaagcttacgtcaccctgaaagaaggccagaatctggacttcgttggcggcgctgagtaa

SEQ ID NO: 7768 - protein, 100 aa, Escherichia coli [sequence omitted]

SEQ ID NO: 7769 - DNA, 606 bp, Escherichia coli
atggaattagtattgaaagacgcgcagagcgcgctgactgtttccgaaactaccttcggtcgtgatttcaacgaagcgctggttcaccaggttgttgttgcttatgcagctggtgctcgtcagggtactcgtgctcagaagactcgtgctgaagtaactggttccggtaaaaaaccgtggcgccagaaaggcaccggccgtgcgcgttctggttctatcaagagcccgatctggcgttctggtggcgtgacctttgctgctcgtccgcaggaccacagtcaaaaagttaacaagaagatgtaccgcggcgcgctgaaaagcatcctgtccgaactggtacgtcaggatcgtctgatcgttgtcgagaagttctctgtagaagcgccgaaaactaagctgctggcacagaaactgaaagacatggctctggaagatgtgctgatcatcaccggtgagctggacgagaacctgttcctggctgcgcgcaacctgcacaaggttgacgtacgcgatgcaactggtatcgacccggttagcctgatcgccttcgacaaagtcgtaatgactgctgatgctgttaagcaagttgaggagatgctggcatga

SEQ ID NO: 7770 - protein, 201 aa, Escherichia coli [sequence omitted]

SEQ ID NO: 7771 - DNA, 630 bp, Escherichia coli
atgattggtttagtcggtaaaaaagtgggtatgacccgtatcttcacagaagacggcgtttctatcccagtaaccgtaatcgaagttgaagcaaaccgcgttactcaggttaaagacctggctaacgatggctaccgtgctattcaggtgaccaccggtgctaaaaaagctaaccgtgtgaccaagcctgaagctggacacttcgctaaagctggcgtagaagctggccgtggtctgtgggaattccgcctggctgaaggcgaagagttcactgtaggtcagagcattagcgttgaactgtttgctgacgttaaaaaagttgacgtaactggcacctctaaaggtaaaggtttcgcaggtaccgttaagcgctggaacttccgtacccaggacgctactcacggtaactccttgtctcaccgcgttccgggttctatcggtcagaaccagactccgggcaaagtgttcaaaggcaagaaaatggcaggtcagatgggtaacgaacgtgtaaccgttcagagccttgacgtagtacgcgttgacgctgagcgcaacctgctgctggttaaaggcgctgtcccgggtgcaaccggtagcgacctgatcgttaaaccagctgtgaaggcgtaa

SEQ ID NO: 7772 - protein, 209 aa, Escherichia coli [sequence omitted]

SEQ ID NO: 7773 - DNA, 312 bp, Escherichia coli
atgcagaaccaaagaatccgtatccgcctgaaagcgtttgatcatcgtctgatcgatcaagcaaccgcggaaatcgtcgagactgctaagcgcactggtgcgcaggtccgtggtccgatcccgctgccgacacgcaaagagcgcttcactgttctgatctccccgcacgtcaacaaagacgcgcgcgatcagtacgaaatccgtactcacttgcgtctggttgacatcgttgagccaaccgagaaaaccgttgatgctctgatgcgtctggatctggctgccggtgtagacgtgcagatcagcctgggttaa

SEQ ID NO: 7774 - protein, 103 aa, Escherichia coli
MQNQRIRIRLKAFDHRLIDQATAEIVETAKRTGAQVRGPIPLPTRKERFTVLISPHVNKDARDQYEIRTHLRLVDIVEPTEKTVDALMRLDLAAGVDVQISLG

SEQ ID NO: 7775 - DNA, 420 bp, Escherichia coli
atgtttgaattctatatcgccgcgcgtgagcagaaagaaacgggtcaccctggtatcttctcccgacaaaaacacagcaccataatatatgtcatttgtttattgctgatttgcctgtggtttgcaggaatggtgttggttggtgggtatgcccggcagctatgggcactttggatagtaaaagcagaagtcactgtagatgctgaaacgcccgcttttaaacaatcaacacaacactattttttcaaaaaacagccactccccgtcgtcgaatccgtcgaggaggaagatgaaccaggcgtcgcggttgagaatgccccctcttcttctgaagacgaagaaaatactgtagaagaaagcgacgagaaagccggtttaagagagcgtgtcaaaaatgcgctgaacgaacttgagagataa

SEQ ID NO: 7776 - protein, 139 aa, Escherichia coli
MFEFYIAAREQKETGHPGIFSRQKHSTIIYVICLLLICLWFAGMVLVGGYARQLWALWIVKAEVTVDAETPAFKQSTQHYFFKKQPLPVVESVEEEDEPGVAVENAPSSSEDEENTVEESDEKAGLRERVKNALNELER

SEQ ID NO: 7777 - DNA, 1470 bp, Escherichia coli
atgtctacgagaagagaagtcattctttcctggttgcgtgagaaacgtcagacctggcgtctgtgctatttgttgggtgaggctggaagtggaaaaacctggctggcgcagcaactacaaaaagataaacatcgccgtgtgattactttaagcctcgttgtttcctggcaaggtaaggccgcatggatcgttaccgacgataatgcggctgaacagggctgccgtgacagcgcctggacgcgagatgagatggcgggtcaattactgcatgcacttcatcgaactgatagtcgctgccctcttattattattgaaaatgctcacctgaatcaccgccgcatacttgatgatctccaacgcgcgatatctcttattcctgacggtcaatttttgctgatcggcagacccgatcgaaaagttgaacgtgattttaaaaaacagggcattgaacttgtctcgacaggtcgtctgacggagcacgagcttaaggcaagcatccttgaaggtcagaatattgaccagcccgatctccttttaaccgccagagttctgaaacggatagctttattatgtcggggagatcgcagaaagctggcgcttgccggcgaaacaattagcttattacagcaagccgagcagacccgcgttttcactgcaaaacaatggcgaatgatttaccgcgtattaggtgataagcgcccccggaaaatgcagcttgccgtggtgatgagtggaaccattctcgcacttacctgtggttggctactgctgtcctctttcacagctccgttacccgttcctgcgtggctgatacccgtaacgccagtagttaaacaagatatgactaaggatattgctcatgtggtgatgcgcgatagtgaggcgctaagcgtgttatacggcgtatgggggtacgaggttccagccgattcggcctggtgcgatcaggcagtaagagcggggctggtatgtaaaagtgggaacgcttctttacaaacattggtagatcagaatttgccctggatcgcatcgcttaaagtcggggacaaaaaattgcctgttgtggtcgttcgcgtcggtgatgctaccgttgatgtactcgtagggcagcaaacctggacgctgacacataaatggtttgagttggtatggacgggtgattatcttctgttgtggaaaatgtcgccggaaggggagagtaccattatgcgtgatagcagcgaggaagagattctctggctggaaacgatgttaaaccgcgcattgcatatttcgacagaatcttcggcagagtggcgtcccttgttggtagaaaaaataaagcaatttcaaaaaagccatcacttgaaaactgacggtgttgttggcttttcaacgttagtacatctctggcaggtggcgggggagagtgcctacttatatcgggatgaagcaaatatttccccagaaacaacagtgaaggggaaatga

SEQ ID NO: 7778 - protein, 489 aa, Escherichia coli
MSTRREVILSWLREKRQTWRLCYLLGEAGSGKTWLAQQLQKDKHRRVITLSLVVSWQGKAAWIVTDDNAAEQGCRDSAWTRDEMAGQLLHALHRTDSRCPLIIIENAHLNHRRILDDLQRAISLIPDGQFLLIGRPDRKVERDFKKQGIELVSTGRLTEHELKASILEGQNIDQPDLLLTARVLKRIALLCRGDRRKLALAGETISLLQQAEQTRVFTAKQWRMIYRVLGDKRPRKMQLAVVMSGTILALTCGWLLLSSFTAPLPVPAWLIPVTPVVKQDMTKDIAHVVMRDSEALSVLYGVWGYEVPADSAWCDQAVRAGLVCKSGNASLQTLVDQNLPWIASLKVGDKKLPVVVVRVGDATVDVLVGQQTWTLTHKWFELVWTGDYLLLWKMSPEGESTIMRDSSEEEILWLETMLNRALHISTESSAEWRPLLVEKIKQFQKSHHLKTDGVVGFSTLVHLWQVAGESAYLYRDEANISPETTVKGK

SEQ ID NO: 7779 - DNA, 816 bp, Escherichia coli
gtgcccacactacctttccctttccatctggcgaatcataataaagatgctgccatcaatatattgattatatttataagcatagggttgattatttttaatgtgaattatttccatacaactatagttaaaaatgaacagatcattaatcaaccaacaaatgcatttcagtctgaattcagccttgccgctttatggcgcaacgaaaatcatgctggggtaaaagatgcaaatcccgtggcagttaatcaggaaacacctaagctctctatagcgcttaatggcattgtactcacatcgaatgatgagacttcttttgtcttaattaatgaggggaacgaacaaaagcgatactccctcaacgaagcccttgagtcagcgccgggaacgtttattagaaaaataaataaaaccagcgttgtgtttgaaactcacgggcattacgaaaaagtaactctccatccagggctacctgacatcatcaagcagcctgattcggaaaatcaaaatgtactcgccgattatattatcgccacacctatacgtgatggagaacagatatacggtcttcgattgaatcctcgtaagggtctcaatgcatttaccaccagcttgctgcaacctggggatatcgccctcaggatcaataatctttcgctgacccaccctgatgaggtttcacaggcattaagtttactgctaactcaacaaagtgctcagtttacaattcgtcgcaacggcgtaccccgcttgataaatgtttccgtcgcggaacttacaggaatgaatggacagcgcaatgaagggactcaataa

SEQ ID NO: 7780 - protein, 271 aa, Escherichia coli
MPTLPFPFHLANHNKDAAINILIIFISIGLIIFNVNYFHTTIVKNEQIINQPTNAFQSEFSLAALWRNENHAGVKDANPVAVNQETPKLSIALNGIVLTSNDETSFVLINEGNEQKRYSLNEALESAPGTFIRKINKTSVVFETHGHYEKVTLHPGLPDIIKQPDSENQNVLADYIIATPIRDGEQIYGLRLNPRKGLNAFTTSLLQPGDIALRINNLSLTHPDEVSQALSLLLTQQSAQFTIRRNGVPRLINVSVAELTGMNGQRNEGTQ

SEQ ID NO: 7781 - DNA, 1965 bp, Escherichia coli
atggacagcgcaatgaagggactcaataaaatcacctgctgcttgctggcagcactactcatgccttgtgcaggacacgctgagaacgaacaatacggcgctaacttcaataacgccgatatccgccagttcgtggaaatagtgggtcagcatcttggcaaaacgatcctgatcgacccttcggtacagggaaccatttccgtacgcagtaatgatacgtttagccaacaggagtactaccagttctttttaagtattcttgatctttacggttattccgtgatcacactggacaatggttttctgaaagtggtgcgctcagctaatgtaaaaacatcgccagggatgattgctgacagttctcgtccaggcgtaggtgatgagttggtcacccgaatcgtaccgcttgagaacgttcctgctcgtgacctggctcccctgctccgccagatgatggatgcgggtagcgtcggtaatgttgtgcattatgaaccctccaacgttcttattctgaccggtcgtgcctccaccattaataaactgattgaagtcataaagcgcgttgatgtcatcggcacagagaagcagcaaattattcatctggaatatgcatcagcggaagatctcgccgagattcttaatcaattaatcagcgaaagccacggtaaaagccagatgcctgccctcctttccgcgaagattgtggcggataagcgaaccaactctcttatcatcagcgggccggaaaaagcacgccagcgcataacttcattactgaaaagccttgatgtagaagagagcgaggaaggaaatacccgggtctattacctgaaatatgctaaagccacgaatctggtggaagtgctaaccggtgtttccgaaaagctgaaagatgaaaaagggaattcgcgtaagccttcttctacttctgcgatggataatgtggccattaccgccgatgaacagaccaactcgttggtcattaccgctgaccagtccgtccaggagaaactcgccacggtaattgcgcgtctggatattcgccgtgcacaggtgctggttgaggcaatcatcgtcgaagttcaggatggaaatggactcaacctcggcgtgcaatgggcgaataaaaacgttggcgcacagcaatttaccaatacgggattaccggtttttaacgctgcgcaaggtgtagctgattataaaaagaatggcgggatcaccagcgcgaatcctgcctgggatatgtttagcgcctacaatggcatggctgcaggcttcttcaatggcgactggggcgtattgttgactgcgctggccagtaacaataaaaatgacatcctcgccaccccgagcatcgtaacgctggataataaactcgcgtccttcaacgttggtcaggatgtgccggtgctatccggctctcagaccacttctggggataacgtctttaatactgtcgaacgcaaaacggtgggcacaaaactcaaagtcactccgcaggtcaatgaaggcgacgcggtactgctcgaaatagagcaggaggtttccagcgttgactcttcgtctaattcgacgctcggcccgacatttaacacccgtactattcaaaacgccgtgctggttaaaaccggtgaaacggtggtcctgggcggattgctggatgatttttctaaagagcaagtgtcaaaggttcctctgcttggcgatattcctttagtgggacaactcttccgctatacctcgaccgagcgcgctaaacgcaacctgatggtatttatccgtccgacgattatccgtgacgatgatgtttatcgctcactgtcaaaagagaaatacacccgctaccgccaggagcaacagctgcgaatcgacgggaaatcaaaagcgctgattggctcggaagatttgccggtgctggatgagaacacgttcaacagtcacgctcctgcgccatcgtcacggtga

SEQ ID NO: 7782 - protein, 654 aa, Escherichia coli
MDSAMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNSRKPSSTSAMDNVAITADEQTNSLVITADQSVQEKLATVIARLDIRRAQVLVEAIIVEVQDGNGLNLGVQWANKNVGAQQFTNTGLPVFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQLRIDGKSKALIGSEDLPVLDENTFNSHAPAPSSR

SEQ ID NO: 7783 - DNA, 1482 bp, Escherichia coli
atgagaattcactcaccgtaccccgccagttgggcgctggcacaacgaattggttatctctattcagagggcgagattatttatctcgccgatacgccattcgaacggttactcgatattcaacgtcaggttggccagtgccagaccatgaccagcttgtcacaggctgattttgaagcccggctggaagcggtgttccatcagaataccggtgagtcgcaacagattgcgcaagatatcgatcaatccgtcgatcttctctcgctttcggaagagatgcccgcaaatgaagatctcctgaatgaagattcagcggcaccggttatccgcttgatcaatgctattttgagtgaggccatcaaagaaaccgcctccgatatccacattgaaacctatgaaaaaacaatgtcgatccgttttcgcatcgacggcgttttgcggacaattttacagccaaacaaaaaactggcggcactgcttatctcccgaattaaggtcatggctcgtcttgatatcgccgaaaaacgtattccacaggatggacgtattagtttgcgtatcgggcgacgtaacatagatgtccgcgtatccacactgccgtccatctatggtgaacgcgccgtgctccgtctgctggataaaaacagcctccagctttcattgaacaacctggggatgacggcagcggataaacaggatttagaaaatctcatccagcttccacacggtattatcctggtgaccggaccgacaggctccggtaaaagtaccacgctctacgccattctttcggcgctgaatactcccggccgcaatattctgacggtagaagatcccgtggaatatgaactggaaggcataggacaaacgcaggtgaatacccgtgtggatatgtctttcgctcgcggcctgcgcgccatacttcgccaggacccggatgtcgtcatggtgggggaaattcgtgatacagaaaccgcgcaaattgcggttcaggcctcgctcaccggccatctggtactctcaacactccacactaacagtgcatcaggcgcagtgacccggctccgcgacatgggcgtcgaatcattcctgctttcgtcttcactggcagggattatcgcgcaacgtctggttcgtcgtctgtgtccgcaatgccgacaattcacgcctgtatcgccgcaacaagcgcagatgtttaaacatcatcagctcgcggtgacgacaattggcactcccgtaggctgccctcattgccatcaatccggctaccaggggcgcatggcgatccacgaaatgatggtggtgacgccggaattgcgggccgctattcatgaaaatgtggatgaacaagcactggagcgactggtccggcaacaacacaatgccttaatcaaaaatggcctgcaaaaagtgatacgcggtgacacctcctgggatgaggttatgcgcgtcgccagtgccacgctggagaacgaagcatga

SEQ ID NO: 7784 - protein, 493 aa, Escherichia coli
MRIHSPYPASWALAQRIGYLYSEGEIIYLADTPFERLLDIQRQVGQCQTMTSLSQADFEARLEAVFHQNTGESQQIAQDIDQSVDLLSLSEEMPANEDLLNEDSAAPVIRLINAILSEAIKETASDIHIETYEKTMSIRFRIDGVLRTILQPNKKLAALLISRIKVMARLDIAEKRIPQDGRISLRIGRRNIDVRVSTLPSIYGERAVLRLLDKNSLQLSLNNLGMTAADKQDLENLIQLPHGIILVTGPTGSGKSTTLYAILSALNTPGRNILTVEDPVEYELEGIGQTQVNTRVDMSFARGLRAILRQDPDVVMVGEIRDTETAQIAVQASLTGHLVLSTLHTNSASGAVTRLRDMGVESFLLSSSLAGIIAQRLVRRLCPQCRQFTPVSPQQAQMFKHHQLAVTTIGTPVGCPHCHQSGYQGRMAIHEMMVVTPELRAAIHENVDEQALERLVRQQHNALIKNGLQKVIRGDTSWDEVMRVASATLENEA

SEQ ID NO: 7785 - DNA, 1197 bp, Escherichia coli
atgaattatcgctatcgcgccatgacccaggatggtcaaaaattgcaggggatcattgatgctaacgatgaacgtcaggcacgactgcggctgcgtgaagaagggcttttcctgttggatattcgcccccaaaaaagttcgggagtaaaaacacgtcgcccgaggatcagccatagtgaactaacgcttttcacccggcagttggcaaccttaagcgcagcggcattacccctggaagagagccttgccgtaattggtcaacaaagcagtaataatcgactggctgacgtgttaaatcaggtacgcagcgccatccttgaagggcatcccctttccgatgcgttacaacattttcccacgcttttcgattcgctctaccgtaccctggtaaaagcgggcgaaaagagcggtctgctggccccggtgttggaaaagctggctgattacaatgaaaaccggcagaaaatccgcagcaagctcattcagtcactgatctacccctgcatgctcactacggtggcgattgtggtcgtgattattctcctcactgctgtcgtgcccaaaattaccgaacagttcgtgcatatgaagcagcaactgccactgagtacacgcattcttttaggtctgagcgacacgttgcaacgtaccggcccgacattattagcgacagtatttattgtcgctgtgggtttctggctctggttaaaacgcggcaataaccgccaccgttttcatgccatgttactgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgcctggcaaatgcggcagaaaacgttcgccagggtaacagcattcatctttcactggaacaaaccgcaattttcccgccgatgatgctctacatggtggcctctggcgaaaaaagcgggcaactcggcacgttaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaa

SEQ ID NO: 7786 - protein, 398 aa, Escherichia coli
MNYRYRAMTQDGQKLQGIIDANDERQARLRLREEGLFLLDIRPQKSSGVKTRRPRISHSELTLFTRQLATLSAAALPLEESLAVIGQQSSNNRLADVLNQVRSAILEGHPLSDALQHFPTLFDSLYRTLVKAGEKSGLLAPVLEKLADYNENRQKIRSKLIQSLIYPCMLTTVAIVVVIILLTAVVPKITEQFVHMKQQLPLSTRILLGLSDTLQRTGPTLLATVFIVAVGFWLWLKRGNNRHRFHAMLLRVALIGPLICAINSARYLRTLSILQSSGVPLLDGMNLSTESLNNLEIRQRLANAAENVRQGNSIHLSLEQTAIFPPMMLYMVASGEKSGQLGTLMVRAADNQETLQQNRIALTLSIFEPALIITMALIVLFIVVSVLQPLLQLNSMIN

SEQ ID NO: 7787 - DNA, 438 bp, Escherichia coli
atgcgcgcaacggataagcaacgcggttttacattactggaaattatggtggtaattgtcatcattggcgtactcgccagcctggtggttcccaacctgatgggcaataaagaaaaggcggataaacaaaaagccgtcagcgatattgtggcgctggaaaacgccctggatatgtacaagctcgacaatcatcgctatccaaccacaaatcaggggcttgaatccttagtagaagcgccgacactgccaccgctggccgcaaactataacaaggaaggttatatcaagcgtctgcctgccgatccctggggcaatgattatgtcctcgttaatcctggtgagcatggtgcatacgatctgctttcagcaggacccgatggtgaaatgggaaccgaggacgacatcaccaactggggtttgagcaagaagaaaaagtaa

SEQ ID NO: 7788 - protein, 145 aa, Escherichia coli
MRATDKQRGFTLLEIMVVIVIIGVLASLVVPNLMGNKEKADKQKAVSDIVALENALDMYKLDNHRYPTTNQGLESLVEAPTLPPLAANYNKEGYIKRLPADPWGNDYVLVNPGEHGAYDLLSAGPDGEMGTEDDITNWGLSKKKK

SEQ ID NO: 7789 - DNA, 468 bp, Escherichia coli
gtgctggcgctggtcgctatcacggcaagtgtggtgctcttcacatatggtcgggaggatgccgccagcactcgtgcgcgcgaaacagcggcgcggtttaccgctgcacttgaattagccatcgaccgcgccacgctcagtggtcagcctgtcggtatccatttctctgattcagcatggcgcattatggtaccgggcaaaacaccatcagcctggcgctgggttccattacaagaagatgccgcagacgagagcaaaaatgactggggtgaagaactctcaattcaacttcagccatttaaacctgatgacagcaaccaaccgcaggtggtgattctggccgacggacaaatcacgcccttctctttgttgatggctaatgccgggaccagtaagccgctcctgacgttagtcagttcaggctcatggcccctggatcaaacgctcgccagagatacccgcccatga

SEQ ID NO: 7790 - protein, 155 aa, Escherichia coli
MLALVAITASVVLFTYGREDAASTRARETAARFTAALELAIDRATLSGQPVGIHFSDSAWRIMVPGKTPSAWRWVPLQEDAADESKNDWGEELSIQLQPFKPDDSNQPQVVILADGQITPFSLLMANAGTSKPLLTLVSSGSWPLDQTLARDTRP

SEQ ID NO: 7791 - DNA, 435 bp, Escherichia coli
atggcccctggatcaaacgctcgccagagatacccgcccatgaacaaacaatcagggatgacactgcttgaagtcttactggcgatgagtattttcaccgctgttgcgctgactttaatgagcagtatgcaagggcaacgaactgccatcgagcggatgcgtaatgagacgctggcattgtggatagcggataaccagcttcagtcacaagattcattcgacgaggaaaacacgtccagttctggcaaagagttaataaatggcgaagagttaataaatggcgaagagtggaactggcgcagcgatatccactcaagcaaagacggcacgcttctggaacacaccataacggtgacattacccagcggtcagacaacctcgcttacgcgctatcaaagcatcaataataaatccgggcaggcacaagatgattaa

SEQ ID NO: 7792 - protein, 144 aa, Escherichia coli
MAPGSNARQRYPPMNKQSGMTLLEVLLAMSIFTAVALTLMSSMQGQRTAIERMRNETLALWIADNQLQSQDSFDEENTSSSGKELINGEELINGEEWNWRSDIHSSKDGTLLEHTITVTLPSGQTTSLTRYQSINNKSGQAQDD

SEQ ID NO: 7793 - DNA, 588 bp, Escherichia coli
atgattaatcgccagcagggtttcacattgctggaagtcatggcggcgctggcgattttctcaatgcttagcgtgctggcgtttatgattttttctcaagcttccgagttgcatcaacgttcacagaaagaaatccagcagttcaatcagctacagcgcaccatcaccattcttgataacgatctcctgcaactggtcgcccggcggaatcggagtacggataaaatcatggtgttgggtgaagaagcgatttttaccacgcaaagtcgcgatccgctggcccctctcagtgaagcacaaaccttactcactgttcactggtatctgcgaaatcatacgctctaccgtgctgttcgtacttctgtggatggcaggaaggatcaacccgcccaggcgatgctggaacatgtcgagagctttcttctggaaagtaacagcggagaaagccaggagcttcctctctcagtcacgttacatctgaagactcagcaatatggggcgttacagcgccgttttgcattacctgagcagttagcgagagaagagtcgccagctcagacgcaggccgggaataataaccatgaataa

SEQ ID NO: 7794 - protein, 195 aa, Escherichia coli
MINRQQGFTLLEVMAALAIFSMLSVLAFMIFSQASELHQRSQKEIQQFNQLQRTITILDNDLLQLVARRNRSTDKIMVLGEEAIFTTQSRDPLAPLSEAQTLLTVHWYLRNHTLYRAVRTSVDGRKDQPAQAMLEHVESFLLESNSGESQELPLSVTLHLKTQQYGALQRRFALPEQLAREESPAQTQAGNNNHE

SEQ ID NO: 7795 - DNA, 984 bp, Escherichia coli
atgaataatgaacaacgcggcgtagcactgctcattgtactcatgttactggcgctcatggctgctctggctgcagacatgacgatcagttttcacggccagcttcatcgaacccgccaggtaaaccatcatttgcaacggcaatatgatattgagctggcggagaaacttgcgcttgccagcctcacccaggacgttaaagataacgacagacaaaccacgttgcagcagtactgggcacaaccgcaacagttgcagctggaaaatggcaatacagtgaagtggcagttacgcgatgcccagcactgttttaatctcaatgccttagcaaaaatatctgacgccccgctggcttcccctgatttccccgcccaggtattcagtgccctgctgattaacgccggtatcgatcgcggaaacaccgatgagatcgtgcaatcaatcgctgactatattgatgccgatgattcgccacgctttcacggcgcagaagataacttttaccaaagccaaacgccgcctcgccatagcgccaatcaaatgctttttctgaccggtgaattgcgtcagataaaaggcataaccgaaaacatctatcagcggcttatcccgtatgtctgcgttctcccgacctcggaacttagcatcaatcttaatatgctaacggagaacgatattccgctcttcagagcattattcctcaataacatcacggatgctgacgctcgggtcttattacaaaaaaggcccagggaaggctggctcaccacagatgcatttctttactgggcgcagcaggatttctccggcgtgaagcccctggttgctcaggtgaaagggcatctctttccctatagccgctattttacgctgagtacggaaagtatcagcgacgaacaatcccagggatggcaaagccatatttttttcaaccgtaaacagcagagcgcccaaatctatcggcgtacgctgcaactctactaa

SEQ ID NO: 7796 - protein, 327 aa, Escherichia coli
MNNEQRGVALLIVLMLLALMAALAADMTISFHGQLHRTRQVNHHLQRQYDIELAEKLALASLTQDVKDNDRQTTLQQYWAQPQQLQLENGNTVKWQLRDAQHCFNLNALAKISDAPLASPDFPAQVFSALLINAGIDRGNTDEIVQSIADYIDADDSPRFHGAEDNFYQSQTPPRHSANQMLFLTGELRQIKGITENIYQRLIPYVCVLPTSELSINLNMLTENDIPLFRALFLNNITDADARVLLQKRPREGWLTTDAFLYWAQQDFSGVKPLVAQVKGHLFPYSRYFTLSTESISDEQSQGWQSHIFFNRKQQSAQIYRRTLQLY

SEQ ID NO: 7797 - DNA, 1167 bp, Escherichia coli
gtgatgcctgaatcgttgatggtaatacgttctttctcgacgctgcgtaagcattgggaatggatgacgttctccgcagatagcgtatcttcggtacatacgctcacagacgatcttccgctggagtcgctggccgatcagcccggtgccggaaatgttcaccttttgatcccacctgagggtcttttatatcgttccctcacgctgcccaacgccaaatacaaactcaccgcgcaaacattacagtggttggcggaggagacattacccgacgccagccaaaattggcactggatggttgtcgataaacaaaacgaaagtgtcgaggtgataggcattcagtcggagaaactcagtcgttatcttgagcgtttacatactgccggactcaacgtgacgcgggttttgccagatggctgctatcttccctgggaagtagatagctggactctggttaaccagcaaacaagctggcttattcgcagtgccgcacatgccttcaacgaactggatgaacactggttacagcatcttgctaaccagtttccgccagagaatatgcgttgttatggtgtagcgcctcacggcgttgcagcggccaatccacttatccagcatcctgaaataccatcactgagtttgtattctgccgatattgcattccagcgctatgacatgctgcatggtgtttttcgtaaacagaaaactgtaagcaaatcgggaaaatggctcgcccgcctggcagtaagctgtctcgttctcgccattctttcttttgttggcagccggggcatcgcgttctggcaaacgcttaagattgaagatcaacttcagcaacaacagcaagaaacctggcaacgttatttcccgcagatcaaacacacccacaactttcgtttttactttaagcagcaactcgctcagcaatatcctgaagctgtaccgttgctctatcatttacaaacacttctgcttgaacaccctgaactgcagttaatggaggcgaactatagccagaggcaaaagtcgctgaccttaaaaatgagtgctaagagtgaagccaatatcgatcgtttctgtgagttaacacagtcctggcttccgatggaaaaaacagaaaaagatccggtcagtggtgtatggacagtaaggaactcagggaaatga

SEQ ID NO: 7798 - protein, 388 aa, Escherichia coli
MMPESLMVIRSFSTLRKHWEWMTFSADSVSSVHTLTDDLPLESLADQPGAGNVHLLIPPEGLLYRSLTLPNAKYKLTAQTLQWLAEETLPDASQNWHWMVVDKQNESVEVIGIQSEKLSRYLERLHTAGLNVTRVLPDGCYLPWEVDSWTLVNQQTSWLIRSAAHAFNELDEHWLQHLANQFPPENMRCYGVAPHGVAAANPLIQHPEIPSLSLYSADIAFQRYDMLHGVFRKQKTVSKSGKWLARLAVSCLVLAILSFVGSRGIAFWQTLKIEDQLQQQQQETWQRYFPQIKHTHNFRFYFKQQLAQQYPEAVPLLYHLQTLLLEHPELQLMEANYSQRQKSLTLKMSAKSEANIDRFCELTQSWLPMEKTEKDPVSGVWTVRNSGK

SEQ ID NO: 7799 - DNA, 462 bp, Escherichia coli
atgattaaatcatggtgggcagaaaaatccacatcggaaaaacagatcgttgcggcattggcggttctctcgctcggcgttttttgttggcttgcggtgataaaaccgatagatacctacattgaagagcatcagtcccacgcgcaaaaaattaagaaggacatcaaatggatgcaggatcaagcgagcacccatggtttactcggtcatccagcgcttacgcagcccatcaaaaatatccttctcgaagaagcaaaacgtgagaatttgactatcacgctggaaaacggtccggacaatactctgacaattaaccctgtcacagctcccctcgaaaacgtctcccgctggctcactacggcacagataacatacggtattgttattgaagaccttcagtttactcttgccggaaacgaagagatcaccctcaagcatttgtccttcagggagcaacaataa

SEQ ID NO: 7800 - protein, 153 aa, Escherichia coli
MIKSWWAEKSTSEKQIVAALAVLSLGVFCWLAVIKPIDTYIEEHQSHAQKIKKDIKWMQDQASTHGLLGHPALTQPIKNILLEEAKRENLTITLENGPDNTLTINPVTAPLENVSRWLTTAQITYGIVIEDLQFTLAGNEEITLKHLSFREQQ

SEQ ID NO: 7801 - DNA, 678 bp, Escherichia coli
atgacaatgctactgccgctcttcattctggttggttttattgcaggttattttgttaatgtcatggcctatcacctctcgcctttggaggataaaacggcgttaacgtttcgccaggtattggttcatttctggcaaaaaaaatatgcctggcatgatacagtgcccctgatactttgcgttgctgctgctatcgcctgcgccctggcacctttcacgcccattgtgactggcgcactctttctctatttctgtttcgcactcacgctcagtgttattgattttcgcactcagctcctgcccgacaaactcaccttaccgctgctctggcttggcttggtatttaatgcgcagtctggattaattgatttacatgatgcggtttatggcgcggtcgctggctatggggtgctgtggtgtgtttactggggcgtctggttagtttgtcacaaagagggattgggctacggtgatttcaagctactggccgctgcaggcgcgtggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctgggatatctggcctggatctcttattaa

SEQ ID NO: 7802 - protein, 225 aa, Escherichia coli
MTMLLPLFILVGFIAGYFVNVMAYHLSPLEDKTALTFRQVLVHFWQKKYAWHDTVPLILCVAAAIACALAPFTPIVTGALFLYFCFALTLSVIDFRTQLLPDKLTLPLLWLGLVFNAQSGLIDLHDAVYGAVAGYGVLWCVYWGVWLVCHKEGLGYGDFKLLAAAGAWCGWQTLPMILLIASLGGIGYAIVSQLLQRRTITTIAFGPWLALGSMINLGYLAWISY

SEQ ID NO: 7803 - DNA, 477 bp, Escherichia coli
atgaaaggtgatactaaagttataaattatctcaacaaactgttgggaaatgagcttgtcgcaatcaatcagtactttcttcatgcccggatgtttaaaaactggggtctcaaacgtctcaatgatgtggagtatcatgaatccattgatgagatgaaacacgccgatcgttatattgagcgcattctttttctggaaggtcttccaaacttacaggacctgggcaaactgaacattggtgaagatgttgaggaaatgctgcgttctgatctggcacttgagctggatggcgcgaagaatttgcgtgaggcaattggttatgccgatagcgttcatgattacgtcagccgcgatatgatgatagaaattttgcgcgatgaagaaggccatatcgactggctggaaacggaacttgatctgattcagaagatgggactgcaaaattatctgcaagcacagattcgcgaagaaggttga

SEQ ID NO: 7804 - protein, 158 aa, Escherichia coli
MKGDTKVINYLNKLLGNELVAINQYFLHARMFKNWGLKRLNDVEYHESIDEMKHADRYIERILFLEGLPNLQDLGKLNIGEDVEEMLRSDLALELDGAKNLREAIGYADSVHDYVSRDMMIEILRDEEGHIDWLETELDLIQKMGLQNYLQAQIREEG

SEQ ID NO: 7805 - DNA, 195 bp, Escherichia coli
atgtacgtttgtctttgtaatggtatcagcgataaaaaaattcgtcaggctgtgcgtcagttttccccccactcgttccagcaattaaaaaaattcattccggtcggcaatcagtgcggtaaatgtgtccgggccgcgcgtgaagtgatggaggatgaattaatgcaactgccggagtttaaggagtccgcataa

SEQ ID NO: 7806 - protein, 64 aa, Escherichia coli
MYVCLCNGISDKKIRQAVRQFSPHSFQQLKKFIPVGNQCGKCVRAAREVMEDELMQLPEFKESA

SEQ ID NO: 7807 - DNA, 2703 bp, Escherichia coli
atgaaattaaatatatttactaaatctatgattggtatggggctggtgtgttccgctctgccagcattggcaatggaagcatggaataaccaacaaggtggtaataaatatcaggttattttcgatggcaaaatttatgaaaatgcctggtgggtttcttctacaaattgcccgggaaaagcgaaagcaaatgatgcaactaacccgtggcgtttaaagcgtaccgcaacagctgctgaaattagtcagtttggcaatacactttcctgcgaaaagagcggaagctcatcttcttcaacttcaaatacgccagcatctaatacgcccgctaatggcgcttcggctacaccagcacagggcactgttccgtctaattcttctgtagttgcctggaataaacagcagggcggtcaaacctggtatgtcgtctttaatggtgcggtatataaaaatgcttggtgggtagcctcttctaactgcccgggtgatgcgaaaggcaatgatgccagcaacccatggcgttatgttcgtgccgctacggcaacggaaatctcagaaaccagtaatccacagtcttgtacttcagcaccacagcctgcaccggatgtgaaaccggcaccggacgttaaaccggctcctgatgttcagccagccccagctgataagtcaaacgacaactatgctgtcgtagcctggaaaggtcaggaaggttcttctacatggtacgttatctacaacggcggcatttataagaacgcctggtgggtgggcgcggcaaattgcccaggcgatgcgaaagaaaacgatgccagcaacccatggcgttatgttcgcgcggcaacggcaacagaaatcactcagtatggtaacccagcctcctgttccgttaagccggataataatggcggtgctgtgactccggttgatccaactccggaaacaccggaaactccagttactccaactccggataacaacgagccatcaacaccagcggatagcagtaacgattactcactgcaggcgtggagtggccaggaaggcagcgaaatttaccatgttatcttcaatggtaatgtttatcagaatgcctggtgggttggttctgaagattgcccgcgtggcaccagtgtagaaaactccaataacccatggcgcctcgtgcgtacagctaccgctgcggaaatgagtcagtacggtaacccgactacctgtgaaattgataatggcggcgtcattattgcggatggtttccaggccagcaaagcgtacagcgcgaacagcatcgtagattataacgatgcacattataaaacctctgtcgatcaagacgcatggggctttgtccccggcggcgataacccgtggaagaaatacgaaccggcgaaagcatggtccgcttccaccgtgtacgtgaaaggtgatcgcgttgttgttgatgggcaggcttatgaagcgctgttctggacgcaaagtgacaaccctgctctgattgcgaaccaaaacgccaccggtagcaatagtcgcccgtggaagccgttaggtaagactcagagctatagcaacgaagagctgaataatgcgccgcagtttaatccagaaacgctttatgccagtgatacgctgattcgctttaacggtgagaactacatttctcagagtaaagtgcagaaagtttctccttctgacagcaacccgtggcgtgtttttgttgactggaccggaaccaaagagcgcgtaggtacgccgaagaaagcgtggccgaaacacgtttatgcaccgtatgtcgactttacgctgaatacgatcccggatttggctgcgctggctaagagtcataacgtcaaccacttcacgctggcgtttgtggtgagtaaagatgcgaacacctgtctaccgacatggggtaccgcttacggtatgcagaattacgctcagtacagcaaaatcaaagctctgcgtgaggctggcggtgatgtgatgctgtctatcggtggtgctaataatgccccgctggcagcttcctgtaagaacgttgacgatctaatgcagcattattatgacatcgttgataacctgaacctcagagtcctggacttcgatatcgaaggcacctgggttgcggatcaggcatctattgaacgtcgtaaccttgctgtgaagaaagtgcaggataaatggaagtcagaaggcaaagatattgctatctggtataccttgccaattctgccgacaggcctgacgccggaagggatgaatgtcctgagcgatgccaaagcgaaaggtgttgagctggcgggtgtgaacgtgatgacaatggactacggtaacgcgatttgtcagtctgcaaataccgaaggccagaacattcacggtaagtgtgcaacgtctgcgattgccaacctgcattcacaattgaaaggcctccatcccaacaagagcgatgcagaaattgacgctatgatgggtaccacgccgatggttggcgtgaacgacgttcagggcgaggtgttctatctctctgatgctcgtctggtcatgcaggatgcgcagaagcgtaatctcggtatggttggtatctggtcaatcgcgcgcgacctgccaggcggcactaacctgtctccggaattccacggcctgactaaagaacaggcaccgaagtacgcatttagcgaaatcttcgcgccgtttactaagcaataa

SEQ ID NO: 7808 - protein, 900 aa, Escherichia coli
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSTSNTPASNTPANGASATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPASCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKSHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 7809 - DNA, 1185 bp, Escherichia coli
gtgtctaaagaaaaatttgaacgtacaaaaccgcacgttaacgttggtactatcggccacgttgaccacggtaaaactactctgaccgctgcaatcaccaccgtactggctaaaacctacggcggtgctgctcgtgcattcgaccagatcgataacgcgccggaagaaaaagctcgtggtatcaccatcaacacttctcacgttgaatacgacaccccgacccgtcactacgcgcacgtagactgcccggggcacgccgactatgttaaaaacatgatcaccggtgctgctcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcctacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgcggtatcaaacgtgaagaaatcgaacgtggtcaggtactggctaagccgggcaccatcaagccgcacaccaagttcgaatctgaagtgtacattctgtccaaagatgaaggcggtcgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgatggtctgcgtttcgcaatccgtgaaggcggccgtaccgttggcgcgggcgttgttgctaaagttctgggctaa

SEQ ID NO: 7810 - protein, 394 aa, Escherichia coli [sequence omitted]

SEQ ID NO: 7811 - DNA, 2115 bp, Escherichia coli
atggctcgtacaacacccatcgcacgctaccgtaacatcggtatcagtgcgcacatcgacgccggtaaaaccactactaccgaacgtattctgttctacaccggtgtaaaccataaaatcggtgaagttcatgacggcgctgcaaccatggactggatggagcaggagcaggaacgtggtattaccatcacttccgctgcgactactgcattctggtctggtatggctaagcagtatgagccgcatcgcatcaacatcatcgacaccccggggcacgttgacttcacaatcgaagtagaacgttccatgcgtgttctcgatggtgcggtaatggtttactgcgcagttggtggtgttcagccgcagtctgaaaccgtatggcgtcaggcaaacaaatataaagttccgcgtattgcgttcgttaacaaaatggaccgcatgggtgcgaacttcctgaaagttgttaaccagatcaaaacccgtctgggcgcgaacccggttccgctgcagctggcgattggtgctgaagaacatttcaccggtgttgttgacctggtgaaaatgaaagctatcaactggaacgacgctgaccagggcgtaaccttcgaatacgaagatatcccggcagacatggttgaactggctaacgaatggcaccagaacctgatcgaatccgcagctgaagcttctgaagagctgatggaaaaatacctgggtggtgaagaactgactgaagcagaaatcaaaggtgctctgcgtcagcgcgttctgaacaacgaaatcatcctggtaacctgtggttctgcgttcaagaacaaaggtgttcaggcgatgctggatgcggtaattgattacctgccatccccggttgacgtacctgcgatcaacggtatcctggacgacggtaaagacactccggctgagcgtcacgcaagtgatgacgagccgttctctgcactggcgttcaaaatcgctaccgacccgtttgttggtaacctgaccttcttccgtgtgtactccggtgtggttaactctggtgataccgtactgaactccgtgaaagctgcacgtgagcgtttcggtcgtatcgttcagatgcacgctaacaaacgtgaagagatcaaagaagttcgcgcgggcgacatcgcagctgcaatcggtctgaaagacgtaaccactggtgacaccctgtgtgacccggatgcgccgatcattctggaacgtatggaattccctgagccggtaatctccatcgcagttgaaccgaaaaccaaagctgaccaggaaaaaatgggtctggctctgggccgtctggctaaagaagacccgtctttccgtgtatggactgacgaagaatctaaccagaccatcatcgcgggtatgggcgaactgcacctcgacatcatcgttgaccgtatgaagcgtgaattcaacgttgaagcgaacgtaggtaaaccgcaggttgcttaccgtgaaactatccgccagaaagttaccgatgttgaaggtaaacacgcgaaacagtctggtggtcgtggtcagtatggtcatgttgttatcgacatgtacccgctggagccgggttcaaacccgaaaggctacgagttcatcaacgacattaaaggtggtgtaatccctggcgaatacatcccggccgttgataaaggtatccaggaacagctgaaagcaggtccgctggcaggctacccggtagtagacatgggtattcgtctgcacttcggttcttaccatgacgttgactcctctgaactggcgtttaaactggctgcttctatcgcctttaaagaaggctttaagaaagctaaaccagttctgcttgagccgatcatgaaggttgaagtagaaactcctgaagagaacaccggtgacgttatcggtgacttgagccgtcgtcgtggtatgctcaaaggtcaggaatctgaagttactggcgttaagatccacgctgaagtaccgctgtctgaaatgttcggatatgcaactcagctgcgttctctgaccaaaggtcgcgcatcatacactatggaattcctgaagtatgatgaagcgccgagtaacgttgctcaggccgtaattgaagcccgtggtaaataa

SEQ ID NO: 7812 - protein, 704 aa, Escherichia coli
MARTTPIARYRNIGISAHIDAGKTTTTERILFYTGVNHKIGEVHDGAATMDWMEQEQERGITITSAATTAFWSGMAKQYEPHRINIIDTPGHVDFTIEVERSMRVLDGAVMVYCAVGGVQPQSETVWRQANKYKVPRIAFVNKMDRMGANFLKVVNQIKTRLGANPVPLQLAIGAEEHFTGVVDLVKMKAINWNDADQGVTFEYEDIPADMVELANEWHQNLIESAAEASEELMEKYLGGEELTEAEIKGALRQRVLNNEIILVTCGSAFKNKGVQAMLDAVIDYLPSPVDVPAINGILDDGKDTPAERHASDDEPFSALAFKIATDPFVGNLTFFRVYSGVVNSGDTVLNSVKAARERFGRIVQMHANKREEIKEVRAGDIAAAIGLKDVTTGDTLCDPDAPIILERMEFPEPVISIAVEPKTKADQEKMGLALGRLAKEDPSFRVWTDEESNQTIIAGMGELHLDIIVDRMKREFNVEANVGKPQVAYRETIRQKVTDVEGKHAKQSGGRGQYGHVVIDMYPLEPGSNPKGYEFINDIKGGVIPGEYIPAVDKGIQEQLKAGPLAGYPVVDMGIRLHFGSYHDVDSSELAFKLAASIAFKEGFKKAKPVLLEPIMKVEVETPEENTGDVIGDLSRRRGMLKGQESEVTGVKIHAEVPLSEMFGYATQLRSLTKGRASYTMEFLKYDEAPSNVAQAVIEARGK

SEQ ID NO: 7813 - DNA, 471 bp, Escherichia coli
atgccacgtcgtcgcgtcattggtcagcgtaaaattctgccggatccgaagttcggatcagaactgctggctaaatttgtaaatatcctgatggtagatggtaaaaaatctactgctgaatctatcgtatacagcgcgctggagaccctggctcagcgctctggtaaatctgaactggaagcattcgaagtagctctcgaaaacgtgcgcccgactgtagaagttaagtctcgccgcgttggtggttctacttatcaggtaccagttgaagtccgtccggttcgtcgtaatgctctggcaatgcgttggatcgttgaagctgctcgtaaacgcggtgataaatccatggctctgcgcctggcgaacgaactttctgatgctgcagaaaacaaaggtactgcagttaagaaacgtgaagacgttcaccgtatggccgaagccaacaaggcgttcgcacactaccgttggtaa

SEQ ID NO: 7814 - protein, 156 aa, Escherichia coli
MPRRRVIGQRKILPDPKFGSELLAKFVNILMVDGKKSTAESIVYSALETLAQRSGKSELEAFEVALENVRPTVEVKSRRVGGSTYQVPVEVRPVRRNALAMRWIVEAARKRGDKSMALRLANELSDAAENKGTAVKKREDVHRMAEANKAFAHYRW

SEQ ID NO: 7815 - DNA, 375 bp, Escherichia coli
atggcaacagttaaccagctggtacgcaaaccacgtgctcgcaaagttgcgaaaagcaacgtgcctgcgctggaagcatgcccgcaaaaacgtggcgtatgtactcgtgtatatactaccactcctaaaaaaccgaactccgcgctgcgtaaagtatgccgtgttcgtctgactaacggtttcgaagtgacttcctacatcggtggtgaaggtcacaacctgcaggagcactccgtgatcctgatccgtggtggtcgtgttaaagacctcccgggtgttcgttaccacaccgtacgtggtgcgcttgactgctccggcgttaaagaccgtaagcaggctcgttccaagtatggcgtgaagcgtcctaaggcttaa

SEQ ID NO: 7816 - protein, 124 aa, Escherichia coli
MATVNQLVRKPRARKVAKSNVPALEACPQKRGVCTRVYTTTPKKPNSALRKVCRVRLTNGFEVTSYIGGEGHNLQEHSVILIRGGRVKDLPGVRYHTVRGALDCSGVKDRKQARSKYGVKRPKA

SEQ ID NO: 7817 - DNA, 288 bp, Escherichia coli
atgctgcacacattacatcgttcaccctggctgacggactttgctgcgctgctgcgtctgctcagtgaaggtgacgaactgctattattgcaagatggcgtaactgccgcagttgacggcaaccgctaccttgaaagtctgcgtaatgcccccattaaggtctatgctctgaacgaagaccttattgcccgcggtttgactggtcgaatttcgaacgacatcattcccattgactatactgatttcgtcagacttacggttaagcactccagccagatggcctggtga

SEQ ID NO: 7818 - protein, 95 aa, Escherichia coli
MLHTLHRSPWLTDFAALLRLLSEGDELLLLQDGVTAAVDGNRYLESLRNAPIKVYALNEDLIARGLTGRISNDIIPIDYTDFVRLTVKHSSQMAW

SEQ ID NO: 7819 - DNA, 360 bp, Escherichia coli
atgaaacgaattgcgtttgttttttctactgtgcctcatggcaccgcggctggccgcgagggattagatgctttactcgcaacttccgcattaactgacgatctggccgtcttctttattgctgatggcgtttttcagctgctgccaggacaaaagcccgatgcagtgctggcgcgtgattacattgccacttttaaattgttgggtctgtatgacattgaacagtgctgggtttgtgcggcttcactgcgcgaacgcgggttagatccgcagacaccttttgtggtcgaagccacgccgctcgaagcagatgccttacgccgcgaactcgccaactacgatgttattttgaggttttga

SEQ ID NO: 7820 - protein, 119 aa, Escherichia coli
MKRIAFVFSTVPHGTAAGREGLDALLATSALTDDLAVFFIADGVFQLLPGQKPDAVLARDYIATFKLLGLYDIEQCWVCAASLRERGLDPQTPFVVEATPLEADALRRELANYDVILRF

SEQ ID NO: 7821 - DNA, 387 bp, Escherichia coli
atgcgttttgccatcgtggtgaccgggccagcatacggtacgcaacaggcgagtagtgcttttcagtttgcgcaggcgctaatagcagaaggccatgagttaagcagcgtttttttctatcgggaaggggtctataacgctaaccaattgacctcaccggcaagcgacgaatttgaccttgtgcgcagctggcaacagttgaatatgcaacatggtgtggcgctgaatatctgcgtagcggcggcattacgccgtggcgttgttgatgaaacggaagccggaagactggggctggcttcgtcaaaccttcagacgggatttaccttaagcggacttggcgcgctggcggaagcctcgctgacctgtgacagggtggtacagttctga

SEQ ID NO: 7822 - protein, 128 aa, Escherichia coli
MRFAIVVTGPAYGTQQASSAFQFAQALIAEGHELSSVFFYREGVYNANQLTSPASDEFDLVRSWQQLNMQHGVALNICVAAALRRGVVDETEAGRLGLASSNLQTGFTLSGLGALAEASLTCDRVVQF

SEQ ID NO: 7823 - DNA, 723 bp, Escherichia coli
atgtccaggtcgcttttaaccaacgaaaccagtgagttggatttactggatcaacgtccttttgaccagaccgattttgatattctgaaatcctacgaagcggtggtggacgggttagcgatgcttattggctcccactgtgaaatcgttttgcactctttgcaggatctaaaatgttcagccattcgcattgctaacggtgaacatacaggccggaagattggttcgccaattactgacctggcgctacgtatgctgcacgatatgacgggagcggatagcagcgtttctaaatgctactttactcgcgccaaaagcggcgtattaatgaagtccctgactatcgcgattcgtaaccgcgaacagcgtgtaattggtctgctgtgcatcaatatgaatcttgatgttcccttctcgcagattatgagcacttttgtgccgccggaaactccggatgtcggttcaagcgtcaactttgcctcttctgttgaagatctggttacccaaacgctggagtttaccatcgaagaagtgaatgccgatcgcaatgtttctaataacgccaaaaatcgtcagatcgtgctaaatctctacgagaaagggatcttcgatattaaagacgcgatcaaccaggttgctgaccgcctgaacatctccaaacacactgtctatctctacatccgccagttcaagagcggtgatttccaggggcaagataagtaa

SEQ ID NO: 7824 - protein, 240 aa, Escherichia coli
MSRSLLTNETSELDLLDQRPFDQTDFDILKSYEAVVDGLAMLIGSHCEIVLHSLQDLKCSAIRIANGEHTGRKIGSPITDLALRMLHDMTGADSSVSKCYFTRAKSGVLMKSLTIAIRNREQRVIGLLCINMNLDVPFSQIMSTFVPPETPDVGSSVNFASSVEDLVTQTLEFTIEEVNADRNVSNNAKNRQIVLNLYEKGIFDIKDAINQVADRLNISKHTVYLYIRQFKSGDFQGQDK

SEQ ID NO: 7825 - DNA, 813 bp, Escherichia coli
atgaaatcactgtttaaagtaacgctgctggcgaccacaatggccgttgccctgcatgcaccaatcacttttgctgctgaagctgcaaaacctgctacaactgctgacagcaaagcagcgttcaaaaatgacgatcagaaatcagcttatgcactgggtgcttcgctgggtcgttacatggaaaactctcttaaagaacaagaaaaactgggcatcaaactggataaagatcagctgatcgctggtgttcaggatgcatttgctgataagagcaaactttccgaccaagagatcgaacagactctgcaagcattcgaagctcgtgtgaagtcttctgctcaggcgaagatggaaaaagacgcggctgataacgaagcaaaaggtaaagagtaccgcgagaaatttgccaaagagaaaggtgtgaaaacctcttccactggtctggtttatcaggtagtagaagccggtaaaggcgaagccccgaaagacagcgatactgttgtagtgaactacaaaggtacgctgatcgacggtaaagagttcgacaactcttacacccgtggtgaaccgctctctttccgtctggacggtgttatcccgggttggacagaaggtctgaagaacatcaagaaaggcggtaagatcaaactggttattccaccagaactggcttacggcaaagcgggtgttccggggatcccaccgaattctaccctggtgtttgacgtagagctgctggatgtgaaaccagcgccgaaggctgatgcaaagccggaagctgatgcgaaagccgcagactctgctaaaaaataa

SEQ ID NO: 7826 - protein, 270 aa, Escherichia coli
MKSLFKVTLLATTMAVALHAPITFAAEAAKPATTADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 7827 - DNA, 219 bp, Escherichia coli
atgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagttaaaagccagccagccgtcgaacatcgcgtcgcaggctgaagaaacgcctccgccacattattaa

SEQ ID NO: 7828 - protein, 72 aa, Escherichia coli
MQDLSLEARLAELESRLAFQEITIEELNVTVTAHEMEMAKLRDHLRLLTEKLKASQPSNIASQAEETPPPHY

SEQ ID NO: 7829 - DNA, 591 bp, Escherichia coli
atgaaagtagcaaaagacctggtggtcagcctggcctatcaggtacgtacagaagacggtgtgttggttgatgagtctccggtgagtgcgccgctggactacctgcatggtcacggttccctgatctctggcctggaaacagcgctggaaggtcatgaagttggcgacaaatttgatgtcgctgttggcgcgaacgacgcttacggtcagtacgacgaaaacctggtgcagcgcgttcctaaagacgtatttatgggcgttgatgaactgcaggtaggtatgcgtttcctggctgaaaccgaccagggtccggtaccggttgaaatcactgcggttgaagacgatcacgtagtggttgatggtaaccacatgctggctggtcagaacctgaaattcaacgttgaagttgtggcgattcgcgaagcgaccgaagaagaactggctcatggtcacgttcacggcgcgcacgatcaccaccacgatcacgaccacgacggttgctgcggtggtcatggccacgatcacggtcatgaacacggtggcgaaggctgctgtggcggtaaaggcaacggcggttgcggttgccactaa

SEQ ID NO: 7830 - protein, 196 aa, Escherichia coli
MKVAKDLVVSLAYQVRTEDGVLVDESPVSAPLDYLHGHGSLISGLETALEGHEVGDKFDVAVGANDAYGQYDENLVQRVPKDVFMGVDELQVGMRFLAETDQGPVPVEITAVEDDHVVVDGNHMLAGQNLKFNVEVVAIREATEEELAHGHVHGAHDHHHDHDHDGCCGGHGHDHGHEHGGEGCCGGKGNGGCGCH

SEQ ID NO: 7831 - DNA, 201 bp, Escherichia coli
atggcaatccgaaaacgttttattgcgggcgcaaaatgcccggcctgtcaggcacaggattcaatggcgatgtggcgcgaaaataatattgatatcgtagaatgtgttaagtgtggacatcagatgcgagaagcagacaaagaagcccgcgatcacgtccgcaaagatgagcaagtgatcgggatttttcatccggactag

SEQ ID NO: 7832 - protein, 66 aa, Escherichia coli
MAIRKRFIAGAKCPACQAQDSMAMWRENNIDIVECVKCGHQMREADKEARDHVRKDEQVIGIFHPD

SEQ ID NO: 7833 - DNA, 1806 bp, Escherichia coli
atggaaggttctgattttttactcgcaggagtgctgtttctcttcgcggcggtggctgcggtgccgctggcatcgcggctgggtattggtgcagtgttgggatatttgctggcggggattgcgattggcccgtgggggctggggtttattagcgacgtcgatgagatcctccacttttcggaactcggcgtggtattcctgatgtttatcatcggccttgagttgaatccctccaagctttggcaactgcggcgttcgatttttggcgtaggcgcggcacaggtgctgttaagcgcggcgttgctggcaggattattgatgctgacccatttctcatggcaggcggcggtggtcggtggcattggccttgcgatgtcttcaactgcaatggcgttgcaattgatgcgtgagaaagggatgaatcgcagcgaatccggccagttaggtttctcggtactgctgtttcaggatctggcggtgatcccggcactggcgttagtgccgttgttggcgggttcggcagacgaacatttcgactggatgaagatcggcatgaaggtgctggcgtttgtcggcatgctgattggcgggcgctatttactgcgtccggtattccgttttattgcagcttctggtgtgcgggaagtgttcaccgccgcgacgctgctgctggtgttgggttccgcattgtttatggatgcgctggggttgtcgatggcgctcggtacgtttattgcgggtgtgctactggcggaaagtgaatatcgccatgaactggaaacggctatcgatcccttcaaaggcttgctgcttggtttgttctttatctctgtcggcatgtcgctcaacctcggggtgctttatacccatctgttgtgggtagtgataagtgtggttgtgctggtggcggtgaaaattctcgtgctgtatctgctggcgcgattgtatggcgtgcgcagttctgagcggatgcagtttgctggcgtgttgagtcagggcggtgagtttgcctttgtcctcttttctaccgcttcttcacaacgcttattccagggcgaccagatggcgctgttgctggtgacggtgacgctttccatgatgaccacgccgctgctgatgaagctggtcgataaatggctatcccgccagtttaacggaccggaagaagaagacgaaaaaccatgggtcaacgatgataaaccgcaggtcattgtcgtgggctttgggcgttttggtcaggtgattggtcgtttgctgatggcaaataaaatgcgcattactgtactggagcgggatatcagtgccgttaacctgatgcgcaaatatggctacaaagtttattacggcgacgccacgcaggtagatcttttacgttctgcgggtgcagaggccgctgagtctatcgtcattacctgtaacgagccggaagacactatgaagctggtggaaatatgccagcagcactttccgcatttgcatattcttgcgcgagcgcgcggacgtgtggaagcgcatgagttattacaggcaggggtgacgcagttttcccgtgaaacattctccagtgcgttagagctggggcgcaagacgctggtcacgcttggcatgcatccgcatcaggcgcagcgcgcgcaactgcattttcgccgcctggatatgcgaatgctgcgggagttaatcccgatgcatgctgataccgtacaaatttctcgcgccagggaagcccgacgtgaactggaagagattttccagcgtgaaatgcaacaagaacgacgccagctggacggctgggatgaatttgagtag

SEQ ID NO: 7834 - protein, 601 aa, Escherichia coli
MEGSDFLLAGVLFLFAAVAAVPLASRLGIGAVLGYLLAGIAIGPWGLGFISDVDEILHFSELGVVFLMFIIGLELNPSKLWQLRRSIFGVGAAQVLLSAALLAGLLMLTHFSWQAAVVGGIGLAMSSTAMALQLMREKGMNRSESGQLGFSVLLFQDLAVIPALALVPLLAGSADEHFDWMKIGMKVLAFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMALLLVTVTLSMMTTPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 7835 - DNA, 552 bp, Escherichia coli
atgtctcagccagcgaaagttttgctgctgtatgcccatccggaatctcaggactcggtggcaaaccgggttctgcttaaaccggccacgcagctcagcaatgttaccgtgcacgacctttacgcgcactatcccgacttttttattgatatccctcgtgagcaggcattactgcgcgagcacgaggtgattgtctttcagcatcctctttatacctatagctgcccggcgctactgaaagagtggctggaccgggtattaagccgtggttttgccagcggaccggggggaaaccaactggcgggaaagtactggcgtagcgtgattaccaccggggagccggaaagtgcttaccgttatgacgcgttgaatcgctatccgatgagcgatgttctgcgcccctttgaactggcggcgggcatgtgccggatgcattggttaagccccatcattatttactgggcgagacggcaaagcgcacaggagctggcgagccacgccagagcctacggtgactggctggcaaatccgctgtctccaggaggctgctga

SEQ ID NO: 7836 - protein, 183 aa, Escherichia coli
MSQPAKVLLLYAHPESQDSVANRVLLKPATQLSNVTVHDLYAHYPDFFIDIPREQALLREHEVIVFQHPLYTYSCPALLKEWLDRVLSRGFASGPGGNQLAGKYWRSVITTGEPESAYRYDALNRYPMSDVLRPFELAAGMCRMHWLSPIIIYWARRQSAQELASHARAYGDWLANPLSPGGC

SEQ ID NO: 7837 - DNA, 1914 bp, Escherichia coli
atgattgttttttcctcgttacaaattcgtcgcggcgtgcgcatcctgctggataatgccaccgccaccatcaaccctgggcagaaagtcggcctggtgggtaaaaacggctgtggtaaatctactctgctggcattgctgaaaaatgaaatcagcgccgacggcggcagctacacctttccggtaagctggcaactggcgtgggtgaatcaggaaacaccggcgttaccgcaagcggcgctggaatatgtcattgacggcgaccgtgaatatcgtcaactggaagcgcagctacacgacgccaacgaacgtaacgacgggcacgccattgcgaccattcatggcaagctggatgctattgacgcatggagtattcgctcccgtgccgccagcctgctgcacggcctcggtttcagcaatgaacaactggagcgcccggtaagtgatttctccggtggctggcgtatgcgtcttaaccttgcccaggcgctgatttgccgttcagacttgctgctgctcgacgaaccgactaaccacctcgatctcgatgccgttatctggctggaaaaatggctgaagagctatcagggcacgctgatcctgatctctcacgatcgcgatttcctcgatccgatcgttgataaaattattcatatcgaacaacaaagcatgttcgagtacaccggcaactacagttcgtttgaagtacagcgcgccacccgtctggcgcagcaacaagcgatgtatgaaagccagcaggaacgcgtagcgcatctgcaaagttatatcgaccgtttccgtgccaaagccaccaaagcgaagcaggcccagagccgcattaagatgcttgagcgtatggagctgattgcccccgcgcacgtcgacaacccgttccgctttagcttccgcgcgccggaaagcctgccaaatccgttactgaagatggcaaaagtcagcgcaggctatggcgatcgcattattctcgactcgattaaactgaatctggtccccggctcgcgcattggtctgctaggccgcaacggcgcgggtaaatcgacattaatcaaactgttagccggcgaacttgcgccagtcagcggtgaaattggtctggcgaaagggatcaagctcggctacttcgcccagcatcaactggaatacctgcgcgccgacgaatcgcctattcaacatctggcacgtttagcgccgcaggagctggagcaaaaactgcgtgactacctcggcggctttggtttccagggcgataaagtaaccgaagaaacgcgccgcttctccggtggggaaaaagcccgcctggtgctggcattaattgtctggcagcgtccgaatctgctgctgctcgacgaaccgaccaaccaccttgacctcgacatgcgtcaggcactcaccgaagcattaatcgagttcgaaggcgcgctggttgtcgtctcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaacgcgaacagcgcccaggcacgtaaagatcagaagcgtcgggaagcggagctgcgtgcgcaaacccagccactgcgtaaagagattgcccgtctggaaaaagagatggagaagctgaacgcgcaactggcgcaggcggaagagaaactcggcgacagcgaactgtacgatcaaagccgtaaagcggagttgaccgcctgcctgcaacagcaagccagcgccaaatccggcctggaagagtgcgaaatggcatggctggaagcccaggagcagcttgagcagatgctgctggaaggccaaagcaactga

SEQ ID NO: 7838 - protein, 637 aa, Escherichia coli
MIVFSSLQIRRGVRILLDNATATINPGQKVGLVGKNGCGKSTLLALLKNEISADGGSYTFPVSWQLAWVNQETPALPQAALEYVIDGDREYRQLEAQLHDANERNDGHAIATIHGKLDAIDAWSIRSRAASLLHGLGFSNEQLERPVSDFSGGWRMRLNLAQALICRSDLLLLDEPTNHLDLDAVIWLEKWLKSYQGTLILISHDRDFLDPIVDKIIHIEQQSMFEYTGNYSSFEVQRATRLAQQQAMYESQQERVAHLQSYIDRFRAKATKAKQAQSRIKMLERMELIAPAHVDNPFRFSFRAPESLPNPLLKMAKVSAGYGDRIILDSIKLNLVPGSRIGLLGRNGAGKSTLIKLLAGELAPVSGEIGLAKGIKLGYFAQHQLEYLRADESPIQHLARLAPQELEQKLRDYLGGFGFQGDKVTEETRRFSGGEKARLVLALIVWQRPNLLLLDEPTNHLDLDMRQALTEALIEFEGALVVVSHDRHLLRSTTDDLYLVHDRKVEPFDGDLEDYQQWLSDVQKQENQTDEAPKENANSAQARKDQKRREAELRAQTQPLRKEIARLEKEMEKLNAQLAQAEEKLGDSELYDQSRKAELTACLQQQASAKSGLEECEMAWLEAQEQLEQMLLEGQSN

SEQ ID NO: 7839 - DNA, 1023 bp, Escherichia coli
atggcgcagataacaacgaccgatgccaatgaatttagcagcagtgctaaattcacccctatgcgcggctttagcaattgtcatctacaaaccatgctgccgcgtctgttccgtcgcaaggtgaaattcaccccgtactggcagcggctggagttgcccgacggcgattttgtcgatctcgcgtggagtgaagatcctgcacaggcgcggcataaaccgcgtttagtggtatttcacgggctggaaggcagtctcaatagcccttacgctcacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgagtttggtcatgcgccaacggctgccgtcggctattcgctcggcggtaatatgctggcctgtttgctggcaaaagaaggcaatgatctcccgattgatgcggcagtgattgtctctgcgccgtttatgctggaggcctgtagttaccatatggaaaagggcttttcccgcatttatcagcgttacttgctgaacctgttaaaagccaatgccgcgcgcaagctggcagcctaccccggaacactgccgattaatctcacgcagttaaaatcggtacgtcgcatccgtgaatttgacgatctcatcaccgccagaattcacggctacgctgacgctatcgactattatcgtcagtgtagcgccatgccgatgctcaatcggatagccaaaccgacactgattattcacgccaaagacgatccgtttatggatcatcaggtgatcccgaaaccggaaagtctccccccgcaggtggagtatcagctgactgaacatggcggtcatgttggctttattggcggtacattacttcatccgcaaatgtggctggagtcacgcattcctgactggttaacaacgtatctggaggcgaaatcatgttga

SEQ ID NO: 7840 - protein, 340 aa, Escherichia coli
MAQITTTDANEFSSSAKFTPMRGFSNCHLQTMLPRLFRRKVKFTPYWQRLELPDGDFVDLAWSEDPAQARHKPRLVVFHGLEGSLNSPYAHGLVEAAQKRGWLGVVMHFRGCSGEPNRMHRIYHSGETEDASWFLRWLQREFGHAPTAAVGYSLGGNMLACLLAKEGNDLPIDAAVIVSAPFMLEACSYHMEKGFSRIYQRYLLNLLKANAARKLAAYPGTLPINLTQLKSVRRIREFDDLITARIHGYADAIDYYRQCSAMPMLNRIAKPTLIIHAKDDPFMDHQVIPKPESLPPQVEYQLTEHGGHVGFIGGTLLHPQMWLESRIPDWLTTYLEAKSC

SEQ ID NO: 7841 - DNA, 219 bp, Escherichia coli
atgttgattccgtggcaagacctctcccccgaaacgctggaaaatttaattgaaagctttgtgttacgtgaaggcaccgattatggtgaacatgagcgtacacttgaacagaaagtctccgacgtcaaacgccagctacagtgcggagaagcggtgctggtatggtcggagctgcacgaaacggtcaatatcatgccgcgcagtcagtttcgcgaataa

SEQ ID NO: 7842 - protein, 72 aa, Escherichia coli
MLIPWQDLSPETLENLIESFVLREGTDYGEHERTLEQKVSDVKRQLQCGEAVLVWSELHETVNIMPRSQFRE

SEQ ID NO: 7843 - DNA, 870 bp, Escherichia coli
atgtctgccaaacatccggtcattgcggtaacaggatccagcggcgcggggaccaccaccaccagcctcgcgtttcgtaaaatattcgcgcagttaaatctgcatgcagccgaggtggaaggcgacagttttcaccgttatacccgcccggaaatggacatggcgatccgcaaagcgcgcgacgccgggcggcatatcagctacttcggccccgaagcgaacgacttcggccttctggaacaaaccttcattgaatacggtcagagtggcaaagggaaatctcgcaaatatctgcatacctacgatgaagccgtaccgtggaatcaggtaccggggacattcaccccctggcaatctttaccggaacccactgatgtactgttttatgaaggtttacacggcggcgtagtcacgccacagcataacgttgcgcagcatgtggacttactggtcggcgtggtgcctatcgttaaccttgagtggattcaaaaactgatccgcgacaccagcgagcgcgggcactcacgagaagcagtgatggactcggtagtgcgttcaatggaagactatatcaactacatcacaccgcagttttcccgcacccatcttaacttccagcgcgttcccaccgtcgacacctcaaacccgttcgcggcaaaaggtatcccgtcgctggatgaaagctttgtggtgatccattttcgtaatctggaagggatcgatttcccctggctgctggcgatgttgcaaggctcattcatttcccacatcaatacgttagtggtgcctggcggcaaaatgggtctggcaatggaattaattatgctgccgctggtgcaacgattgatggaaggaaagaaaatcgagtaa

SEQ ID NO: 7844 - protein, 289 aa, Escherichia coli
MSAKHPVIAVTGSSGAGTTTTSLAFRKIFAQLNLHAAEVEGDSFHRYTRPEMDMAIRKARDAGRHISYFGPEANDFGLLEQTFIEYGQSGKGKSRKYLHTYDEAVPWNQVPGTFTPWQSLPEPTDVLFYEGLHGGVVTPQHNVAQHVDLLVGVVPIVNLEWIQKLIRDTSERGHSREAVMDSVVRSMEDYINYITPQFSRTHLNFQRVPTVDTSNPFAAKGIPSLDESFVVIHFRNLEGIDFPWLLAMLQGSFISHINTLVVPGGKMGLAMELIMLPLVQRLMEGKKIE

SEQ ID NO: 7845 - DNA, 405 bp, Escherichia coli
atgcaagcgcgagtgaagtgggtcgaagggttaacttttctgggcgaatccgcctctggtcaccagattttaatggacggcaactcaggcgataaagcaccaagcccgatggaaatggtgttgatggcagcgggtggttgcagtgccatcgatgtggtttctatcctgcaaaaagggcgtcaggatgtggtcgattgtgaagtaaaattgacctctgagcgccgcgaagaggcaccacgcctgtttacgcacattaatctgcattttatcgtcaccggtcgcgacctgaaagacgcagcggttgcgcgtgcagttgatctttctgccgagaaatattgttcagtggcgctgatgctggaaaaagcggtgaatattactcactcgtatgaagtggttgccgcgtga

SEQ ID NO: 7846 - protein, 134 aa, Escherichia coli
MQARVKWVEGLTFLGESASGHQILMDGNSGDKAPSPMEMVLMAAGGCSAIDVVSILQKGRQDVVDCEVKLTSERREEAPRLFTHINLHFIVTGRDLKDAAVARAVDLSAEKYCSVALMLEKAVNITHSYEVVAA

SEQ ID NO: 7847 - DNA, 633 bp, Escherichia coli
atggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtctgtctgcacagatggcgcgtcgtctgcaagtcacttcagagaaagtgggcaacctggcgttcctcgacgtgacgggccgcattgcacagactctgctgaatctggcaaaacaaccggatgctatgactcacccggacggtatgcaaatcaaaattacccgtcaggaaatcggtcagattgtcggctgttctcgtgaaaccgtgggacgcattctgaagatgctggaagatcagaacctgatctccgcacacggtaaaaccatcgtcgtttacggcactcgttaa

SEQ ID NO: 7848 - protein, 210 aa, Escherichia coli
MVLGKPQTDPTLEWFLSHCHIHKYPSKSTLIHQGEKAETLYYIVKGSVAVLIKDEEGKEMILSYLNQGDFIGELGLFEEGQERSAWVRAKTACEVAEISYKKFRQLIQVNPDILMRLSAQMARRLQVTSEKVGNLAFLDVTGRIAQTLLNLAKQPDAMTHPDGMQIKITRQEIGQIVGCSRETVGRILKMLEDQNLISAHGKTIVVYGTR

SEQ ID NO: 7849 - DNA, 2103 bp, Escherichia coli
ttgtttcccccgatgtggcgcagactgatttatcaccccgatatcaactatgcacttcgacaaacgctggtgctatgtttgcccgtggccgttgggttaatgcttggcgaattacgattcggcctgctcttctccctcgttcctgcctgttgcaatattgcgggccttgatacgcctcataaacgttttttcaaacgcttaatcattggtgcgtcgctgtttgccacctgtagcttgctgacacaggtgctactggcaaaagatgttcccctgccctttttgctgaccggattaacgctggtacttggcgtcactgctgaactggggccattgcacgcaaaattgcttcccgcatcgctgctcgctgccatttttaccctcagtctggcgggatacatgccggtctgggaaccgttgctcatctatgcgctgggcactttgtggtacggattgtttaactggttttggttctggatctggcgcgaacaaccgctacgcgagtcactaagtctgctgtaccgtgaactggcagattactgtgaagccaaatacagcctgcttacccagcacaccgaccctgataaagcgctgccgccgctgctggtgcgccagcaaaaagcggtcgatctaattacccagtgctatcagcaaatgcatatgctttccgcgcaaaataataccgattacaagcggatgctgcgtattttccaggaggcgctggatttgcaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccaacgcgttttacgatggaaaagcaaattggcgcactggaaaaaatcgcccgccaacacccggataatccggttgggcaattctgctactggcatttcagccgcattgctcgtgtgctgcgcacccaaaaaccgctctatgcccgtgacttactggccgataaacagcggcgaatgccattacttccggcgctgaaaagttatctgtcactaaagtctccagcgctacgcaatgccggacgactcagtgtgatgttaagcgttgccagcctgatgggcaccgcgcttcatctgccgaagtcgtactggatcctgatgacagtattgctggtgacgcaaaatggctatggcgcaacccgtctgaggattgtaaatcgctccgtgggaaccgtggtcgggttaatcattgcaggcgtgacgctacactttaaaattcccgaaggttacaccctgaccttgatgctgattaccaccctcgccagctacctgatattgcgcaaaaactacggctgggcgacggtcggttttactattaccgcagtgtataccctgcaactgttgtggctgaacggtgagcagtacatccttccgcgtcttatcgataccattattggttgtttaattgctttcggcggtactgtctggctgtggccgcagtggcagagcgggttattgcgtaagaacgcccatgacgctttagaagcctatcaggacgcgattcgcttgattctgagcgaggacccgcaacctacgccactggcctggcagcgaatgcgggtgaatcaggcgcataacactctgtataactcattgaatcaggcgatgcaggaaccggcgtttaacagccattatctggcagatatgaaactgtgggtaacgcacagccagttcattgttgagcatattaatgccatgaccacgctggcgcgggaacaccgggcattgccaccggaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacaacgggttattggtcatctgaacaccatgcacaccatttcgtcgatggcatggcggcagcgaccgcatcacgggatttggctgagtcgcaagttgcgggattcgaaggcgtaa

SEQ ID NO: 7850 - protein, 700 aa, Escherichia coli
MFPPMWRRLIYHPDINYALRQTLVLCLPVAVGLMLGELRFGLLFSLVPACCNIAGLDTPHKRFFKRLIIGASLFATCSLLTQVLLAKDVPLPFLLTGLTLVLGVTAELGPLHAKLLPASLLAAIFTLSLAGYMPVWEPLLIYALGTLWYGLFNWFWFWIWREQPLRESLSLLYRELADYCEAKYSLLTQHTDPDKALPPLLVRQQKAVDLITQCYQQMHMLSAQNNTDYKRMLRIFQEALDLQEHISVSLHQPEEVQKLVERSHAEEVIRWNAQTVAARLRVLADDILYHRLPTRFTMEKQIGALEKIARQHPDNPVGQFCYWHFSRIARVLRTQKPLYARDLLADKQRRMPLLPALKSYLSLKSPALRNAGRLSVMLSVASLMGTALHLPKSYWILMTVLLVTQNGYGATRLRIVNRSVGTVVGLIIAGVTLHFKIPEGYTLTLMLITTLASYLILRKNYGWATVGFTITAVYTLQLLWLNGEQYILPRLIDTIIGCLIAFGGTVWLWPQWQSGLLRKNAHDALEAYQDAIRLILSEDPQPTPLAWQRMRVNQAHNTLYNSLNQAMQEPAFNSHYLADMKLWVTHSQFIVEHINAMTTLAREHRALPPELAQEYLQSCEIAIQRCQQRLEYDEPGSSGDANIMDAPEMQPHEGAAGTLEQHLQRVIGHLNTMHTISSMAWRQRPHHGIWLSRKLRDSKA

SEQ ID NO: 7851 - DNA, 1221 bp, Escherichia coli
atggcaattgaacaaacagcaattacacgcgcgactttcgatgaagtgattctgccgatttatgctccggcagagtttattccggtaaaaggtcagggcagccgaatctgggatcaacagggcaaggagtatgtcgatttcgcgggtggcattgcagttacggcgttgggccattgccatcctgcgctggtgaacgcgttaaaaacccagggcgaaactctgtggcatattagtaacgttttcaccaatgagccggcgctgcgtcttggccgtaaactgattgaggcaacgtttgccgaacgcgtggtgtttatgaactccggcacggaagctaacgaaaccgcctttaaactggcacgccattacgcctgtgtgcgtcatagcccgttcaaaaccaaaattattgccttccataacgcttttcatggtcgctcgctgtttaccgtttcggtgggtgggcagccaaaatattccgacggctttgggccaaaaccggcagacatcatccacgtgccttttaacgatcttcacgcagtaaaagccgtgatggatgaccatacctgtgcggtggtggttgagccgattcagggcgagggcggcgtgacggcagcgacgccagagtttttgcagggcttgcgcgagctgtgtgatcagcatcaggcattattggtgtttgatgaagtgcagtgcgggatggggcggaccggcgatctgtttgcttatatgcactacggcgtgacgccggatattctgacctctgcgaaagcgctaggtggcggcttcccggttagcgccatgctgaccacggcggagattgcttccgcgtttcatcctggttctcacggttccacctacggcggtaatcctctggcctgtgcagtagcgggcgcggcgtttgatatcatcaatacccctgaagtgctggaaggtattcaggcgaaacgccagcgttttgttgaccatttgcagaagatcgatcagcagtacgatgtgtttagcgatattcgcggtatggggctgttgattggcgcagagctgaaaccacagtacaaaggtcgggcgcgtgatttcctgtatgccggtgcagaggaaggcgtaatggtgctgaatgccgggcctgatgtgatgcgttttgcgccgtcgctggtggtggaagatgcggatatcgatgaagggatgcatcgtttcgcccacgcggtggcgaaggtgattggggcgtaa

SEQ ID NO: 7852 - protein, 406 aa, Escherichia coli
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPVSAMLTTAEIASAFHPGSHGSTYGGNPLACAVAGAAFDIINTPEVLEGIQAKRQRFVDHLQKIDQQYDVFSDIRGMGLLIGAELKPQYKGRARDFLYAGAEEGVMVLNAGPDVMRFAPSLVVEDADIDEGMHRFAHAVAKVIGA

SEQ ID NO: 7853 - DNA, 564 bp, Escherichia coli
atgatcctgcttattgataactacgattcttttacctggaacctctaccagtacttttgtgaactgggggcggatgtgttggttaagcgcaacgatgcgttgacgttggcggatatcgacgcccttaaaccacaaaaaattgtcatctcacccggcccctgtacgccagatgaagccgggatctcccttgacgttattcgtcactatgccggacgcttgccgattcttggcgtctgcctcggtcatcaggcaatggcgcaggcatttggcggcaaagttgtgcgcgccgcaaaggtcatgcacggcaaaacctcgccgattacacataatggtgtgggcgtatttaaggggctggcaaatccactcaccgtgacacgctaccattcgctggtggtggaacctgactcattaccggagtgctttgaagtgacggcctggagcgaaacccgcgagattatggggattcgccatcgccagtgggatctggaaggtgtgcaattccatccagaaagtattcttagcgaacaaggacatcaactgctggctaattttctgcatcgctga

SEQ ID NO: 7854 - protein, 187 aa, Escherichia coli
MILLIDNYDSFTWNLYQYFCELGADVLVKRNDALTLADIDALKPQKIVISPGPCTPDEAGISLDVIRHYAGRLPILGVCLGHQAMAQAFGGKVVRAAKVMHGKTSPITHNGVGVFKGLANPLTVTRYHSLVVEPDSLPECFEVTAWSETREIMGIRHRQWDLEGVQFHPESILSEQGHQLLANFLHR

SEQ ID NO: 7855 - DNA, 603 bp, Escherichia coli
atgagcgataaattcggcgaagggcgcgatccgtatctttatccaggccttgatatcatgcgtaaccggctgaacatccgccagcagcagcggctggaacaggccgcttacgaaatgacggcgctgcgtgctgcgaccattgaacttggcccgttggttcggggtttaccgcatttgcgtactcttcatcgccagttgtatcaggatattttcgactgggcggggcaactgcgcgaagtcgatatttatcagggagatacgccgttctgccactttgcctatctcgaaaaagagggcaatgccctgatgcaggatttggaggaagagaagtatctgactagccttgagaaagataaattcgtcgagcggctggcgcattactattgtgaaatcaacgtgctgcatcccttccgggtgggaagtggtttggcacagcggatcttcttcgagcaactggcgattcatgccggatatcaactgagctggcagggtatcgaaaaagaggcctggaatcaggcaaatcagaatggggcaatgggggatctcaccgcgctgcagatgatatttagcaaagtggtaagcgaagccggggaatctgagtaa

SEQ ID NO: 7856 - protein, 200 aa, Escherichia coli
MSDKFGEGRDPYLYPGLDIMRNRLNIRQQQRLEQAAYEMTALRAATIELGPLVRGLPHLRTLHRQLYQDIFDWAGQLREVDIYQGDTPFCHFAYLEKEGNALMQDLEEEKYLTSLEKDKFVERLAHYYCEINVLHPFRVGSGLAQRIFFEQLAIHAGYQLSWQGIEKEAWNQANQNGAMGDLTALQMIFSKVVSEAGESE

SEQ ID NO: 7857 - DNA, 573 bp, Escherichia coli
atgttcaaatcgaccctggcggcgatggctgctgttttcgctctttctgctctttctcccgcagcaatggcagcgaaaggggacccgcacgtattgttgacaacctcagctggtaacatcgaactggaactggataaacaaaaagcgccagtgtctgtgcaaaactttgtcgattatgtgaacagtggtttttataacaacacgacctttcaccgcgtcattcctggctttatgattcagggcggcggtttcaccgagcagatgcagcagaaaaaaccaaacccgccaatcaaaaatgaagcagataacggcctgcgcaacacgcgtggcaccatcgcgatggcgcgtaccgctgacaaagacagcgccaccagccagttctttatcaacgttgccgataacgccttccttgaccacggtcagcgtgatttcggttacgcggtatttggtaaagtggtgaaaggcatggacgttgccgataagatttcccaggtgccgactcatgacgttggtccgtaccagaatgtgccgtcaaaaccggtagttatcctttccgctaaagtcctgccgtaa

SEQ ID NO: 7858 - protein, 190 aa, Escherichia coli
MFKSTLAAMAAVFALSALSPAAMAAKGDPHVLLTTSAGNIELELDKQKAPVSVQNFVDYVNSGFYNNTTFHRVIPGFMIQGGGFTEQMQQKKPNPPIKNEADNGLRNTRGTIAMARTADKDSATSQFFINVADNAFLDHGQRDFGYAVFGKVVKGMDVADKISQVPTHDVGPYQNVPSKPVVILSAKVLP

SEQ ID NO: 7859 - DNA, 108 bp, Escherichia coli
gtgagcttgatgcgattgctgttagtcatgattggcctgcgttcaaaaataaaatggcatagcgggctatgccgcgagcgggcgattttaggcgattttgtgatctga

SEQ ID NO: 7860 - protein, 35 aa, Escherichia coli
MSLMRLLLVMIGLRSKIKWHSGLCRERAILGDFVI

SEQ ID NO: 7861 - DNA, 1182 bp, Escherichia coli
atgactaacagcaatcgcatcaagctcacatggattagctttctttcctacgcactgaccggtgcgttggttattgtcaccgggatggtgatgggaaatatcgccgattatttcaatctgcctgtttccagcatgagtaacaccttcaccttcctcaatgccggcattttaatctctatcttcctcaacgcctggctgatggaaatcgtcccgttgaaaacgcagttacgttttggctttctcctgatggtgctggcggttgccggtttgatgttcagccacagcctggcgctgttctcggcggcgatgttcattctcggggtggtcagcggcatcaccatgtcgattggtacattcctggtaacacaaatgtatgaaggacgtcagcgcggttcacgcctgttatttaccgactccttcttcagtatggccgggatgattttcccaatgatcgccgcgtttctgctggcacgtagcattgagtggtactgggtttatgcctgcatcgggctggtgtatgtcgctatttttattctgaccttcggctgtgaattcccggcactgggcaaacatgcgccaaaaacagatgctccggtagagaaagaaaagtgggggatcggcgtactgtttctctctgttgcggcgctgtgctacatcctcggtcagttaggttttatctcctgggtgccagaatatgccaaaggcctgggcatgagcctgaatgacgctggcacgctggtaagtaacttctggatgtcgtacatggtcggcatgtgggcgttcagctttattcttcgcttctttgatttgcaacgtatcctgaccgtactggctggtctggctgcgattctgatgtacgtctttaacaccggaacaccggcacatatggcgtggtcaattctcgccctgggcttcttctccagcgcgatctataccaccatcatcaccctgggttcacagcagaccaaagtaccgtcgccaaaactggttaactttgtcctgacctgcgggaccatcggtactatgttgacctttgtggttaccggcccgattgttgaacatagtggtccgcaggcggcgctgctgacggcaaacggtctgtacgctgtcgtctttgtgatgtgcttcctgttaggtttcgtcagccgtcaccgtcagcataacaccctgacctctcattaa

SEQ ID NO: 7862 - protein, 393 aa, Escherichia coli
MTNSNRIKLTWISFLSYALTGALVIVTGMVMGNIADYFNLPVSSMSNTFTFLNAGILISIFLNAWLMEIVPLKTQLRFGFLLMVLAVAGLMFSHSLALFSAAMFILGVVSGITMSIGTFLVTQMYEGRQRGSRLLFTDSFFSMAGMIFPMIAAFLLARSIEWYWVYACIGLVYVAIFILTFGCEFPALGKHAPKTDAPVEKEKWGIGVLFLSVAALCYILGQLGFISWVPEYAKGLGMSLNDAGTLVSNFWMSYMVGMWAFSFILRFFDLQRILTVLAGLAAILMYVFNTGTPAHMAWSILALGFFSSAIYTTIITLGSQQTKVPSPKLVNFVLTCGTIGTMLTFVVTGPIVEHSGPQAALLTANGLYAVVFVMCFLLGFVSRHRQHNTLTSH

SEQ ID NO: 7863 - DNA, 2544 bp, Escherichia coli
atgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccggacgtaccgttttttatgacaagctgatcatggcgaccggttcctacccgtggatcccgccaattaaaggttctgatactcaggactgctttgtctatcgcaccattgaagacctcaacgccattgaatcctgcgctcgtcgcagcaagcgcggtgccgttgttggtggcggcctgttaggtctggaagctgctggcgcgctgaaaaacttaggcattgaaacccacgttatcgaatttgcccctatgctgatggcggaacagcttgatcagatgggcggcgagcagctgcgtcgcaaaatcgaaagtatgggcgtgcgcgttcacaccagcaaaaacactcttgagattgtgcaggaaggtgttgaagcgcgtaaaaccatgcgttttgccgacggcagcgaactggaagtcgactttatcgtcttctctaccggtatccgtccgcgcgataagctggcaacccagtgtggtctggacgttgctccgcgtgggggtatcgtcataaatgattcctgccagacttccgatccggatatctacgccatcggtgaatgcgcaagctggaacaaccgtgtatttggtctggtagcaccaggctacaaaatggcgcaggtcgccgttgaccatattcttggtagcgaaaacgcctttgaaggtgcagaccttagcgccaagctgaaactgctgggcgtagacgtaggcggtattggtgatgcgcacggtcgcacgcctggcgcacgtagctacgtttacctcgacgaaagcaaagagatctacaaacgcctgattgtcagcgaagacaacaaaaccctgctcggtgcggtactggtgggcgataccagcgactacggcaacctgctgcaactggtgctgaacgctatcgagctgccggaaaacccggattccctgatcctgccagcgcactcgggtagcggtaagccgtctatcggtgttgataaactgccggacagcgcgcaaatctgctcctgcttcgacgtcaccaaaggcgacctgattgctgctatcaacaaaggctgccacaccgttgcggcgctgaaagccgaaaccaaagccggtacgggctgcggcggttgtattccgctggtcactcaggtactgaacgcggaactggcgaaacagggtatcgaagttaacaacaacctgtgtgaacactttgcttattcgcgtcaggaactgttccatttgatccgcgttgaaggcattaaaaccttcgaagaactgctggcgaaacacggcaaaggttacggttgtgaagtttgtaaaccgaccgtcggttcgctgctggcctcctgctggaacgaatacattctgaagccggaacatactccgctgcaggattctaacgacaacttcctcgcgaacatccagaaagacggcacctactcggtgatcccgcgttctccgggcggtgaaatcaccccggaagggctgatggcagtgggtcgtatcgcgcgtgaatttaatctctacaccaaaatcaccggctctcagcgcctggcgatgtttggcgcacagaaagacgatctgccggagatctggcgtcaactgattgaagccggcttcgaaaccggtcatgcctatgcgaaagcactgcgtatggcgaaaacctgcgtgggaagcacctggtgccgctacggtgttggcgacagcgtcggcctcggcgtggaactggaaaaccgttacaaaggcatccgtacgccgcacaaaatgaagttcggtgtctccggctgtacccgtgaatgttcagaagctcagggtaaagacgtgggtattatcgccaccgaaaaaggctggaacctgtatgtttgcggtaacggcggcatgaaaccgcgtcatgcggatctgctggcagcggatatcgatcgcgaaacgctgattaaatatcttgaccgcttcatgatgttctacatccgtactgccgacaaactgacgcgtaccgcgccgtggttagaaaacctcgaaggtggcatcgattacctgaaagcggtgatcattgacgacaaactggggctgaacgcacatctggaagaagagatggcgcgcctgcgtgaagcggtagtgtgtgagtggactgaaacggtcaataccccgtctgcgcagactcgcttcaaacacttcatcaacagcgataagcgtgacccgaacgtgcagatggtgccagagcgcgaacagcaccgtccggcaacgccgtatgaacgtatcccggtaactctggtggaggacaacgcatga

SEQ ID NO: 7864 - protein, 847 aa, Escherichia coli
MSKVRLAIIGNGMVGHRFIEDLLDKSDAANFDITVFCEEPRIAYDRVHLSSYFSHHTAEELSLVREGFYEKHGIKVLVGERAITINRQEKVIHSSAGRTVFYDKLIMATGSYPWIPPIKGSDTQDCFVYRTIEDLNAIESCARRSKRGAVVGGGLLGLEAAGALKNLGIETHVIEFAPMLMAEQLDQMGGEQLRRKIESMGVRVHTSKNTLEIVQEGVEARKTMRFADGSELEVDFIVFSTGIRPRDKLATQCGLDVAPRGGIVINDSCQTSDPDIYAIGECASWNNRVFGLVAPGYKMAQVAVDHILGSENAFEGADLSAKLKLLGVDVGGIGDAHGRTPGARSYVYLDESKEIYKRLIVSEDNKTLLGAVLVGDTSDYGNLLQLVLNAIELPENPDSLILPAHSGSGKPSIGVDKLPDSAQICSCFDVTKGDLIAAINKGCHTVAALKAETKAGTGCGGCIPLVTQVLNAELAKQGIEVNNNLCEHFAYSRQELFHLIRVEGIKTFEELLAKHGKGYGCEVCKPTVGSLLASCWNEYILKPEHTPLQDSNDNFLANIQKDGTYSVIPRSPGGEITPEGLMAVGRIAREFNLYTKITGSQRLAMFGAQKDDLPEIWRQLIEAGFETGHAYAKALRMAKTCVGSTWCRYGVGDSVGLGVELENRYKGIRTPHKMKFGVSGCTRECSEAQGKDVGIIATEKGWNLYVCGNGGMKPRHADLLAADIDRETLIKYLDRFMMFYIRTADKLTRTAPWLENLEGGIDYLKAVIIDDKLGLNAHLEEEMARLREAVVCEWTETVNTPSAQTRFKHFINSDKRDPNVQMVPEREQHRPATPYERIPVTLVEDNA

SEQ ID NO: 7865 - DNA, 327 bp, Escherichia coli
atgagccagtggaaagacatctgcaaaatcgatgacatcctgcctgaaaccggcgtctgcgcgctgttaggtgacgaacaagtagcaattttccgcccgtatcacagcgatcaggtgtttgcgatcagcaacatcgacccgttcttcgagtccagcgtgctgtcacgcgggttgattgcggaacaccagggcgagctgtgggtcgccagtccgctgaaaaagcagcgttttcgcttaagcgacggcttgtgcatggaagacgaacagttttccgtcaagcattacgacgcgcgagtgaaagacggcgtggtacagctgcgcggttaa

SEQ ID NO: 7866 - protein, 108 aa, Escherichia coli
MSQWKDICKIDDILPETGVCALLGDEQVAIFRPYHSDQVFAISNIDPFFESSVLSRGLIAEHQGELWVASPLKKQRFRLSDGLCMEDEQFSVKHYDARVKDGVVQLRG

SEQ ID NO: 7867 - DNA, 807 bp, Escherichia coli
atgtttacagacactattactaagtgtgcggctaacgctgcgcgcattgcacgcctgtcggcaaataacccgctcggcttttgggtcagctccgccatggcgggcgcgtatgtgggtcttgggatcatcctgattttcacgctcggtaatttgctcgacccgtccgtacgtcctctggtgatgggcgcgacctttggtatcgccttaacgctggtcattattgctggttctgaactgttcaccggacacaccatgttcctcacctttggggtgaaagcgggcactatcagccacgggcaaatgtgggcaatcctgccgcaaacctggctgggtaacctggtcggttccgtcttcgttgccatgctttatagctggggcggcggtagcctgctgccggtcgataccagcatcgttcactccgttgcgctggctaaaaccactgcaccggcaatggtactgttcttcaaaggtgcattgtgtaactggctggtttgcctggctatctggatggcattgcgtacagaaggggcggcgaaatttatcgctatctggtggtgtctgctggcatttatcgcgtccggctacgagcactccatcgctaacatgacgctgttcgccctctcctggttcggcaaccacagcgaagcctacacgctggcgggtattggtcataacctgctgtgggtgacgctgggtaatactttatcaggtgccgtattcatgggattgggttattggtatgctacgccgaaagcgaatcgtccggttgcggacaaatttaatcaaactgaaacggctgccggttaa

SEQ ID NO: 7868 - protein, 268 aa, Escherichia coli
MFTDTITKCAANAARIARLSANNPLGFWVSSAMAGAYVGLGIILIFTLGNLLDPSVRPLVMGATFGIALTLVIIAGSELFTGHTMFLTFGVKAGTISHGQMWAILPQTWLGNLVGSVFVAMLYSWGGGSLLPVDTSIVHSVALAKTTAPAMVLFFKGALCNWLVCLAIWMALRTEGAAKFIAIWWCLLAFIASGYEHSIANMTLFALSWFGNHSEAYTLAGIGHNLLWVTLGNTLSGAVFMGLGYWYATPKANRPVADKFNQTETAAG

SEQ ID NO: 7869 - DNA, 1374 bp, Escherichia coli
gtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcgattgcagcgacagatgatgacgcgcttaaccagcgcgtcagcgaagccgctgaatctcgtcgtatcttctgtaacgtggtcgatgcgccgaaagccgccagctttattatgccgtcgattattgaccgctcaccgctcatggtagcggtatcctctggcggtacttctccggttctggcgcgcctgttgcgcgaaaaactcgaatcactgctgccgttacatctgggccaggtagcgaaatacgccgggcaattacgcgggcgagtaaaacagcagttcgccacgatgggtgagcgtcgccgtttctgggagaaattgttcgttaacgaccgcctggcgcagtcgctggccaacaacgatcagaaagccattactgaaaccaccgaacagttaatcaatgaaccgctcgaccatcgcggtgaagtggtgctggttggtgcaggtccgggcgatgccgggctgctgacactgaaaggtctgcaacaaattcagcaggcagatgtggtggtctacgaccgtctggtttctgacgatattatgaatctgatacgccgcgatgctgatcgcgttttcgtcggcaaacgcgcgggataccactgcgtaccgcaggaagagattaaccagatcttgctgcgggaagcgcaaaaaggtaaacgcgtggtgcgtctgaaaggcggcgatccgtttattttcgggcgtggcggagaagagctggaaacactgtgcaacgcgggtattccgttctcggtggttccgggtattaccgcagcttctggttgctctgcctattcgggtattccgctcacgcatcgcgattatgcccagagcgtacgcttaattaccggacacttaaaaaccggtggcgagctggactgggaaaacctggcggcagaaaaacagacgctggtgttctatatggggctgaatcaggctgcaactattcagcaaaagctgattgaatacggtatgcctggtgaaatgccggtggcaattgtcgaaaacggaacggcagtcacgcagcgcgtgattgacggtacgctcacgcagctgggcgaactggcgcagcaaatgaacagtccatcgctaattattattggtcgggttgttggcctgcgcgataaattgaactggttctctaaccattaa

SEQ ID NO: 7870 - protein, 457 aa, Escherichia coli
MDHLPIFCQLRDRDCLIVGGGDVAERKARLLLDAGARLTVNALAFIPQFTAWADAGMLTLVEGPFDESLLDTCWLAIAATDDDALNQRVSEAAESRRIFCNVVDAPKAASFIMPSIIDRSPLMVAVSSGGTSPVLARLLREKLESLLPLHLGQVAKYAGQLRGRVKQQFATMGERRRFWEKLFVNDRLAQSLANNDQKAITETTEQLINEPLDHRGEVVLVGAGPGDAGLLTLKGLQQIQQADVVVYDRLVSDDIMNLIRRDADRVFVGKRAGYHCVPQEEINQILLREAQKGKRVVRLKGGDPFIFGRGGEELETLCNAGIPFSVVPGITAASGCSAYSGIPLTHRDYAQSVRLITGHLKTGGELDWENLAAEKQTLVFYMGLNQAATIQQKLIEYGMPGEMPVAIVENGTAVTQRVIDGTLTQLGELAQQMNSPSLIIIGRVVGLRDKLNWFSNH

SEQ ID NO: 7871 - DNA, 168 bp, Escherichia coli
atgaacaaatttattaaagttgcactggtaggcgcagtactggctacgttaactgcatgtactggtcatattgaaaaccgtgataagaactgctcttacgactacctgctgcacccggctatttctatttctaaaatcattggcggttgcggtccgactgcacagtaa

SEQ ID NO: 7872 - protein, 55 aa, Escherichia coli
MNKFIKVALVGAVLATLTACTGHIENRDKNCSYDYLLHPAISISKIIGGCGPTAQ

SEQ ID NO: 7873 - DNA, 1086 bp, Escherichia coli
atgaagacgtttcctctgcaaagcctgacgcttattgaggcgcagcaaaagcagtttgcgctggtggacacgatttgccgtcattttcctggctgcgagtttcttacctgcggtgatttgggcttaacgccggggctaaatcagccccgcattacccagcgtgtggaacaggtgctggctgacgcgtttcacgcacaggccgcggcgctggtacagggcgcgggtactggcgcgatccgtgcggcactggcggctttgctcaaatcggggcagcgtcttctggtgcatgacgcgcctgtttacccgacgacacgggttattattgagcagatggggctaacgctcattacggctgatttcaatgatctgtcggcactgaagcaggttgttgacgagcaacaacctgatgcagcgctggtgcagcatacgcgccagcagccgcaggaccgctatgtgctggcagacgtgctggcaacgttgcgcgcggcaggtgttccagcgttaaccgatgacaactatgcggtgatgaaggtagcgcgaatcggctgcgaatgcggggcgaatgtgtcgacattttcctgcttcaagctatttgggccagagggcgttggtgcggtggtaggcgatgccgatgttattagccggattcgcgccacgctctattccggcggcagtcagattcagggggcgcaggcattagaggtgttgcgtggtctggtgctcgcgccagtgatgcacgcggtgcaggcgggggtatctgaacggttgctggctttgcttaacggcggcgcggtggcggaagtgaaaagcgccgtcattgccaatgcacagtcgaaggtattgattgtggagtttcatcagccgattgccgccagagtgctggaagaggcgcagaaactcggtgccttgccttacccggttggtgcagagtcaaaatatgaaatcccgccgctcttttatcgactttccggaacgtttcgccaggcgaatccgcagttagaacattgcgcgattcgcattaacccaaatcgcagcggtgaagagacgatattgcggatcttgcgtgaaagtattgccagcatttaa

SEQ ID NO: 7874 - protein, 361 aa, Escherichia coli
MKTFPLQSLTLIEAQQKQFALVDTICRHFPGCEFLTCGDLGLTPGLNQPRITQRVEQVLADAFHAQAAALVQGAGTGAIRAALAALLKSGQRLLVHDAPVYPTTRVIIEQMGLTLITADFNDLSALKQVVDEQQPDAALVQHTRQQPQDRYVLADVLATLRAAGVPALTDDNYAVMKVARIGCECGANVSTFSCFKLFGPEGVGAVVGDADVISRIRATLYSGGSQIQGAQALEVLRGLVLAPVMHAVQAGVSERLLALLNGGAVAEVKSAVIANAQSKVLIVEFHQPIAARVLEEAQKLGALPYPVGAESKYEIPPLFYRLSGTFRQANPQLEHCAIRINPNRSGEETILRILRESIASI

SEQ ID NO: 7875 - DNA, 1305 bp, Escherichia coli
atggatctgtatattcagattatcgtggtggcgtgcctgacgggtatgacatcgcttctggcgcatcgctcggcggccgtttttcatgacggtatccgcccgatcctgccacaactgattgaaggctatatgaaccgtcgcgaggcggggagtatcgcttttggtctgagcattggttttgtggcctcggtggggatctcttttaccctgaaaaacgggctgctcaacgcatggttactctttcttcctaccgatatcctcggcgtactggcgataaacagcctgatggcgtttggtcttggtgctatctggggaatattgatcctcacctgtctgttgccagtaaaccagctgctgaccgcgctaccggtggatgtattaggtagcctgggggaattaagctcgccggtggtttcagcttttgcactgttcccgttggtggcgattttctaccagtttggctggaagcaaagtctgatcgccgccgtggtggtactgatgactcgtgtggtggtagtgcgctattccccacatcttaaccctgaatccatcgaaatctttattggcatggtgatgctgctggggatcgcaataactcatgacctgcgtcatcgtgatgaaaatgatatcgatgccagcggtatgtcggtgtttgaagagcgtacatcacggattatcaaaaacttaccgtatatcgccatcgtgggtgcattgattgctgccgttgccagcatgaagattttcgccggtagtgaagtgtcgatcttcacactggagaaagcgtactccgcaggcgtaacgccggaacaatcgcaaacactaatcaaccaggcggcactggcagaatttatgcgcgggctgggttttgtgccgttgattgccaccacggcgttagccaccggtgtgtatgcagttgcgggctttacctttgtttatgcggtgggctatctctcgccgaatccgatggttgcagcggtattaggcgcagtggttatttcggcggaagtcttgctgcttcgttcgatcggcaaatggttggggcgctacccgtcggtacgtaatgcgtcggataacatccgtaacgccatgaatatgctgatggaagtggcgttgctggtcggttcgatctttgcagcaatcaaaatggcgggctataccggattctctatcgcggttgccatttacttcctcaacgaatccctgggccgtccggtacagaaaatggcggcaccggtcgtagcagtaatgatcaccggcatcctgctgaatgttctttactggcttggcctgttcgttccggcttaa

SEQ ID NO: 7876 - protein, 434 aa, Escherichia coli
MDLYIQIIVVACLTGMTSLLAHRSAAVFHDGIRPILPQLIEGYMNRREAGSIAFGLSIGFVASVGISFTLKNGLLNAWLLFLPTDILGVLAINSLMAFGLGAIWGILILTCLLPVNQLLTALPVDVLGSLGELSSPVVSAFALFPLVAIFYQFGWKQSLIAAVVVLMTRVVVVRYSPHLNPESIEIFIGMVMLLGIAITHDLRHRDENDIDASGMSVFEERTSRIIKNLPYIAIVGALIAAVASMKIFAGSEVSIFTLEKAYSAGVTPEQSQTLINQAALAEFMRGLGFVPLIATTALATGVYAVAGFTFVYAVGYLSPNPMVAAVLGAVVISAEVLLLRSIGKWLGRYPSVRNASDNIRNAMNMLMEVALLVGSIFAAIKMAGYTGFSIAVAIYFLNESLGRPVQKMAAPVVAVMITGILLNVLYWLGLFVPA

SEQ ID NO: 7877 - DNA, 393 bp, Escherichia coli
gtgaaaatccctctcaatttttccaataaggacagactcatgaaaaagattggcgttgcaggcttacagcgtgagcagattaaaaaaaccattgaagcgacggctcctggctgttttgaagttttcattcacaacgacatggaagcggcaatgaaagtgaaatccgggcaactggattactacatcggtgcgtgtaataccggtgcgggcgcggcattgtcgattgctatcgcggtgattggctataacaaaagttgcaccattgccaagccgggcattaaagcgaaagacgaacatatcgccaaaatgatcgctgaaggaaaagtggcgtttggcctttccgttgagcacgttgaacacgcgattccgatgctgattaaccatctgaaataa

SEQ ID NO: 7878 - protein, 130 aa, Escherichia coli
MKIPLNFSNKDRLMKKIGVAGLQREQIKKTIEATAPGCFEVFIHNDMEAAMKVKSGQLDYYIGACNTGAGAALSIAIAVIGYNKSCTIAKPGIKAKDEHIAKMIAEGKVAFGLSVEHVEHAIPMLINHLK

SEQ ID NO: 7879 - DNA, 879 bp, Escherichia coli
atgagttttgatccgacgggctacacccttgcccatgagcatctgcatattgatctttccggctttaaaaacaacgtggactgccgccttgatcagtatgcgttcatttgccaggagatgaacgacctgatggcccggggcgtgcgtaatgtgattgagatgaccaaccgttacatggggcgcaatgtgcaatttatgctcgatgtaatgcgcgaaaccgggatcaacgtggtggcctgtaccggttattaccaggacgcgtttttcccggaacatgtggcgacccgcagcgtgcaggaactggcgcaggagatggtcgatgaaattgagcagggtatcgatggcactgacctgaaagccgggatcatcgcggagattggctccagcgaagggaagattacgccgctggaagagaaggtgtttattgccgccgcgctggcacataaccagaccggacgcccgatctccacgcatacgtcgttcagcacgatggggctggagcaactggctctgttgcaagcccacggagttgatctttcgcgcgtcaccgtcggccactgcgatctgaaagacaatctcgacaacattttgaagatgatcgatctcggcgcgtatgtgcagttcgacaccatcggcaagaacagttactacccggacgaaaagcgcattgcgatgctccatgcgctacgtgaccgtgggttgctgaaccgcgtcatgctgtcgatggatattacgcggcgctctcatttaaaagccaacggtggttatggctatgactttttattgaccacctttattccgcaattgcgccagtcaggattcagtcaggccgatgtggatgtgatgttacgtgaaaatccctctcaatttttccaataa

SEQ ID NO: 7880 - protein, 292 aa, Escherichia coli
MSFDPTGYTLAHEHLHIDLSGFKNNVDCRLDQYAFICQEMNDLMARGVRNVIEMTNRYMGRNVQFMLDVMRETGINVVACTGYYQDAFFPEHVATRSVQELAQEMVDEIEQGIDGTDLKAGIIAEIGSSEGKITPLEEKVFIAAALAHNQTGRPISTHTSFSTMGLEQLALLQAHGVDLSRVTVGHCDLKDNLDNILKMIDLGAYVQFDTIGKNSYYPDEKRIAMLHALRDRGLLNRVMLSMDITRRSHLKANGGYGYDFLLTTFIPQLRQSGFSQADVDVMLRENPSQFFQ

SEQ ID NO: 7881 - DNA, 1227 bp, Escherichia coli
atggcgcgatttgtggtgttagtgattgatagctttggcgtaggggcaatgaaagatgtcacgttggtgcgtccgcaggatgccggggcgaatacctgtggtcacatcctgagccagttgccgcatttgcagctaccaacgctggagacgctggggctaatcaacgcattgggttatgcgcctggcgatatgcagccgtcagactcctccacctggggcgtggcggaactgcaacatgaaggtggcgatacctttatggggcatcaggagattttaggtacgcgcccattaccgccgctgcggatgccctttcgtgatgtgattgaccgtgttgagcaggcattagtatccgccggttggcaggtggagcgtcgtggcgatgatctgcaatttctgtgggtcaatcaggcggttgcgattggcgataatctcgaggcggatttaggccaggtctataacatcaccgccaatctctctgtgatctcttttgacgacgcaatcaaaatgggtcgtattgtgcgtgagcaggtacaggtcggtcgggtcattacatttggcggcctgttacccgacagtcaacgcattctcgatgccgcagaaagcaaagaagggcgctttattggcatcaatgcgccgcgttctggcgcctatgacaacggtttccaggtcgtacatatgggctacggtgttgatgaaaaagtgcaggtgccgcaaaaactgtatgaagcgggcgtgccaaccgtgctggtgggtaaggtggcagatatcgtcagcaatccttatggcgtgagctggcaaaacctggtggatagccagcggattatggatatcaccctcaacgaatttaacacctatccgacggcgtttatttgtaccaatatccaggaaaccgacctcgctggtcatgcagaagacgtcgcacgttatgccgaacgtttgcaggtcgttgaccgtaaccttgcccggcttgttgaggcgatgcagccagatgattgcctggtcgtgatggcggatcacggtaacgatccgaccattggtcacagccaccatacccgcgaagtggtgccagtgctggtttatcagcaaggactggtcgctacgcagctcggtgtgcgcaccacgctttctgatgtgggggctacagtgtgtgaatttttccgtgcgccaccgccacaaaatggtcgctcttttctttcctccttccggtttgcaggagacaccctatga

SEQ ID NO: 7882 - protein, 408 aa, Escherichia coli
MARFVVLVIDSFGVGAMKDVTLVRPQDAGANTCGHILSQLPHLQLPTLETLGLINALGYAPGDMQPSDSSTWGVAELQHEGGDTFMGHQEILGTRPLPPLRMPFRDVIDRVEQALVSAGWQVERRGDDLQFLWVNQAVAIGDNLEADLGQVYNITANLSVISFDDAIKMGRIVREQVQVGRVITFGGLLPDSQRILDAAESKEGRFIGINAPRSGAYDNGFQVVHMGYGVDEKVQVPQKLYEAGVPTVLVGKVADIVSNPYGVSWQNLVDSQRIMDITLNEFNTYPTAFICTNIQETDLAGHAEDVARYAERLQVVDRNLARLVEAMQPDDCLVVMADHGNDPTIGHSHHTREVVPVLVYQQGLVATQLGVRTTLSDVGATVCEFFRAPPPQNGRSFLSSFRFAGDTL

SEQ ID NO: 7883 - DNA, 1164 bp, Escherichia coli
atgtttgtagaagcattgaaacgccagaatccggcgctgatttccgccgcactaagtttgtggcagcagggcaagatcgccccggacagttgggtgatcgacgtggatcaagttctggaaaacggcaagcggctgattgagacggcgcggctttacggcattgaactgtatctgatgaccaaacaattcggtcgtaatccgtggctggcagaaaaactgctggctctgggctacagcggcattgtggcggtggattacaaagaggtgcgagtcatgcgccgcgccggtttgccggtagcgcatcaggggcatctggtacaaatcccttgtcatcaggtttctgacgccgttgaacagggaaccgacgtcatcactgtgtttaccctcgacaaagcgcgggaaatttctgcggcagcggtgaagaccggacgtgtgcagtctgtgctgctcaaagtttatagcgacgatgattttctttatccggggcaggagagcggttttgtacagcattcgctgcacgaggtggttgctgaaatccagaatctgccggggctacatttggcgggacttacccatttcccttgcctgctttgggatgaggctgccgggaaagttttgccgacaccgaatcttcacacgctggtacaagcacgggatcaactggcgaaatctggtattgcgattgagcaactgaacgcgccttcagcgaccagctgcacgtcgctgccattgctggcggaatacggtgtgactcataccgaacccggtcatgcgctgacgggtactattccggcaaatcaacagggcgatcagcctgaacgtatcgcgatgctctggttaagtgaaatctcccatcatttccgtggcgacagctactgctacggcggcggttactaccgtcgtggtcacgcgcaacatgcgctggtgtttacgccagaaaatcaaagaattactgaaacatatctcaacgccgttgatgacagcagtatcgactacaccctgccgctggcaggcgagcatccggtaagcagtgcagtggtgctctgttttcgcacgcagatttttatcacccgtagcgatgtggtgctggtgtccggtattcaccgtggcgaaccagaaatagttggtcgttatgacagcctcggcaaccctctggaggcgtaa

SEQ ID NO: 7884 - protein, 387 aa, Escherichia coli
MFVEALKRQNPALISAALSLWQQGKIAPDSWVIDVDQVLENGKRLIETARLYGIELYLMTKQFGRNPWLAEKLLALGYSGIVAVDYKEVRVMRRAGLPVAHQGHLVQIPCHQVSDAVEQGTDVITVFTLDKAREISAAAVKTGRVQSVLLKVYSDDDFLYPGQESGFVQHSLHEVVAEIQNLPGLHLAGLTHFPCLLWDEAAGKVLPTPNLHTLVQARDQLAKSGIAIEQLNAPSATSCTSLPLLAEYGVTHTEPGHALTGTIPANQQGDQPERIAMLWLSEISHHFRGDSYCYGGGYYRRGHAQHALVFTPENQRITETYLNAVDDSSIDYTLPLAGEHPVSSAVVLCFRTQIFITRSDVVLVSGIHRGEPEIVGRYDSLGNPLEA

SEQ ID NO: 7885 - DNA, 405 bp, Escherichia coli
gtggggaacaggaacccagttattaaacgaaaggcatctgatatggaaaccagactcaacctgctttgcgatgcaggcgttattgataaggacatctgcaaaggcatgatgcaggtcgtcaatgtactggaaacagagtgccatctaccggtgcgcagtgagcaaggaacgatggcgatgacacatatggcgagtgcactgatgcgcagtcgccgtggtgaagaaatagagccgctggatgacgaattgctggcggaactggcgcaatccagccactggcaagccgttgtgcaattgcatcaggtattgttgaaggaatttgcactggaagttaacccgtgtgaagaaggctatttgctggccaacctttatggattatggatggctgctaacgaagaggtttga

SEQ ID NO: 7886 - protein, 134 aa, Escherichia coli
MGNRNPVIKRKASDMETRLNLLCDAGVIDKDICKGMMQVVNVLETECHLPVRSEQGTMAMTHMASALMRSRRGEEIEPLDDELLAELAQSSHWQAVVQLHQVLLKEFALEVNPCEEGYLLANLYGLWMAANEEV

SEQ ID NO: 7887 - DNA, 906 bp, Escherichia coli
atgcgtcgaacgtttatcaaaaaagaaggcgtcgttatcacgacactggcccgttatttgttgggtgaaaagtgcggtaatcgactgaaaaccatagatgagctggcaactgaatgccgttcatcggttggcctgacgcaggccgcgttgaaaacgctggaatcaagcggagcgatacggattgaacgccgtgggcgcaatggcagttatctggtcgagatggataacaaagcattgctgactcatgtggatatcaacaacgtggtatgtgcgatgcccttgccctatacccgtttgtacgaaggcctggcgagcggattgaaagcccagtttgatggcattcctttttactatgcgcatatgcgcggcgcggatattcgcgtggagtgtttacttaacggcgtgtatgacatggcggtggtttcgcgactggcggcggaaagttatctcacgcaaaaaggattatgcctcgcgctggagttgggaccgcatacctacgttggcgagcaccagttgatttgccgtaaaggcgagtccgcaaacgtgaagcgcgtggggctggataaccgttcggcagatcagaaaatcatgaccgatgtcttttttggcgatagtgatgtggaacgagtcgatctctcttatcacgagagtttacaacgcattgttaaaggcgatgttgacgcggttatctggaacgtagtggcggaaaacgaactgactatgctgggattagaagcgacgccgctcacagacgatccgcgatttttacaggccaccgaagccgtgatcctgacgcgtgccgatgattacccaatgcaacaactgctgcgtgcagttgttgataaacatgccctgcttgctcatcaacagcgagtagtcagtggggaacaggaacccagttattaa

SEQ ID NO: 7888 - protein, 301 aa, Escherichia coli
MRRTFIKKEGVVITTLARYLLGEKCGNRLKTIDELATECRSSVGLTQAALKTLESSGAIRIERRGRNGSYLVEMDNKALLTHVDINNVVCAMPLPYTRLYEGLASGLKAQFDGIPFYYAHMRGADIRVECLLNGVYDMAVVSRLAAESYLTQKGLCLALELGPHTYVGEHQLICRKGESANVKRVGLDNRSADQKIMTDVFFGDSDVERVDLSYHESLQRIVKGDVDAVIWNVVAENELTMLGLEATPLTDDPRFLQATEAVILTRADDYPMQQLLRAVVDKHALLAHQQRVVSGEQEPSY

SEQ ID NO: 7889 - DNA, 1005 bp, Escherichia coli
atgactaagcccatcgtttttagtggcgcacagccctcaggtgaattgaccattggtaactacatgggtgcgctgcgtcagtgggtaaacatgcaggatgactaccattgcatttactgtatcgttgaccaacacgcgatcaccgtgcgccaggatgcacagaagctgcgtaaagcgacgctggatacgctggcgttgtatctggcttgtggtatcgatcctgagaaaagcaccatttttgttcagtcccacgtgccggaacatgcgcagttaggctgggcattgaactgctatacctacttcggcgaactgagccgcatgacacagtttaaagataaatctgcgcgttatgccgagaacatcaacgctggtctgtttgactatccggtgctgatggcagcggacatcctgctgtatcaaactaatctggtgccggtgggtgaagaccagaaacagcacctggaactgagccgcgatatcgcccagcgtttcaacgcgctgtacggcgatatctttaaggtgccagagccgtttattccgaaatctggcgcgcgcgtaatgtcgctgctggagccgaccaagaagatgtccaagtctgacgataaccgcaataacgttatcggcctgctggaagatccgaaatcggtagtgaagaaaatcaaacgcgcggtcactgactccgacgagccgccggtagttcgctacgatgtgcagaacaaagcgggcgtttccaacctgctggatatcctttctgcggtaacgggccagagcatcccggaactggaaaaacagttcgaaggcaagatgtatggtcatctgaaaggtgaagtggctgatgccgtttccggtatgctgactgaattgcaggaacgttaccaccgtttccgcaacgatgaagccttcctgcaacaggtgatgaaagacggcgcagaaaaagccagcgcacacgcttcccgtacgctaaaagcggtgtacgaagcgattggttttgtggcgaagccgtaa

SEQ ID NO: 7890 - protein, 334 aa, Escherichia coli
MTKPIVFSGAQPSGELTIGNYMGALRQWVNMQDDYHCIYCIVDQHAITVRQDAQKLRKATLDTLALYLACGIDPEKSTIFVQSHVPEHAQLGWALNCYTYFGELSRMTQFKDKSARYAENINAGLFDYPVLMAADILLYQTNLVPVGEDQKQHLELSRDIAQRFNALYGDIFKVPEPFIPKSGARVMSLLEPTKKMSKSDDNRNNVIGLLEDPKSVVKKIKRAVTDSDEPPVVRYDVQNKAGVSNLLDILSAVTGQSIPELEKQFEGKMYGHLKGEVADAVSGMLTELQERYHRFRNDEAFLQQVMKDGAEKASAHASRTLKAVYEAIGFVAKP

SEQ ID NO: 7891 - DNA, 426 bp, Escherichia coli
ttgttcccgcacgttgccgatacgttgggcgcgttgcaggctaaaggcctgccgctaggcctggtcaccaacaaaccgacgccgttcgtcgcgccgctgctcgaagccttagatatcgccaaatacttcagcgtggttatcggcggcgatgatgtgcaaaacaaaaaaccgcatccggacccgctgttactggtggctgaacggatgggcattgctccacaacagatgctgtttgtcggcgactcacgcaatgatattcaggcagcaaaagcggcaggttgcccatcagttggcttaacctacggatataactacggcgaggctatcgatctcagccagcctgatgtaatttatcagtctctaaatgaccttctgcccgcattagggcttccgcatagcgaaaatcaggaatcgaaaaatgactaa

SEQ ID NO: 7892 - protein, 141 aa, Escherichia coli
MFPHVADTLGALQAKGLPLGLVTNKPTPFVAPLLEALDIAKYFSVVIGGDDVQNKKPHPDPLLLVAERMGIAPQQMLFVGDSRNDIQAAKAAGCPSVGLTYGYNYGEAIDLSQPDVIYQSLNDLLPALGLPHSENQESKND

SEQ ID NO: 7893 - DNA, 99 bp, Escherichia coli
gtgaagaacgcgttattacctggattgggtaacggcgcagaatattctgatggagcgcgcattgacctgggcgcgtcaggaacgtgcgactctgcgtaa

SEQ ID NO: 7894 - protein, 32 aa, Escherichia coli
MKNALLPGLGNGAEYSDGARIDLGASGTCDSA

SEQ ID NO: 7895 - DNA, 156 bp, Escherichia coli
atgaataagtttgaagatattcgcggcgtcgcttttgatctcgacggtacgctggttgacagtgcccccggtcttgctgctgcggtagatatggcgctgtatgcgctggagttgcctgtcgcaggtgaagaacgcgttattacctggattgggtaa

SEQ ID NO: 7896 - protein, 51 aa, Escherichia coli
MNKFEDIRGVAFDLDGTLVDSAPGLAAAVDMALYALELPVAGEERVITWIG

SEQ ID NO: 7897 - DNA, 678 bp, Escherichia coli
atgaaacagtatttgattgctccctcaattctgtcggctgattttgcccgcctgggtgaagataccgcaaaagccctggcagctggcgctgatgtcgtgcattttgacgtcatggataaccactatgttcccaatctgacgattgggccaatggtgctgaaatccttgcgtaactacggcattaccgcccctatcgacgtacatctgatggtgaaacccgtcgatcgcattgtgcctgatttcgctgccgctggtgccagcatcattacctttcatccagaagcctccgagcatgttgaccgcacgctgcaactgattaaagaaaatggctgtaaagcgggtttggtatttaacccggcgacacctctgagttatctggattacgtgatggataagctggatgtgatcctgctgatgtccgtcaatcctggtttcggcggtcagtctttcattcctcaaacactggataaactgcgcgaagtacgtcgtcgtatcgacgagtctggctttgacattcgactggaagtggacggtggcgtgaaggtgaacaacattggcgaaatcgctgcggcgggcgcggatatgtttgttgctggttcggcaatcttcgaccagccagactacaaaaaagtcattgatgaaatgcgcagtgaactggcaaaggtaagtcatgaataa

SEQ ID NO: 7898 - protein, 225 aa, Escherichia coli
MKQYLIAPSILSADFARLGEDTAKALAAGADVVHFDVMDNHYVPNLTIGPMVLKSLRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGFDIRLEVDGGVKVNNIGEIAAAGADMFVAGSAIFDQPDYKKVIDEMRSELAKVSHE

SEQ ID NO: 7899 - DNA, 837 bp, Escherichia coli
atgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgtttggccgctacaaaaaaccctatttcccggaagcagagttgtatcacttcgctgaaaaagcgcagaatgcctttttctattgtgagtcttacgccgatagcatggcgcgcgcagatgatgcatctgtcgtctattgcgatccgccttatgcgccgctgtctgcgactgccaactttacggcgtatcacacaaacagttttacgcttgaacaacaagcgcatctggcggagatcgctgaaggtctggttgatcgccatattccggtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataa

SEQ ID NO: 7900 - protein, 278 aa, Escherichia coli
MKKNRAFLKWAGGKYPLLDDIKRHLPKGECLVEPFVGAGSVFLNTDFSRYILADINSDLISLYNIVKMRTDEYVQAARELFVPETNCAEVYYQFREEFNKSQDPFRRAVLFLYLNRYGYNGLCRYNLRGEFNVPFGRYKKPYFPEAELYHFAEKAQNAFFYCESYADSMARADDASVVYCDPPYAPLSATANFTAYHTNSFTLEQQAHLAEIAEGLVDRHIPVLISNHDTMLTREWYQRAKLHVVKVRRSISSNGGTRKKVDELLALYKPGVVSPAKK

SEQ ID NO: 7901 - DNA, 1287 bp, Escherichia coli
atggatgaattcaaaccagaagacgagctgaaacccgatcccagcgatcgtcgtactggtcgttctcgtcaatcttctgaacgttctgagcgtactgaacgtggcgaaccgcagatcaattttgatgatattgaacttgatgacactgacgatcgccgtccgactcgtgcgcaaaaagcgcgtaatgaggaaccggaaatcgaagaagaaattgacgaatccgaagatgaaaccgtggatgaagagcgcgtagagcgtcgtccgcgtaagcgcaaaaaagcagccagtaaacccgcttctcgtcagtatatgatgatgggtgtcggcattctggttctactgctgttgatcatcggtatcggttctgcgctaaaagccccctcgacctcttccagcgatcaaaccgcgtctggcgagaagagtattgatcttgcaggcaatgcgaccgatcaggccaatggcgtgcagccagcgccgggaaccacgtctgcggaaaatactcagcaggatgtttctctgccgccgatctcttctacgccgactcaagggcaaaccccggtggcaacggatggtcaacaacgtgttgaagtgcagggtgacctgaacaatgcgctgacccagccacaaaatcagcaacagttgaacaatgtggcggtcaattctacattgccgactgaacccgcaacggttgcgcctgttcgcaatggcaatgcatcgcgtgacacggcgaaaacgcaaaccgctgaacgtccggccactacgcgcccggctcgtcagcaggcggtgattgaaccgaaaaaaccgcaagcaaccgtgaaaacggaaccgaagccagtcgcacagacgccgaagcgaactgaaccagctgcccctgtggcgagcacaaaggcaccggctgcgacttctacgccagcaccaaaagagacggcgactacggctccagtacagacggcatccccggcgcaaaccacggcaacaccagccgctggagggaagaccgcaggtaatgttggttcgttgaaatcggcaccgtccagccattacactctgcagctgagcagttcctctaactacgacaacctgaacggttgggcgaagaaagagaatctgaaaaactacgttgtctatgaaacgacgcgtaatggtcagccgtggtatgtcctggtttctggcgtgtatgcttcgaaagaagaggcgaaaaaagcggtatctacattgccagcagatgtccaggccaaaaacccgtgggcgaaaccgctgcgtcaggtacaggccgatctgaagtaa

SEQ ID NO: 7902 - protein, 428 aa, Escherichia coli
MDEFKPEDELKPDPSDRRTGRSRQSSERSERTERGEPQINFDDIELDDTDDRRPTRAQKARNEEPEIEEEIDESEDETVDEERVERRPRKRKKAASKPASRQYMMMGVGILVLLLLIIGIGSALKAPSTSSSDQTASGEKSIDLAGNATDQANGVQPAPGTTSAENTQQDVSLPPISSTPTQGQTPVATDGQQRVEVQGDLNNALTQPQNQQQLNNVAVNSTLPTEPATVAPVRNGNASRDTAKTQTAERPATTRPARQQAVIEPKKPQATVKTEPKPVAQTPKRTEPAAPVASTKAPAATSTPAPKETATTAPVQTASPAQTTATPAAGGKTAGNVGSLKSAPSSHYTLQLSSSSNYDNLNGWAKKENLKNYVVYETTRNGQPWYVLVSGVYASKEEAKKAVSTLPADVQAKNPWAKPLRQVQADLK

SEQ ID NO: 7903 - DNA, 1089 bp, Escherichia coli
atggagaggattgtcgttactctcggggaacgtagttacccaattaccatcgcatctggtttgtttaatgaaccagcttcattcttaccgctgaaatcgggcgagcaggtcatgttggtcaccaacgaaaccctggctcctctgtatctcgataaggtccgcggcgtacttgaacaggcgggtgttaacgtcgatagcgttatcctccctgacggcgagcagtataaaagcctggctgtactcgataccgtctttacggcattgttacaaaagccgcatggtcgcgatactactctggtggcgcttggcggcggcgtagtgggtgatctgaccggcttcgcggcggcgagttatcagcgcggtgtacgtttcattcaagtcccgacgacgttactgtcgcaggtcgattcctccgttggcggcaaaactgcggtcaaccatcccctcggtaaaaacatgattggcgcgttctaccagcccgcttcagtggtggtggatctcgactgtctgaaaacgcttcccccgcgtgagttagcgtcggggctggcagaagtcatcaaatacggcattattcttgacggtgcgttttttaactggctggaagagaatctggatgcgttgttgcgtctggacggtccggcaatggcgtactgtattcgccgttgttgtgagctgaaagcagaagttgtcgccgccgacgagcgcgaaaccgggttacgtgctttactgaatctgggacacacctttggtcatgccattgaagctgaaatggggtatggcaattggttacatggtgaagcggtcgctgcgggtatggtgatggcggcgcggacgtcggaacgtctcgggcagtttagttctgccgaaacgcagcgtattataaccctgctcacgcgggctgggttaccggtcaatgggccgcgcgaaatgtccgcgcaggcgtatttaccgcatatgctgcgtgacaagaaagtccttgcgggagagatgcgcttaattcttccgttggcaattggtaagagtgaagttcgcagcggcgtttcgcacgagcttgttcttaacgccattgccgattgtcaatcagcgtaa

SEQ ID NO: 7904 - protein, 362 aa, Escherichia coli
MERIVVTLGERSYPITIASGLFNEPASFLPLKSGEQVMLVTNETLAPLYLDKVRGVLEQAGVNVDSVILPDGEQYKSLAVLDTVFTALLQKPHGRDTTLVALGGGVVGDLTGFAAASYQRGVRFIQVPTTLLSQVDSSVGGKTAVNHPLGKNMIGAFYQPASVVVDLDCLKTLPPRELASGLAEVIKYGIILDGAFFNWLEENLDALLRLDGPAMAYCIRRCCELKAEVVAADERETGLRALLNLGHTFGHAIEAEMGYGNWLHGEAVAAGMVMAARTSERLGQFSSAETQRIITLLTRAGLPVNGPREMSAQAYLPHMLRDKKVLAGEMRLILPLAIGKSEVRSGVSHELVLNAIADCQSA

SEQ ID NO: 7905 - DNA, 723 bp, Escherichia coli
gtggtagcaaggcagcgcgcttgcagcgaccagatatgcagagggatgggtgatttattcagttgccaaacccgctggagtattgagataattttcagtctgactctcgcaatatcttatgaggtttcagttcatgtcctgcggcgctctctgagcgaagcgggtttatcattaacgaatagtcttagtagtaccgaaaaaatggcagagaaacgcaatatctttctggttgggcctatgggtgccggaaaaagcactattgggcgccagttagctcaacaactcaatatggaattttacgattccgatcaagagattgagaaacgaaccggagctgatgtgggctgggttttcgatttagaaggcgaagaaggcttccgcgatcgcgaagaaaaggtcatcaatgagttgaccgagaaacagggtattgtgctggctactggcggcggctctgtgaaatcccgtgaaacgcgtaaccgtctttccgctcgtggcgttgtcgtttatcttgaaacgaccatcgaaaagcaacttgcacgcacgcagcgtgataaaaaacgcccgttgctgcacgttgaaacaccgccgcgtgaagttctggaagcgttggccaatgaacgcaatccgctgtatgaagagattgccgacgtgaccattcgtactgatgatcaaagcgctaaagtggttgcaaaccagattattcacatgctggaaagcaactaa

SEQ ID NO: 7906 - protein, 240 aa, Escherichia coli
MVARQRACSDQICRGMGDLFSCQTRWSIEIIFSLTLAISYEVSVHVLRRSLSEAGLSLTNSLSSTEKMAEKRNIFLVGPMGAGKSTIGRQLAQQLNMEFYDSDQEIEKRTGADVGWVFDLEGEEGFRDREEKVINELTEKQGIVLATGGGSVKSRETRNRLSARGVVVYLETTIEKQLARTQRDKKRPLLHVETPPREVLEALANERNPLYEEIADVTIRTDDQSAKVVANQIIHMLESN

SEQ ID NO: 7907 - DNA, 1068 bp, Escherichia coli
gtgtcgttacatttaactgacgttccctggaagcaggcactacaaactgtagtgaaaagcgccggattgataacgcgccaggagggcaacattctctcggtgcattccgttgcctggcagaatgacaatatcgcccgccaggaggcggagcagacgcgggcgcaggcaaatctgccgctggaaaatcgcaatattactctgcaatacgccgacgccggagagctggcgaaagcgggggagaagctactgagtgccaaagggagtatgaccgtcgataaacgcaccaatcgccttttgctgcgagataacaaaacggcgttaagcacgcttgaacagtgggtatcgcaaatggatctgccggtcgggcaggttgagctctcggcgcatattgtcaccattaatgaaaaaagtttgcgtgagttaggtgtgaaatggacgctggccgatgcgcaacaagctggtggcgttgggcaagtcaccacgcttggcagcgacctctccgtagcgacggcgacaacgcatatcggttttaacattggacgcatcaacggacgtttactggatcttgagctttccgcgctcgaacaaaaacagcagctggatattatcgccagtccgcgtctgctggcctcacatcttcagcctgccagcattaaacaggggagcgaaattccatatcaggtttccagcggggaaagtggcgcgacgtcggtggaatttaaagaggccgtcctggggatggaagtcacgcccacggtgttacaaaaaggtcgcatccggctgaaattacacatcagccagaacgttccggggcaggtgctacagcaggcagatggcgaagtgctggcgattgataagcaggagatcgaaacgcaggtcgaggtcaaaagcggagaaacgttggcgctgggcggcatttttacccgtaaaaataaatcgggtcaggatagcgtaccgttgcttggcgacattccctggttcgggcaattatttcgtcatgacggaaaagaagatgaacgacgcgagttagtggtgtttatcacgccacgactggtttccagtgagtaa

SEQ ID NO: 7908 - protein, 355 aa, Escherichia coli
MSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 7909 - DNA, 405 bp, Escherichia coli
atgagggttaaacgctggttgttggcaggcattgcattgtgccttttaaccggtatgcgtgacccttttaaaccgccggaagatctatgccggattagcgaacttagccagtggcgctatcaggggatggtagggagaggcgagcgcatcatcggtgtaataaaagatgggcaaaaaaaatggcgacgggtgcagcaaaacgatgtgctggaaaacggctggacgatcttacagctgacgccagacgcactaacgctgggaaccgggacaaactgcgaaccgccacactggttgtggcaacggcaaggagatacaaatgaagcaatggatagccgcactactgttgatgcttatacccggcgtacaggcggcaaagccgcaaaaagtgacgctgatggtggatga

SEQ ID NO: 7910 - protein, 134 aa, Escherichia coli
MRVKRWLLAGIALCLLTGMRDPFKPPEDLCRISELSQWRYQGMVGRGERIIGVIKDGQKKWRRVQQNDVLENGWTILQLTPDALTLGTGTNCEPPHWLWQRQGDTNEAMDSRTTVDAYTRRTGGKAAKSDADGG

SEQ ID NO: 7911 - DNA, 441 bp, Escherichia coli
atgaacatgttctttgactggtggttcgccacatcactccgcctccgccagttttgctgggcagtctggttgctggtgttagttacgctcatttttctgtcattgacacaccatgaagagagcgatgcattaattcgactacgggcaaatcatcaccagcagtgggctgcactgtatcgcctggtagacaccacttccttcagcgaagaaaaaacgctgcccttttcgccactggattttcagttatccggcgcgcaactggtttactggcatccatccgcgcagggaggtgagttggcgttgaaaacgctgtgggaagcagtgccgtcggcatttacacggctggcagagcgcaacgtcagcgtgagccgttttttgttaagcgtggaaggtgatgaccttttgttcacgctacaactggagacgccgcatgagggttaa

SEQ ID NO: 7912 - protein, 146 aa, Escherichia coli
MNMFFDWWFATSLRLRQFCWAVWLLVLVTLIFLSLTHHEESDALIRLRANHHQQWAALYRLVDTTSFSEEKTLPFSPLDFQLSGAQLVYWHPSAQGGELALKTLWEAVPSAFTRLAERNVSVSRFLLSVEGDDLLFTLQLETPHEG

SEQ ID NO: 7913 - DNA, 540 bp, Escherichia coli
atgaacccgccaattaattttttgccctggcgacagcaacgccggaccgcttttcttcgtttctggttgctgatgttcgttgcgcctttgctgctggccgtcgggataacgctaatactgcgtctgacaagcaatgccgaagcacgcgtaaacgccgttttgcttcaggcggaacaacaactcgcccgcagcttacagataacgaaaccacgtttgctggaacgccagcagttacgcgaacagcgtttgcaacgtcagcgccagcgacaatttacccgcgactggcaatctgcgctggaagcactggcggcgcttttacccgaacatgcctggctgacaacgataagctggcagcagggaacgctggagatcaaggggctgacaacaagcattaccgcgttaaacgcactagaaacgtcactacgccaggatgcttcttttcatctcaatcagcggggggccacgcagcaggatgcgcagggacgctggcaatttgagtatcagttaacaaggaaggttagcgatgaacatgttctttga

SEQ ID NO: 7914 - protein, 179 aa, Escherichia coli
MNPPINFLPWRQQRRTAFLRFWLLMFVAPLLLAVGITLILRLTSNAEARVNAVLLQAEQQLARSLQITKPRLLERQQLREQRLQRQRQRQFTRDWQSALEALAALLPEHAWLTTISWQQGTLEIKGLTTSITALNALETSLRQDASFHLNQRGATQQDAQGRWQFEYQLTRKVSDEHVL

SEQ ID NO: 7915 - DNA, 780 bp, Escherichia coli
atggcatttaagaactggcaaattggtttgcatttacaacagcaagaagcggtagcggttgctatcgtgcggagcgcaaaagaatgcttattgcaccgctggtggcggttgccactggagaacgacattatcaaagatgggcggattgttgatgtgcagcggctggctaacacgttgttaccgtggagtcgtgaactgccgcagcgtcatcacattatgttggcgtttcccgccagtcgcacattacagcggtcatttccacgcccgtcgatgtccctcggtgagcgggagcaaatggcctggctgtccgggacgatggcccgtgaactggatatggatccggactccctgcgcttcgattacagcgaagacgcactcagtcccgcctataacgtgactgccgcgcaaagcaaagagctggcaacgctgcttactctggcagaaaggttgcgtgttcatgttagcgcgatcactccggatgccagtgcattacagcgattcctgccttttttaccttctcatcagcaatgtctggcctggcgtgataacgaacagtggctgtgggcgacgcgctatagctgggggcgcaaactggcggtggggatgactagcgcgaaggagctggcggcagcgttatctgttgatcccgaaagcgtcgcgctatgtggcgaaggcggatttgacccctgggaggcggtttctgttcgtcagccgccgctaccgccaccaggtggagactttgccatcgcgctggggctggcgcttgggaaggtgtactga

SEQ ID NO: 7916 - protein, 259 aa, Escherichia coli
MAFKNWQIGLHLQQQEAVAVAIVRSAKECLLHRWWRLPLENDIIKDGRIVDVQRLANTLLPWSRELPQRHHIMLAFPASRTLQRSFPRPSMSLGEREQMAWLSGTMARELDMDPDSLRFDYSEDALSPAYNVTAAQSKELATLLTLAERLRVHVSAITPDASALQRFLPFLPSHQQCLAWRDNEQWLWATRYSWGRKLAVGMTSAKELAAALSVDPESVALCGEGGFDPWEAVSVRQPPLPPPGGDFAIALGLALGKVY

SEQ ID NO: 7917 - DNA, 2553 bp, Escherichia coli
gtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccgccggagatggtgaaagcctttatcgcgacggaagatagccgcttctacgagcatcacggcgttgacccggtggggatcttccgtgcggcaagcgtggcgctgttctccggtcacgcgtcacaaggggcgagtactattacccagcagctggcgagaaacttcttcctcagtccagaacgcacgctgatgcgcaagattaaggaagtcttcctcgcgattcgcattgaacagttgctgacgaaagacgagatcctcgagctttatctgaacaagatttacctcggttaccgcgcctatggtgtcggtgctgcggcacaagtctatttcggtaaaacggtcgaccaactgacgttgaacgaaatggcggtgatagccgggctgccgaaagcgccttccaccttcaacccgctctactcaatggatcgtgccgtcgcgcggcgtaacgtcgtgctgtcgcggatgctggatgaaggatatatcacccaacaacagttcgatcagacacgcactgaggcgattaacgctaactatcacgcgccggagattgctttctctgcgccatacctgagcgaaatggtgcgccaggagatgtataaccgttatggcgaaagtgcctatgaagacggttatcgcatttacaccaccatcacccgcaaagtgcagcaggccgcacagcaggcggtacgtaataacgtgctggactacgacatgcgccacggctatcgcggcccggcaaatgtgctgtggaaagtgggcgaatcggcgtgggacaacaacaaaattaccgatacgctgaaggcgctgccgacctatggtccgctgctgcctgccgcagtcaccagcgccaatcctcaggaagcaacggcgatgctggcagacgggtcgaccgtcgtattgagtatggaaggtgttcgctgggcgcgtccttaccgttcggatactcagcagggaccgacgccgcgtaaagtgaccgatgttctgcaaacgggtcagcaaatctgggttcgtcaagttgacgatgcatggtggctggcgcaagtgccggaagtgaactcggcgctggtgtcgatcaatccgcaaaacggtgccgttatggcgctggtcggtggctttgatttcaatcagagcaagtttaaccgcgccacccaggcactgcgtcaggtgggttccaacatcaaaccgttcctctacaccgcggcgatggataaaggtctaacgctggcaagtatgttgaacgatgtgccaatttcccgctgggatgcaggtgccggttctgactggcagccgaagaactcaccaccgcaatatgccggtccaattcgcttacgtcaggggctgggtcagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcttccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtaccaatgccgcagctggagcaggcaaatcaggcgttagtggcgaagactggcgcgcaggagtacgcaccgcacgtcatcaacacaccgctggcattcctgattaagagtgccttgaacaccaatatttttggtgaaccaggctggcagggtactggctggcgagcaggtcgtgatttacaacggcatgatataggcggaaaaacgggtaccactaacagttcgaaagatgcgtggttctcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggaacagccgctgacgccgccaccgggtattgtgacggtgaatatcgatcgcagcaccgggcaattagctaatggtggcaacagccgcgaagagtatttcatcgaaggtacgcagccgacacaacaggcggtgcacgaggtgggaacgaccattatcgataatggcgaggcacaggaattgttctga

SEQ ID NO: 7918 - protein, 850 aa, Escherichia coli
MKFVKYFLILAVCCILLGAGSIYGLYRYIEPQLPDVATLKDVRLQIPMQIYSADGELIAQYGEKRRIPVTLDQIPPEMVKAFIATEDSRFYEHHGVDPVGIFRAASVALFSGHASQGASTITQQLARNFFLSPERTLMRKIKEVFLAIRIEQLLTKDEILELYLNKIYLGYRAYGVGAAAQVYFGKTVDQLTLNEMAVIAGLPKAPSTFNPLYSMDRAVARRNVVLSRMLDEGYITQQQFDQTRTEAINANYHAPEIAFSAPYLSEMVRQEMYNRYGESAYEDGYRIYTTITRKVQQAAQQAVRNNVLDYDMRHGYRGPANVLWKVGESAWDNNKITDTLKALPTYGPLLPAAVTSANPQEATAMLADGSTVVLSMEGVRWARPYRSDTQQGPTPRKVTDVLQTGQQIWVRQVDDAWWLAQVPEVNSALVSINPQNGAVMALVGGFDFNQSKFNRATQALRQVGSNIKPFLYTAAMDKGLTLASMLNDVPISRWDAGAGSDWQPKNSPPQYAGPIRLRQGLGQSKNVVMVRAMRAMGVDYAAEYLQRFGFPAQNIVHTESLALGSASFTPMQVARGYAVMANGGFLVDPWFISKIENDQGGVIFEAKPKVACPECDIPVIYGDTQKSNVLENNDVEDVAISREQQNVSVPMPQLEQANQALVAKTGAQEYAPHVINTPLAFLIKSALNTNIFGEPGWQGTGWRAGRDLQRHDIGGKTGTTNSSKDAWFSGYGPGVVTSVWIGFDDHRRNLGHTTASGAIKDQISGYEGGAKSAQPAWDAYMKAVLEGVPEQPLTPPPGIVTVNIDRSTGQLANGGNSREEYFIEGTQPTQQAVHEVGTTIIDNGEAQELF

SEQ ID NO: 7919 - DNA, 561 bp, Escherichia coli
atgagcaaatcattacaaaaacccaccattctgaatgttgaaactgtagcccgttcccgactgtttaccgtcgaaagcgtggatctggagttcagcaatggcgtgcggcgtgtttatgaacgaatgcgtccaaccaaccgggaagcagtgatgattgtgccgattgtggacgatcacctgatcctgatccgcgaatacgcagtgggaactgaatcctacgaattaggtttttcgaaaggattaattgatccgggtgaaagcgtctttgaagccgctaaccgcgagctaaaagaagaggttggatttggtgcgaacgatctgacttttttgaagaagctcagcatggcaccgtcttacttttccagcaaaatgaatatcgtggtagcgcaagatctctacccggaatcactggaaggcgatgagccagagccgttaccacaggtgcgctggccgctggcgcatatgatggatttgctggaagcccctgacttcaacgaagcgcgtaatgtcagcgcgctgttcctcgtgcgcgaatggttgaaagggcaggggcgagtgtaa

SEQ ID NO: 7920 - protein, 186 aa, Escherichia coli
MSKSLQKPTILNVETVARSRLFTVESVDLEFSNGVRRVYERMRPTNREAVMIVPIVDDHLILIREYAVGTESYELGFSKGLIDPGESVFEAANRELKEEVGFGANDLTFLKKLSMAPSYFSSKMNIVVAQDLYPESLEGDEPEPLPQVRWPLAHMMDLLEAPDFNEARNVSALFLVREWLKGQGRV

SEQ ID NO: 7921 - DNA, 2136 bp, Escherichia coli
atgagcaccattgtgatttttttagctgctttgctggcctgctcactacttgcgggatggctgataaaagtgcgatccagacggcgtcagctgccctggaccaacgccttcgtggatgcgcaaacgcgtaaactcacatctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttatggcatctctaccgacgatccgaataaatggcgttactacctcgattcggtagaagtccacctgccgcctttctgggaacagtacatcaacgatgagaataccgttgaactgattcataccgattcgctgccgctggttatttcactcaacggtcatacgctgcaggagtacatgcaggaaattcgcggctatgccttgcaacctgttccgtcaacgcaggcgtcgattcgcggggaagagagcgagcaaatagaactgctcaatattcgcaaagaaacgcacgaagagtatgcgctgagtcgtccgcgcgggctgcgcgaagcgttgctgattgtcgcctccttcctgatgttctttttctgcctgattaccccggatgtctttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatcttggtcaacaaaccgatatcgatatctatctcgaccgccacgtagtgcgtcaggggcgatatctttcgctgcatgatgaagtaaaaaactttccgttacagcactggctgcgcagtacgattattgctgcgggctcgctattggtgctgtttatgctgttattctggatcccgctggatatgccgctgaaattcaccctctcgtggatgaaaggcgcgcagaccattgaagccaccagcgtgaaacaactggctgacgctggcgtgcgggttggcgatacattgcgtattagcggtacgggaatgtgtaatattcgcacttccggtacctggagcgcgaaaaccaactcaccttttttaccgtttgactgctcgcagatcatctggaatgacgcccgctcattgccattaccagaatctgaattggtcaacaaagcgacggcattgaccgaagcagttaatcgccagctgcaccctaaaccggaagatgaatctcgcgtcagtgcctcattacgttcagcaattcaaaaatccggtatggtattgcttgatgattttggcgacattgttctgaagacagcagatctgtgttctgccaaagatgactgtgtgcgactgaaaaatgcgctggtcaatctcggcaacagtaaagactgggacgcgctggtaaaacgcgccaacgccgggaaactcgatggcgtgaatgtgttattacgcccggtgagtgcggaatcgctggataacctggtggccacctctaccgcgccgtttatcacgcatgaaacggcgcgagcggcacaatcactaaacagtccggcccccggcgggttcctgattgtcagcgacgaaggcagcgattttgttgatcagccctggccttcggcatcactttacgactatccgccgcaagaacagtggaacgctttccagaaactggcacaaatgctgatgcatacgccgtttaacgccgaaggtatcgtcacaaaaatcttcactgacgccaatggtacgcagcatattggccttcatccgatcccggatcgttccggcctgtggcgctatctcagcaccacgctgctgctactgacgatgctgggtagcgccatttataatggcgtacaggcctggcgtcgttaccagcgccatcgtactcgcatgatgaagattcaggcctattatgaaagctgcctgaacccgcaactgatcaccccttcagaaagccttatcgaataa

SEQ ID NO: 7922 - protein, 711 aa, Escherichia coli
MSTIVIFLAALLACSLLAGWLIKVRSRRRQLPWTNAFVDAQTRKLTSEERSAVENYLESLTQVLQVPGPTGASAAPISLALNAESNNVMMLTHAITRYGISTDDPNKWRYYLDSVEVHLPPFWEQYINDENTVELIHTDSLPLVISLNGHTLQEYMQEIRGYALQPVPSTQASIRGEESEQIELLNIRKETHEEYALSRPRGLREALLIVASFLMFFFCLITPDVFVPWLAGGALLLLGAGLWGLFAPPAKSSLREIHCLRGTPRRWGLFGENDQEQINNISLGIIDLVYPAHWQPYIAQDLGQQTDIDIYLDRHVVRQGRYLSLHDEVKNFPLQHWLRSTIIAAGSLLVLFMLLFWIPLDMPLKFTLSWMKGAQTIEATSVKQLADAGVRVGDTLRISGTGMCNIRTSGTWSAKTNSPFLPFDCSQIIWNDARSLPLPESELVNKATALTEAVNRQLHPKPEDESRVSASLRSAIQKSGMVLLDDFGDIVLKTADLCSAKDDCVRLKNALVNLGNSKDWDALVKRANAGKLDGVNVLLRPVSAESLDNLVATSTAPFITHETARAAQSLNSPAPGGFLIVSDEGSDFVDQPWPSASLYDYPPQEQWNAFQKLAQMLMHTPFNAEGIVTKIFTDANGTQHIGLHPIPDRSGLWRYLSTTLLLLTMLGSAIYNGVQAWRRYQRHRTRMMKIQAYYESCLNPQLITPSESLIE

SEQ ID NO: 7923 - DNA, 669 bp, Escherichia coli
atgcatatcaacattgcctggcaggacgtagataccgttctgctggatatggacggcacgttgcttgacctcgccttcgataactatttctggcaaaagctggtgcctgaaacatggggcgcgaaaaacggagttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaaacagcgaattttgctcaccaatgcgcatccgcacaacctggcggtaaaacttgagcataccggtctggacgcacaccttgatttattactttccacccacacatttggttatccgaaagaggatcagcggttatggcatgcggtggccgaagctacgggtcttaaagctgaaagaacgctgtttattgatgacagcgaagcgattctcgatgctgccgcgcaatttggtattcgttactgcctcggtgtgactaatcctgactccgggattgccgagaaacagtatcaacgccatccgtcactgaatgactaccgccgcctgatcccctcgctaatgtga

SEQ ID NO: 7924 - protein, 222 aa, Escherichia coli
MHINIAWQDVDTVLLDMDGTLLDLAFDNYFWQKLVPETWGAKNGVTPQEAMEYMRQQYHDVQHTLNWYCLDYWSEQLGLDICAMTTEMGPRAVLREDTIPFLEALKASGKQRILLTNAHPHNLAVKLEHTGLDAHLDLLLSTHTFGYPKEDQRLWHAVAEATGLKAERTLFIDDSEAILDAAAQFGIRYCLGVTNPDSGIAEKQYQRHPSLNDYRRLIPSLM

SEQ ID NO: 7925 - DNA, 402 bp, Escherichia coli
atgaaagaaaaacctgctgttgaggttcgactggataaatggctatgggctgcccgtttttataaaacccgcgcgctggcccgtgaaatgattgaaggcggtaaggtgcattacaacgggcagcgcagcaagccaagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcatccggaccgacgcccggacaaaaaagagcgccgcgacctgttacgatttaaacacggcgacagtgaataa

SEQ ID NO: 7926 - protein, 133 aa, Escherichia coli
MKEKPAVEVRLDKWLWAARFYKTRALAREMIEGGKVHYNGQRSKPSKIVELNATLTLRQGNDERTVIVKAITEQRRPASEAALLYEETAESVEKREKMALARKLNALTMPHPDRRPDKKERRDLLRFKHGDSE

SEQ ID NO: 7927 - DNA, 879 bp, Escherichia coli
atgccgcaacatgaccaattacatcgctatctgtttgaaaactttgccgttcgcggcgaactggtaaccgtttcggaaaccctgcaacagatccttgagaatcacgattatccgcagcccgttaaaaacgtgctggcagaactgctggttgcgaccagcctgttaaccgctacgttgaagtttgatggtgatatcaccgtacagctgcaaggcgacggtccgatgaatctggcggttattaacggtaacaacaaccagcagatgcgcggtgtggcgcgcgtgcagggcgaaattccagaaaatgccgacctgaaaacgctggtcggcaatggttacgtggtgatcaccatcactccgagcgaaggcgaacgctatcagggcgtggttggtctggaaggtgataccctggcggcctgcctggaagattactttatgcgttctgaacagctgccgacgcgcctgtttattcgcaccggcgacgtagacggcaaaccggctgcaggcggaatgttgttgcaggtaatgcctgcgcaaaatgcccagcaggacgactttgaccacctggcgacgctaaccgaaaccatcaaaaccgaagaactgctgactttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagtcgatagcatcctggcggaagatggcgaaattgacatgcattgtgattactgcggtaaccactatctgttcaatgcgatggatattgccgagatccgcaacaacgcgtctccggcagatccgcaagttcattaa

SEQ ID NO: 7928 - protein, 292 aa, Escherichia coli
MPQHDQLHRYLFENFAVRGELVTVSETLQQILENHDYPQPVKNVLAELLVATSLLTATLKFDGDITVQLQGDGPMNLAVINGNNNQQMRGVARVQGEIPENADLKTLVGNGYVVITITPSEGERYQGVVGLEGDTLAACLEDYFMRSEQLPTRLFIRTGDVDGKPAAGGMLLQVMPAQNAQQDDFDHLATLTETIKTEELLTLPANEVLWRLYHEEEVTVYDPQDVEFKCTCSRERCADALKTLPDEEVDSILAEDGEIDMHCDYCGNHYLFNAMDIAEIRNNASPADPQVH

SEQ ID NO: 7929 - DNA, 1659 bp, Escherichia coli
gtggtttgctacctgctgatcgcctggcttgccggaaaaaatctcagttggattgtttatggcgtgcctgcgaccgtcgcgttttcatccgttttactcttctccgtgatctcctttaaacagaatcgcctttggggatggctggcgctggtgtttattgccacgctgggaatgagcggctggctgaagtggcaaactgatggcatgaccccctggagagctgaaaaggcgctttgggattttggctgctatctgctgctgatggcaatgttgttgctaccgtggatacaacaaagccttcgcatccgcaatgacagtagccgctatcgctacttttaccagtcagtatggcataacgtacttatattactggtgatttttctcgccaatggcctgacgtggctggtgcttttactgtggagtgagttgtttaaacttgttggcatcacgtttttcaaaacgctcttttttgcaaccgactggtttatttatctcacgttaggtctggttaccgcgctggcggtgatcctcgcgcgaacacagtcacgtttaatcgactctattcaaaagttgttcacgttaatcgccacggggttgctgccgttagtatcattgctaaccctgatgtttattatcaccctgccgtttacgggcctgagcgcgatttctcgccacatctccgccgctgggttgctgttaacgctggcctttttgcaattgatcttaatggctattgtcctcgatccgcaaaaagcgtcacttccctggacggggccattgcgttgcctgattaaaaccgctttgctggttgctccgctgtatgtgttcgccgccgcctgggcgctatggctgcgggtcgctcagtacggctggactgccgaccgcttgcagggcgcgctggcggtgctggtgttactggtatggtcgctggggtattttgtcagtatcgtctggcgtaaagggcaaaatccccttgatcttcagggcaaagtgaaccttgtggtttcgttattggtgttggtaatactggtgcttcttaattcgccggtgctggacagtatgcgcattagcgtgaacagtcatatggcgcgttatcagagcggcaaaaacacgccagaccaggtaactatctacatgctcgaacagagcggtcgctatggacgtgcggcgcttgagtcgctgaaaagcgatgccgagtatatgaaagacccgaaacgcgcgcgggatctgctgatggcgttagatggagagcaacatcttcaggaacaggtatcggaaaaagtattagccgataatgtgttaattgccccaggttctggtaaaccggatgcgacattctggtcggccttaatccaggatcgctataacgtgatgacctgtattgaaaaagacgcctgcgtactggtcgagcaagatctgaatagtgatggtcaggcggagcggatcctgtttgcttttaatgatgacagagtcattgtctatggctttgactcagccagaaaagaatgggacgcgcttgatatgagtttacttccgcgccaaataacgaaagaaaaattactcgctgctgcgaaggatggaaagctggggacgaggcctaaagcgtggcgcgatcttgtagtggatggtgaaaggctggatgtgaatctgaatgagtga

SEQ ID NO: 7930 - protein, 552 aa, Escherichia coli
MVCYLLIAWLAGKNLSWIVYGVPATVAFSSVLLFSVISFKQNRLWGWLALVFIATLGMSGWLKWQTDGMTPWRAEKALWDFGCYLLLMAMLLLPWIQQSLRIRNDSSRYRYFYQSVWHNVLILLVIFLANGLTWLVLLLWSELFKLVGITFFKTLFFATDWFIYLTLGLVTALAVILARTQSRLIDSIQKLFTLIATGLLPLVSLLTLMFIITLPFTGLSAISRHISAAGLLLTLAFLQLILMAIVLDPQKASLPWTGPLRCLIKTALLVAPLYVFAAAWALWLRVAQYGWTADRLQGALAVLVLLVWSLGYFVSIVWRKGQNPLDLQGKVNLVVSLLVLVILVLLNSPVLDSMRISVNSHMARYQSGKNTPDQVTIYMLEQSGRYGRAALESLKSDAEYMKDPKRARDLLMALDGEQHLQEQVSEKVLADNVLIAPGSGKPDATFWSALIQDRYNVMTCIEKDACVLVEQDLNSDGQAERILFAFNDDRVIVYGFDSARKEWDALDMSLLPRQITKEKLLAAAKDGKLGTRPKAWRDLVVDGERLDVNLNE

SEQ ID NO: 7931 - DNA, 1623 bp, Escherichia coli
atgcgcgttaacaatggtttgaccccgcaagaactcgaggcttatggtatcagtgacgtacatgatatcgtttacaacccaagctacgatctgctgtatcaggaagagctggacccgagcctgaccggttatgagcgcggggtgttaactaatctgggtgccgttgccgtcgataccgggatcttcaccggtcgttcaccaaaagataagtatatcgttcgtgacgataccactcgcgatactttctggtgggcagacaaaggcaaaggtaagaacgacaacaaacctctctctccggaaacctggcagcatctgaaaggcctggtgaccaaacagctttccggcaaacgtctgttcgttgtcgacgccttctgtggtgcgaacccggatactcgtctttccgtccgtttcatcaccgaagtggcctggcaggcgcattttgtcaaaaacatgtttattcgcccgagcgatgaagagctggcaggtttcaaaccagactttatcgttatgaacggcgcgaagtgcactaacccgcagtggaaagaacagggtctgaactccgaaaacttcgtggcgtttaacctgaccgagcgcatgcagctgattggcggcacctggtacggcggcgaaatgaagaaagggatgttctcaatgatgaactacctgctgccgctgaaaggtatcgcttctatgcactgctccgccaacgttggcgagaaaggcgatgttgcggtgttcttcggcctttccggcaccggtaaaaccaccctttccaccgacccgaaacgtcgcctgattggcgatgacgagcacggctgggacgatgacggcgtgtttaactttgaaggcggctgctacgcaaaaactatcaagctgtcgaaagaagcggaacctgaaatctacaacgctatccgtcgtgatgcgctgctggaaaacgtcaccgtgcgtgaagatggcactatcgactttgatgatggttcaaaaaccgagaacacccgcgtttcttatccgatctatcacatcgaaaacatcgttaagccggtgtccaaagcgggccacgcaacgaaagttatcttcctgaccgcagacgcctttggtgtgctgccgccggtttctcgtctgactgccgatcaaacccagtaccacttcctctctggcttcaccgccaaactggctggtacagagcgcggcatcaccgaaccgacgccaactttctccgcctgcttcggcgcggcattcctgtcgctgcacccgactcagtacgcagaagtgctggtgaaacgtatgcaggcggcaggcgcgcaggcgtatctggttaacaccggctggaacggcactggcaaacgtatctccattaaagatacccgcgccattatcgacgccatcctcaacggttcgctggataacgcagaaaccttcactctgccgatgtttaacctggcgatcccaaccgaactgccgggcgtagacacgaagattctcgatccgcgtaacacctacgcttctccggaacagtggcaggaaaaagccgaaacgctggcaaaactgtttatcgacaacttcgataaatacaccgacaccccagcgggtgccgcgctggtagcggctggtccgaagctgtaa

SEQ ID NO: 7932 - protein, 540 aa, Escherichia coli
MRVNNGLTPQELEAYGISDVHDIVYNPSYDLLYQEELDPSLTGYERGVLTNLGAVAVDTGIFTGRSPKDKYIVRDDTTRDTFWWADKGKGKNDNKPLSPETWQHLKGLVTKQLSGKRLFVVDAFCGANPDTRLSVRFITEVAWQAHFVKNMFIRPSDEELAGFKPDFIVMNGAKCTNPQWKEQGLNSENFVAFNLTERMQLIGGTWYGGEMKKGMFSMMNYLLPLKGIASMHCSANVGEKGDVAVFFGLSGTGKTTLSTDPKRRLIGDDEHGWDDDGVFNFEGGCYAKTIKLSKEAEPEIYNAIRRDALLENVTVREDGTIDFDDGSKTENTRVSYPIYHIENIVKPVSKAGHATKVIFLTADAFGVLPPVSRLTADQTQYHFLSGFTAKLAGTERGITEPTPTFSACFGAAFLSLHPTQYAEVLVKRMQAAGAQAYLVNTGWNGTGKRISIKDTRAIIDAILNGSLDNAETFTLPMFNLAIPTELPGVDTKILDPRNTYASPEQWQEKAETLAKLFIDNFDKYTDTPAGAALVAAGPKL

SEQ ID NO: 7933 - DNA, 1344 bp, Escherichia coli
ttgcgcttctcgccacgaagttcatttgcccgtacgttattgctcatcgtcaccttgctgttcgtcagcctggtgacgacttatctggtggtgctgaacttcgcgattttgccgagcctccagcagtttaataaagtcctcgcgtacgaagtgcgtatgttgatgaccgacaaactgcaactggaggacggcacgcagttggttgtgcctcccgctttccgtcgggagatctaccgtgagctggggatctctctctattccaacgaagctgccgaagaggcaggtctgcgttgggcgcaacactatgaattcttaagccatcagatggcgcagcaactgggcggtccgacggaagttcgcgtcgaggtcaacaaaagttcgcctgtcgtctggctgaaaacctggttgtcgcccaatatctgggtacgcgtgccgctaaccgaaattcatcagggcgatttctccccgctgttccgttatacgttggcgattatgctattggcgataggcggggcgtggctgtttattcgtatccagaaccgaccattggtcgatctcgaacacgcagccttgcaggtgggtaaagggattattccgccgccgctgcgtgaatatggcgcttcggaggtgcgttccgttacccgcgcctttaaccatatggcggctggtgttaagcaactggcggatgaccgcacgctgctgatggcgggggtaagccatgatctgcgcacgccgctgacgcgtattcgcctggcaaccgagatgatgagcgagcaggatggctacctggcagaatcgatcaataaagatatcgaagagtgcaacgccatcattgagcagtttatcgactacctgcgcaccgggcaggagatgccgatggaaatggcggatctcaacgcagtactcggtgaggttattgctgccgaaagtggctatgagcgggaaattgaaaccgcgctttaccccggtagcattgaggtgaaaatgcacccgctgtcgatcaaacgcgcggtggcgaatatggtggtcaacgccgcccgttacggcaatggctggatcaaagtcagcagcggcacggagccgaatcgcgcctggttccaggtagaagatgacggtccgggtattgcgccggaacaacgtaagcacctgttccagccgtttgttcgtggcgacagtgcgcgcaccattagcggcacgggattagggctggcgattgtgcagcgtatcgtggataaccataacgggatgctggagcttggcaccagcgaacggggcgggctttccattcgcgcctggctgccagtgccggtaacgcgggcgcagggcatgacaaaagaagggtaa

SEQ ID NO: 7934 - protein, 447 aa, Escherichia coli
MRFSPRSSFARTLLLIVTLLFVSLVTTYLVVLNFAILPSLQQFNKVLAYEVRMLMTDKLQLEDGTQLVVPPAFRREIYRELGISLYSNEAAEEAGLRWAQHYEFLSHQMAQQLGGPTEVRVEVNKSSPVVWLKTWLSPNIWVRVPLTEIHQGDFSPLFRYTLAIMLLAIGGAWLFIRIQNRPLVDLEHAALQVGKGIIPPPLREYGASEVRSVTRAFNHMAAGVKQLADDRTLLMAGVSHDLRTPLTRIRLATEMMSEQDGYLAESINKDIEECNAIIEQFIDYLRTGQEMPMEMADLNAVLGEVIAAESGYEREIETALYPGSIEVKMHPLSIKRAVANMVVNAARYGNGWIKVSSGTEPNRAWFQVEDDGPGIAPEQRKHLFQPFVRGDSARTISGTGLGLAIVQRIVDNHNGMLELGTSERGGLSIRAWLPVPVTRAQGMTKEG

SEQ ID NO: 7935 - DNA, 720 bp, Escherichia coli
atgcaagagaactacaagattctggtggttgatgacgacatgcgcctgcgcgcgctgctggaacgttatctcaccgaacaaggcttccaggttcgaagcgtcgctaatgcagaacagatggatcgcctgctgactcgtgaatctttccatcttatggtactggatttgatgttacctggtgaagatggcttgtcgatttgccgacgtcttcgtagccagagcaatccgatgccgatcattatggtgacggcgaaaggggaagaagtggaccgtatcgttggcctggagattggcgctgacgattacattccaaaaccgtttaacccgcgtgaattgctggcccgcattcgtgcggtgctgcgtcgtcaggcgaacgaactgccaggcgcaccgtcacaggaagaggcggtaattgctttcggtaagttcaaacttaacctcggtacgcgcgaaatgttccgcgaagacgagccgatgccgctcaccagtggtgagtttgcggtacttaaggcgctggtcagccatccgcgtgagccgctctcccgcgataagctgatgaaccttgcccgtggtcgtgaatattccgcaatggaacgctccatcgacgtgcagatttcgcgtctgcgccgcatggtggaagaagatccggcgcatccgcgttacattcagaccgtctggggtctgggctacgtctttgtaccggacggttctaaagcatga

SEQ ID NO: 7936 - protein, 239 aa, Escherichia coli
MQENYKILVVDDDMRLRALLERYLTEQGFQVRSVANAEQMDRLLTRESFHLMVLDLMLPGEDGLSICRRLRSQSNPMPIIMVTAKGEEVDRIVGLEIGADDYIPKPFNPRELLARIRAVLRRQANELPGAPSQEEAVIAFGKFKLNLGTREMFREDEPMPLTSGEFAVLKALVSHPREPLSRDKLMNLARGREYSAMERSIDVQISRLRRMVEEDPAHPRYIQTVWGLGYVFVPDGSKA

SEQ ID NO: 7937 - DNA, 513 bp, Escherichia coli
gtgcgcattatcaaacagacaaagggaatcaacgagatgaaaacgcccctggttacccgggaagggtatgaaaaactcaaacaagagcttaattatctctggcgtgaagaacgcccggaggtcacaaagaaagtgacctgggccgcaagtctgggcgaccgcagcgaaaatgctgactatcagtataataaaaagcgcctgcgtgaaatcgaccgtcgcgtgcgctatctcactaaatgcatggaaaatctcaaaatcgtcgattactccccgcagcaggaaggcaaagtcttttttggcgcgtgggtggagattgaaaacgacgatggtgtgactcaccgtttccgtattgtcggctacgatgaaatttttggccgtaaagattacatctctatcgattccccgatggcccgcgcattgctgaaaaaagaagtcggcgatctggcggtggtgaatacccctgccggggaagcgagctggtatgttaatgctatcgagtacgtgaaaccgtaa

SEQ ID NO: 7938 - protein, 170 aa, Escherichia coli
MRIIKQTKGINEMKTPLVTREGYEKLKQELNYLWREERPEVTKKVTWAASLGDRSENADYQYNKKRLREIDRRVRYLTKCMENLKIVDYSPQQEGKVFFGAWVEIENDDGVTHRFRIVGYDEIFGRKDYISIDSPMARALLKKEVGDLAVVNTPAGEASWYVNAIEYVKP

SEQ ID NO: 7939 - DNA, 2322 bp, Escherichia coli
atgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaagtccatttccgagcaaggcaaactcaccgatgatctggcgaatgccatcaacgccaccctaagcaaaaccgaactcgaagacctctacctgccctacaaacctaaacgccgcacccgtgggcaaatcgccattgaagcagggcttgagccgttggccgatctgctgtggagcgatccgtcacacacgccagaagtcgccgctgcacaatatattgatgccgataaaggcgtggcagataccaaagccgcgctggacggcgcgcgctatatcctgatggaacgttttgccgaagatgctgcgctgctggcgaaagtgcgtgattatctgtggaagaacgcgcatctggtctcaaccgtggtgagcggtaaagaagaggaaggggcaaaattccgcgactatttcgatcatcacgaaccactgtcaacggtgccttctcaccgcgcgctggcgatgttccgtggtcgtaacgaaggcatacttcagctttcgctgaatgccgatccgcagttcgaagagccgccgaaagagagctattgcgagcaaatcatcatggaacaccttggcctgcgcctgaacaatgccccggcggatagctggcgcaaaggtgtggtgagctggacgtggcgcatcaaggtgttgatgcatctggaaactgaactgatgggcaccgtgcgcgaacgcgcggaagatgaagcaatcaacgtctttgcccgtaacctgcacgatctgctgatggcggcccctgccggactgcgtgcaacgatgggcctcgatccgggtctgcgtaccggggtaaaagtggcggtagtcgatgcgacaggtaaactggtggcgaccgataccatttatccgcataccgggcaggccgcaaaagcagcgatgaccgttgctgcgctgtgtgaaaagcataacgttgaactggtggcgattggcaacggtacagcttcccgcgaaaccgaacgtttctatctcgacgtgcagaagcagttcccgaaagtgaccgcgcagaaagtgatcgtcagcgaagctggcgcgtcggtttactcggcttccgagctggcagcacaggaattcccggatctcgacgtttcgctgcgtggcgcggtgtctatcgcccgtcgtttgcaggatccgctggcagagctggtgaaaatcgatccgaaatctatcggcgtaggtcagtatcagcatgacgtcagccagacgcagctggcacgcaaactggatgcagtagtagaagactgcgtaaacgccgttggcgtcgatctcaacaccgcttctgttcctctattaacccgtgtggcgggcctgacgcgcatgatggcgcaaaacatcgtggcctggcgcgatgagaacggccagttccagaaccgtcagcaactgttaaaagtgagccgtctggggccgaaagccttcgagcagtgcgcgggcttcttgcgcattaaccacggcgataacccgctggacgcctctaccgttcacccggaagcctatccggtggtggaacgcattctggcagcaacacagcaggcactgaaagatctgatgggtaacagcagcgagctgcgtaacctgaaagcgtctgactttactgatgagaaattcggtgtgccgacagtaactgacatcatcaaagagctggaaaaaccgggtcgcgatccgcgtccggaatttaaaaccgctcagtttgctgatggcgtcgagacaatgaacgacctgcaaccgggtatgatcctcgaaggcgcggtgaccaacgtcaccaactttggcgcgtttgtcgatattggcgtgcatcaggacggcctggtccacatctcttcattgtcgaacaagtttgtggaagatccgcataccgtggtgaaagcgggcgacattgtgaaggtgaaagtgctggaagtggatcttcagcgcaaacgtatcgccctgaccatgcgtctggacgagcagcctggcgaaaccaacgcccgtcgcggcggcggtaatgaacgcccgcaaaacaaccgcccggcagccaaaccgcgtgggcgtgaagcgcagcctgccggtaacagcgcgatgatggatgcgctggcggcggcaatgggcaaaaaacgttaa

SEQ ID NO: 7940 - protein, 773 aa, Escherichia coli
MMNDSFCRIIAGEIQARPEQVDAAVRLLDEGNTVPFIARYRKEITGGLDDTQLRNLETRLSYLRELEERRQAILKSISEQGKLTDDLANAINATLSKTELEDLYLPYKPKRRTRGQIAIEAGLEPLADLLWSDPSHTPEVAAAQYIDADKGVADTKAALDGARYILMERFAEDAALLAKVRDYLWKNAHLVSTVVSGKEEEGAKFRDYFDHHEPLSTVPSHRALAMFRGRNEGILQLSLNADPQFEEPPKESYCEQIIMEHLGLRLNNAPADSWRKGVVSWTWRIKVLMHLETELMGTVRERAEDEAINVFARNLHDLLMAAPAGLRATMGLDPGLRTGVKVAVVDATGKLVATDTIYPHTGQAAKAAMTVAALCEKHNVELVAIGNGTASRETERFYLDVQKQFPKVTAQKVIVSEAGASVYSASELAAQEFPDLDVSLRGAVSIARRLQDPLAELVKIDPKSIGVGQYQHDVSQTQLARKLDAVVEDCVNAVGVDLNTASVPLLTRVAGLTRMMAQNIVAWRDENGQFQNRQQLLKVSRLGPKAFEQCAGFLRINHGDNPLDASTVHPEAYPVVERILAATQQALKDLMGNSSELRNLKASDFTDEKFGVPTVTDIIKELEKPGRDPRPEFKTAQFADGVETMNDLQPGMILEGAVTNVTNFGAFVDIGVHQDGLVHISSLSNKFVEDPHTVVKAGDIVKVKVLEVDLQRKRIALTMRLDEQPGETNARRGGGNERPQNNRPAAKPRGREAQPAGNSAMMDALAAAMGKKR

SEQ ID NO: 7941 - DNA, 228 bp, Escherichia coli
atgcaatacactccagatactgcgtggaaaattactggcttttcccgtgaaatcagcccggcatatcgccaaaaactgctttctcttggcatgttacctggctcctcttttaatgtggtgcgcgtcgctccactcggcgaccccattcatatcgaaacccgtcgtgtgagcctggtattacgcaaaaaagatctggccttattagaagtggaagcggtttcctgttaa

SEQ ID NO: 7942 - protein, 75 aa, Escherichia coli
MQYTPDTAWKITGFSREISPAYRQKLLSLGMLPGSSFNVVRVAPLGDPIHIETRRVSLVLRKKDLALLEVEAVSC

SEQ ID NO: 7943 - DNA, 2334 bp, Escherichia coli
gtgataacaacaatgaaaaaattaaccattggcttaattggtaatccaaattctggcaagacaacgttatttaaccagctcactggctcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacattttgagtggcgacgcagacctgctgattaacgtggtggatgcgtctaaccttgagcgtaacctgtacctgacgctgcaactgttggaactcggcattccctgcatcgtggcgctgaacatgctcgacattgccgagaagcaaaatattcgcattgaaattgatgctctgtcggcgcgtcttggctgcccggtgatcccgctggtttcaacccgtggtcgcggtattgaagcgctcaagctggcgattgatcgctataaagctaacgaaaatgtggaactggtgcattacgctcagccgctgctcaacgaagcagattcactggcaaaagtgatgccttccgacatcccgctgaaacaacgtcgctggctgggcctgcaaatgctggaaggcgatatctacagccgcgcctacgccggtgaagcgtcgcagcatctggatgccgccctcgcccgtctgcgtaatgagatggacgatccggcgctgcacattgccgatgcgcgttaccagtgcattgctgccatctgtgatgtggtaagcaacaccctgacggcagaacccagccgtttcaccactgcggtagataaaatcgtgctcaaccgtttcctcggtctgccgattttcctctttgtgatgtacctgatgttcttgctggctatcaacatcggcggggcgttacagccgctgtttgacgtcggctccgtagcactctttgtgcatggtattcagtggattggctacacgctccacttcccggactggctgactatcttcctcgcccaaggcctgggcggtggtattaacaccgtgctgccactggtgccgcagatcggcatgatgtacctgttcctctccttccttgaggactccggctatatggcgcgtgcggcgtttgtgatggatcgtctgatgcaggcgctgggcttgccggggaaatcctttgtaccgctgatcgttggtttcggttgtaacgtaccgtcggtaatgggcgcacgtacgcttgatgcaccgcgtgaacgtctgatgaccatcatgatggcaccgtttatgtcctgcggcgcgcgtctggctatcttcgcagtattcgcggctgccttcttcgggcagaacggtgcgctggcggtcttctcgctgtatatgctgggtatcgtaatggcggtgctgacgggcctgatgctcaagtacaccatcatgcgcggtgaagcgacgccgtttgtcatggagctgccggtctaccatgtaccacacgttaaaagcctggttatccagacctggcagcgtctgaaaggcttcgttctgcgtgctggtaaagtgattatcattgtcagcattttcctgagcgccttcaacagcttctcgctgagcggaaaaatcgtcgataacatcaacgactcggcgctggcttccgtcagccgggtgatcaccccggtcttcaagccgattggcgtacatgaagataactggcaggcaacggttggcctgtttacaggtgccatggcgaaagaagtggtggtgggtacgctcaacaccctctacaccgcagaaaatattcaggacgaagagttcaatccggcggaatttaacctcggtgaagagctgttcagtgcggtagatgaaacctggcagagcctgaaagacaccttcagccttagcgtactgatgaaccccattgaagccagcaaaggcgacggcgaaatgggtaccggggcgatgggcgtgatggatcagaaattcggtagcgcagctgccgcatacagctacctgattttcgtcctgctgtacgtaccgtgcatctcggtgatgggggctatcgcgcgtgaatcaagccgtggctggatgggcttctccatcctgtgggggctgaatattgcttactcactggcaacattgttctatcaggtcgccagctacagccagcatccaacttacagcctggtgtgcattctggcagttatcctgtttaacatcgtggttatcggtctgctgcgccgcgcgcgtagccgggtagatgtcgaactgctggcaacgcgcaaatcggtaagcagttgctgtgcggccagtaccactggcgattgccactaa

SEQ ID NO: 7944 - protein, 777 aa, Escherichia coli
MITTMKKLTIGLIGNPNSGKTTLFNQLTGSRQRVGNWAGVTVERKEGQFSTTDHQVTLVDLPGTYSLTTISSQTSLDEQIACHYILSGDADLLINVVDASNLERNLYLTLQLLELGIPCIVALNMLDIAEKQNIRIEIDALSARLGCPVIPLVSTRGRGIEALKLAIDRYKANENVELVHYAQPLLNEADSLAKVMPSDIPLKQRRWLGLQMLEGDIYSRAYAGEASQHLDAALARLRNEMDDPALHIADARYQCIAAICDVVSNTLTAEPSRFTTAVDKIVLNRFLGLPIFLFVMYLMFLLAINIGGALQPLFDVGSVALFVHGIQWIGYTLHFPDWLTIFLAQGLGGGINTVLPLVPQIGMMYLFLSFLEDSGYMARAAFVMDRLMQALGLPGKSFVPLIVGFGCNVPSVMGARTLDAPRERLMTIMMAPFMSCGARLAIFAVFAAAFFGQNGALAVFSLYMLGIVMAVLTGLMLKYTIMRGEATPFVMELPVYHVPHVKSLVIQTWQRLKGFVLRAGKVIIIVSIFLSAFNSFSLSGKIVDNINDSALASVSRVITPVFKPIGVHEDNWQATVGLFTGAMAKEVVVGTLNTLYTAENIQDEEFNPAEFNLGEELFSAVDETWQSLKDTFSLSVLMNPIEASKGDGEMGTGAMGVMDQKFGSAAAAYSYLIFVLLYVPCISVMGAIARESSRGWMGFSILWGLNIAYSLATLFYQVASYSQHPTYSLVCILAVILFNIVVIGLLRRARSRVDVELLATRKSVSSCCAASTTGDCH

SEQ ID NO: 7945 - DNA, 279 bp, Escherichia coli
gtgcggccagtaccactggcgattgccactaaggacacgacaatggcttcgctcattcaagtgcgtgatttactggcattacggggccgtatggaagcggcccagattagccagacactgaacactccgcagccaatgattaacgccatgctgaaacagctagaaagtatgggaaaagcagtgcggattcaggaagaacctgacggctgtctttccggcagttgtaaaagctgcccggaaggaaaagcctgtctgcacgaatggtgggcgttgcgttaa

SEQ ID NO: 7946 - protein, 92 aa, Escherichia coli
MRPVPLAIATKDTTMASLIQVRDLLALRGRMEAAQISQTLNTPQPMINAMLKQLESMGKAVRIQEEPDGCLSGSCKSCPEGKACLHEWWALR

SEQ ID NO: 7947 - DNA, 894 bp, Escherichia coli
atgagcaaaaagcagagttccaccccacacgatgcgctgttcaaactctttttacgccaaccggagacggcacgcgattttcttgcgtttcatttaccggcacccattcacgcgctctgtgatatgaaaaccctcaagctggagtcgagcagctttattgatgacgatctgcgtgaaagctattccgacgtgctgtggtcggtgaaaacggaacaaggaccaggatacatctattgtctgattgaacatcaaagcacctcaaacaaactgatcgcatttcgcatgatgcgctacgccattgccgcaatgcaaaatcacctggatgccggatacaaaaccttgccgatggtggtgccattgttgttttaccacggtattgaaagcccctatccctattcgctgtgttggcttgattgtttcgccgatctcaacctggcaaggcagctttatgcctctgcatttccgctgattgatgtcaccgtcatgcctgatgatgaaatcatgcagcaccgacgtatggcactgctggagttaattcaaaaacatattcgtcaacgcgacctgatggggctggtagagcaaatggcctgcttattaagtagtggatacgctaatgacagacaaatcaaagggctgtttaattacatcttgcaaaccggcgatgcggtacgttttaacgattttatcgacggcgttgccgaacattcaccgaaacacaaggagaacttaatgactattgcggaaagattgcggcaggaagggtttcagaaaggtatacgtaccaacgccctaaatattgccaaaaccatgctggacgccggagtttctcttgaggacgttctgcgatttaccagcctgacggttgaagaccttgctgaaataaatcatcaataa

SEQ ID NO: 7948 - protein, 297 aa, Escherichia coli
MSKKQSSTPHDALFKLFLRQPETARDFLAFHLPAPIHALCDMKTLKLESSSFIDDDLRESYSDVLWSVKTEQGPGYIYCLIEHQSTSNKLIAFRMMRYAIAAMQNHLDAGYKTLPMVVPLLFYHGIESPYPYSLCWLDCFADLNLARQLYASAFPLIDVTVMPDDEIMQHRRMALLELIQKHIRQRDLMGLVEQMACLLSSGYANDRQIKGLFNYILQTGDAVRFNDFIDGVAEHSPKHKENLMTIAERLRQEGFQKGIRTNALNIAKTMLDAGVSLEDVLRFTSLTVEDLAEINHQ

SEQ ID NO: 7949 - DNA, 108 bp, Escherichia coli
atggttttaatgacagatgcagaaagagaatatcttattatttacctgattggttatttattgggtcgacgcctggaagccctggatatcgccaaaagaatgctgtaa

SEQ ID NO: 7950 - protein, 35 aa, Escherichia coli
MVLMTDAEREYLIIYLIGYLLGRRLEALDIAKRML

SEQ ID NO: 7951 - DNA, 690 bp, Escherichia coli
gtgtggcgttgcattgacgaggaacttagctcgcattttacgctgcaccttgttgatctgcccggtttcgggcgcagtcggggatttggtgcgctgtcgcttgctgatatggccgaagccgtgctgcgacaggcacctgataaagccatttggttaggctggagtctgggcgggctggtggcaagccagattgcgttaacccatcccgagcgtgttcaggcgctggtcaccgtggcgtcgtcgccttgttttagtgctcgtgacgagtggccggggataaaaccggacgtgctggcgggatttcagcagcagctgagtgatgattttcagcgtacagtggagcggttcctggcgttacaaaccatgggtactgaaacggcgcgccaggatgcgcgggcgttgaagaaaaccgtactggcgttaccgatgccggaggtggacgtgctcaatggtgggctggaaatcctcaaaacggtcgatctccgtctgccgctgcaaaacgtgtccatgccgtttttgcgattgtatggctatcttgatggtctggtgccgcgcaaagtagtgccgatgctggataaactctggccgcacagcgagtcgtacattttcgccaaagcggcccatgcgccgtttatttcgcatccggtcgagtttcatcacctgctggtggcgttgaagcagagggtgtag

SEQ ID NO: 7952 - protein, 229 aa, Escherichia coli
MWRCIDEELSSHFTLHLVDLPGFGRSRGFGALSLADMAEAVLRQAPDKAIWLGWSLGGLVASQIALTHPERVQALVTVASSPCFSARDEWPGIKPDVLAGFQQQLSDDFQRTVERFLALQTMGTETARQDARALKKTVLALPMPEVDVLNGGLEILKTVDLRLPLQNVSMPFLRLYGYLDGLVPRKVVPMLDKLWPHSESYIFAKAAHAPFISHPVEFHHLLVALKQRV

SEQ ID NO: 7953 - DNA, 93 bp, Escherichia coli
gtgcagcagcacaagatgaacattcccctgacctttggtctgccaccagatgttattcatccgctattgttctcttttgacttacaaggatga

SEQ ID NO: 7954 - protein, 30 aa, Escherichia coli
MQQHKMNIPLTFGLPPDVIHPLLFSFDLQG

SEQ ID NO: 7955 - DNA, 684 bp, Escherichia coli
atgctaacagtaccgggattatgctggctatgccgaatgccgctggcgttaggtcattgggggatttgttcggtatgctcacgcgccgcccgtacagataaaacgttatgcccccaatgtggattacccgccacacactcacatcttccctgcggtcgctgcctgcaaaaaccgccgccctggcaaagactggtcacggttgccgactatgcgccgccgttaagcccgctaatccaccagcttaagttttcccggcgcagcgaaatcgccagcgccctgtcacgtctgttactattggaggtcttacacgctcgtcgcaccaccgggttgcaattgccggatcgcatcatcagcgttccgttatggcagcggcgtcactggcgtcggggatttaatcagagcgatttgctgtgtcagccgttatcacgctggttgcactgccgatgggatagcgaagccgtcacacgaacacgggccactgcgacccagcattttctcagtgcccggctacgcaaacgcaacctgaaaaatgcctttcgtcttgaattgcccgtgcaaggtcgccatatggtgattgtggatgatgtcgtcaccaccggaagtaccgtcgcagagattgcgcagttgcttttacgcaatggtgcggcgactgtccaggtctggtgcctttgtcgaaccttgtag

SEQ ID NO: 7956 - protein, 227 aa, Escherichia coli
MLTVPGLCWLCRMPLALGHWGICSVCSRAARTDKTLCPQCGLPATHSHLPCGRCLQKPPPWQRLVTVADYAPPLSPLIHQLKFSRRSEIASALSRLLLLEVLHARRTTGLQLPDRIISVPLWQRRHWRRGFNQSDLLCQPLSRWLHCRWDSEAVTRTRATATQHFLSARLRKRNLKNAFRLELPVQGRHMVIVDDVVTTGSTVAEIAQLLLRNGAATVQVWCLCRTL

SEQ ID NO: 7957 - DNA, 576 bp, Escherichia coli
atgatccgtatttccgatgctgcacaagcgcactttgccaaactgctggcaaatcaggaagaagggacacaaatccgcgtatttgtgattaaccctggcacgcctaacgctgaatgtggcgtttcttattgtccgccggacgctgtagaagccaccgacactgccctgaaatttgacctgctgaccgcgtatgttgatgagttaagcgctccttacctggaagatgcagagatcgactttgttacagaccagttgggttcccagttaacgctgaaagcgcctaacgccaaaatgcgtaaagtcgcagacgatgcaccgctgatggagcgcgtggagtatatgctgcagtcgcagatcaacccacagcttgctggtcacggtggtcgcgtttcgctgatggaaatcaccgaagacggttacgccattctgcaatttggcggcggctgtaacggttgttctatggtagatgtgacgctgaaagaagggatcgagaagcagctgctgaacgaattcccggagctgaaaggtgtgcgcgatctcaccgaacaccagcgcggcgagcactcctactactaa

SEQ ID NO: 7958 - protein, 191 aa, Escherichia coli
MIRISDAAQAHFAKLLANQEEGTQIRVFVINPGTPNAECGVSYCPPDAVEATDTALKFDLLTAYVDELSAPYLEDAEIDFVTDQLGSQLTLKAPNAKMRKVADDAPLMERVEYMLQSQINPQLAGHGGRVSLMEITEDGYAILQFGGGCNGCSMVDVTLKEGIEKQLLNEFPELKGVRDLTEHQRGEHSYY

SEQ ID NO: 7959 - DNA, 1317 bp, Escherichia coli
atgccattagtcattgttgctatcggtgtaatcttgttattactcctgatgatccgcttcaaaatgaacggcttcatcgctctcgtcctcgtggcgcttgctgttggattaatgcaaggaatgccgctggataaagttattggctccatcaaagctggtgtcggcggaacgctcggtagccttgccctgatcatgggttttggcgcaatgctgggcaaaatgctggcagactgcggtggcgcacaacgtatcgccaccacgctgattgccaaatttggtaaaaaacacatccagtgggcggtggtactgaccggttttaccgttggttttgccctgttctatgaagtgggctttgtgctgatgctgccgctggtgtttaccatcgcggcttctgcgaatattccactgctgtatgttggtgtaccaatggcagctgcactgtctgtgacccacggcttcctgccaccgcatccgggtccgactgcgattgccaccattttcaatgccgatatgggtaaaaccctgctgtacggtactattctggcaatcccgaccgtgattctcgccggtccggtttacgctcgcgtgttgaaaggtatcgataagccaattccggaaggtctctacagcgcgaaaaccttcagcgaagaagagatgccgagctttggcgtcagcgtctggacctctctggtgccggtagtactgatggcgatgcgtgcgattgccgaaatgatcctgccgaaaggtcacgctttcctgccggtagcggagttcctcggtgacccggtaatggctacgctgattgccgtgctgattgcgatgttcacctttggtctaaaccgtggtcgttcaatggatcagattaacgacacgctggtttcttccatcaaaatcattgcgatgatgctgttgatcatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgttgcggcaatcactgcgggtggtatcgcggcaccgctgattgcaacgacgggtgttagcccggagctgatggttattgcggtgggttccggtagtgtgattttctctcatgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttga

SEQ ID NO: 7960 - protein, 438 aa, Escherichia coli
MPLVIVAIGVILLLLLMIRFKMNGFIALVLVALAVGLMQGMPLDKVIGSIKAGVGGTLGSLALIMGFGAMLGKMLADCGGAQRIATTLIAKFGKKHIQWAVVLTGFTVGFALFYEVGFVLMLPLVFTIAASANIPLLYVGVPMAAALSVTHGFLPPHPGPTAIATIFNADMGKTLLYGTILAIPTVILAGPVYARVLKGIDKPIPEGLYSAKTFSEEEMPSFGVSVWTSLVPVVLMAMRAIAEMILPKGHAFLPVAEFLGDPVMATLIAVLIAMFTFGLNRGRSMDQINDTLVSSIKIIAMMLLIIGGGGAFKQVLVDSGVDKYIASMMHETNISPLLMAWSIAAVLRIALGSATVAAITAGGIAAPLIATTGVSPELMVIAVGSGSVIFSHVNDPGFWLFKEYFNLTIGETIKSWSMLETIISVCGLVGCLLLNMVI

SEQ ID NO: 7961 - DNA, 2085 bp, Escherichia coli
atggaaagcaaacgtctggataatgccgcgctggcggcgggtattagccccaattacatcaatgcccacggtaaaccgcagtcgattagcgccgaaaccaaacggcgtttgcttgacgcgatgcatcaacgtaccgccacgaaagtggcggtaacgccagtcccgaatgtcatggtttataccagcggcaaaaaaatgccgatggtggtggagggcagcggcgaatatagctggctgctgaccaccgaagaaggaacgcagtacaaaggccatgtaacggggggcaaagcgttcaatctaccgacgaagctgccggaaggttatcacacgctgacactcacccaggacgaccagcgcgcgcattgccgggtgattgtcgccccgaaacgctgttacgaaccgcaggcgttgctgaataaacaaaagctgtggggtgcctgcgttcagctttatacgctgcgatcggaaaaaaactggggtattggggattttggcgatctcaaagcgatgcttgaggatgtggcaaaacgtggcgggtcgttcatcggtctgaacccgattcatgcgctctatccggcaaatccggaaagtgccagcccgtacagcccgtcttctcgccgttggctgaatgtgatttatatcgacgttaacgcagttgaagatttccatcttagcgaagaggctcaggcctggtggcagttgccgaccacgcaacagacgctgcaacaggcgcgggatgccgactgggttgattactccacggttaccaccctaaaaatgacagcattacgaatggcgtggaaaggtttcgcgcaacgtgatgatgagcagatgactgcgtttcgccagtttgttgcagagcagggcgacagcctgttctggcaggcagcctttgatgcgctacatgcccagcaagtgaaagaggacgaaatgcgctggggctggccagcatggccagagatgtatcagaacgtggattcaccagaagtgcgccagttctgcgaagaacatcgtgatgacgtcgatttttatctctggttgcagtggctggcttacagccagtttgccgcctgctgggagataagccagggctatgaaatgccgattggcttgtatcgtgatctggccgttggtgtagcagaaggtggggcagaaacctggtgcgaccgtgaactgtattgcctgaaagcgtcggttggcgcgccgccggatatcctcggcccgttggggcagaactggggattgccgccaatggacccgcatatcatcaccgcgcgtgcctatgaaccgtttatcgagctgttgcgtgccaatatgcaaaactgcggcgcattacgaattgatcacgtgatgtcgatgctgcgtttgtggtggataccgtatggcgagacggcagatcagggcgcgtatgttcactatccggtggatgatctgctctcgattctggcactcgaaagtaaacgtcatcgctgtatggtgattggtgaagatctcggtaccgtaccggtagagattgtcggtaagctgcgcagcagcggtgtgtactcctacaaagtgctctatttcgaaaacgaccacgagaagacgttccgttcaccgaaagcgtacccggagcagtcgatggcggttgcggcgacacacgacctgccaacgctgcgtggttactgggagagcggggatctaacgctgggcaaaaccctggggctgtatccggatgaagtggtactgcgcggtctgtatcaggatcgcgaactggcgaagcaagggctgctggatgcactgcataaatatggttgtctgccaaaacgtgccgggcataaggcatcgttgatgtcgatgacgccgacgctgaaccgtggtttgcagcgctacattgccgacagtaacagtgctctgttaggactacagccggaagactggctggatatggccgaaccggtgaatattcctggcaccagttaccagtataaaaactggcgacgcaagctttccgcaacgcttgagacgatgtttgccgatgatggcgtgaacaagttgctgaaggatttggacagacggcgcagagctgcagcgaagaagaagtag

SEQ ID NO: 7962 - protein, 694 aa, Escherichia coli
MESKRLDNAALAAGISPNYINAHGKPQSISAETKRRLLDAMHQRTATKVAVTPVPNVMVYTSGKKMPMVVEGSGEYSWLLTTEEGTQYKGHVTGGKAFNLPTKLPEGYHTLTLTQDDQRAHCRVIVAPKRCYEPQALLNKQKLWGACVQLYTLRSEKNWGIGDFGDLKAMLEDVAKRGGSFIGLNPIHALYPANPESASPYSPSSRRWLNVIYIDVNAVEDFHLSEEAQAWWQLPTTQQTLQQARDADWVDYSTVTTLKMTALRMAWKGFAQRDDEQMTAFRQFVAEQGDSLFWQAAFDALHAQQVKEDEMRWGWPAWPEMYQNVDSPEVRQFCEEHRDDVDFYLWLQWLAYSQFAACWEISQGYEMPIGLYRDLAVGVAEGGAETWCDRELYCLKASVGAPPDILGPLGQNWGLPPMDPHIITARAYEPFIELLRANMQNCGALRIDHVMSMLRLWWIPYGETADQGAYVHYPVDDLLSILALESKRHRCMVIGEDLGTVPVEIVGKLRSSGVYSYKVLYFENDHEKTFRSPKAYPEQSMAVAATHDLPTLRGYWESGDLTLGKTLGLYPDEVVLRGLYQDRELAKQGLLDALHKYGCLPKRAGHKASLMSMTPTLNRGLQRYIADSNSALLGLQPEDWLDMAEPVNIPGTSYQYKNWRRKLSATLETMFADDGVNKLLKDLDRRRRAAAKKK

SEQ ID NO: 7963 - DNA, 2394 bp, Escherichia coli
atgtcacaacctatttttaacgataagcaatttcaggaagcgctttcacgtcagtggcagcgttatggcttaaattctgcggctgaaatgactcctcgccagtggtggctggcagtgagcgaagcactggccgaaatgctgcgtgctcagccattcgccaagccagtggcgaatcagcgacatgttaactacatctcaatggagtttttaattggtcgcctgacgggcaacaacctgttgaatctcggctggtatcaggatgtacaggattcgttgaaggcttatgacatcaacctgactgacctgttggaagaagagatcgacccggcgctggggaacggtggtctgggacgtctggcggcgtgctttctcgactcaatggcaactgtcggtcagtctgcgacgggttacggtctgaactatcaatatggtttgttccgccagtcttttgtcgatggcaaacaggttgaagcgccggatgactggcatcgcggtaactacccgtggttccgccacaacgaagcactggatgtgcaggtagggattggcggtaaagtgacgaaagatggacgctgggagccggagtttaccattaccggtcaagcgtgggatctccccgttgtcggctatcgtaatggcgtggcgcagccactgcgtctgtggcaggcgacgcatgcgcatccgtttgatctgactaaatttaacgatggtgatttcctgcgcgccgaacagcagggtatcaacgcggaaaaactgaccaaagttctctatccaaacgacaaccatactgccggtaaaaagctgcgcctgatgcagcaatacttccagtgtgcctgttcggtagcggatattttgcgtcgccatcatctggcggggcgtaaactgcacgaactggcggagtacgaagttattcagctgaacgatacccacccaactatcgccattccagaactgctgcgcgtgctgatcgatgagcaccagatgagctgggatgacgcctgggccatcaccagcaaaactttcgcttacaccaaccataccctgatgccagaagcgctggaacgctgggatgtgaaactggtgaaaggcttactgccgcgccacatgcagattattaacgaaattaatactcgctttaaaacgctggtggaaaaaacctggccgggcgatgaaaaagtgtgggccaaactggcggtggtacacgacaaacaagtgcatatggcgaacctgtgtgtggttggcggtttcgcggtaaacggtgttgcggcgctgcactcggatctggtagtgaaagatctgttcccggaatatcaccagctatggccgaacaaattccataacgtcaccaacggtattaccccacgtcgctggatcaaacagtgcaacccggcactggcggctctgttggataaatcactgaaaaaagagtggactaacgatctcgatcaactgatcaatctggaaaaattcgctgatgatgcgaaattccgtcagcaatatcgcgagatcaagcaggcgaataaagtccgtctggcagagtttgtgaaagttcgtaccggtattgagatcaatccacaggcgattttcgatattcagatcaaacgtctgcatgaatacaaacgccagcacctgaatctgctgcatattctggcgttgtacaaagaaattcgtgaaaacccgcaggctgatcgcgtaccgcgcgtcttcctctttggcgcgaaagcggcaccgggctactacctggcgaaaaacattatctttgcgatcaacaaagtggctgacgtgatcaacaacgatccgcaggttggcgacaaattgaaggtggtgttcctgccggattattgcgtttcggcggcggaaaaactgatcccggcggcggatatctccgaacaaatttcgacggcaggtaaagaagcttccggtaccggcaatatgaaactggcgctcaatggtgcgcttactgtcggtacgctggatggggcgaacgttgaaatcgccgagaaagttggtgaagaaaatatctttatttttggtcataccgtggaacaagtgaaggcaattctggccaaaggctacgacccggtgaaatggcggaagaaagataaggtgctggacgcagtattgaaagagctggaaagcggcaaatacagcgacggcgataagcatgccttcgaccagatgctgcacagtatcggcaaacagggcggcgatccgtatctggtgatggcggatttcgcagcctatgtagaggcacaaaagcaggtggatgtgctataccgcgaccaggaggcctggactcgcgcggcgatcctcaataccgcccgctgcggtatgtttagctcggatcgctctattcgcgattatcaggctcgtatctggcaggcaaaacgctaa

SEQ ID NO: 7964 - protein, 797 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRGNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELAEYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLKKEWTNDLDQLINLEKFADDAKFRQQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPQVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 7965 - DNA, 2706 bp, Escherichia coli
atgctgattccgtcaaaattaagtcgtccggttcgactcgaccataccgtggttcgtgagcgcctgctggctaaactttccggcgcgaacaacttccggctggcgctgatcacaagtcctgcgggctacggaaagaccacgctcatttcccagtgggcggcaggcaaaaacgatatcggctggtactcgctggatgaaggtgataaccagcaagagcgtttcgccagctatctcattgccgccgtgcaacaggcaaccaacggtcactgcgcgatatgtgagacgatggcgcaaaaacggcaatatgccagcctgacgtcactcttcgcccagcttttcattgagctggcggaatggcatagcccactttatctggtcatcgatgactatcatctgatcactaatcctgtgatccacgagtcaatgcgcttctttattcgccatcaaccagaaaatctcacccttgtggtgttgtcacgcaaccttccgcaactgggcattgccaatctgcgtgttcgtgaccagctgctggaaattggcagtcagcaactggcatttacccatcaggaagcgaagcagttttttgattgccgtctgtcatcgccgattgaagctgcagaaagcagtcggatttgtgatgatgtttccggttgggcgacggcactgcagctaatcgccctctccgcccggcagaatactcactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgcactcatcacccgtgtgaccggcgaagaaaacgggcaaatgcgcctcgaagagattgagcgtcaggggctgtttttacagcggatggatgataccggcgagtggttttgctatcacccactgtttggtaacttcctgcgccagcgctgccagtgggaactggcggcggagctgccggaaatccaccgtgccgccgcagaaagctggatggcccagggatttcccagcgaagcgattcatcatgcgctggcggcaggcgatgcgctgatgctgcgcgatattctgcttaatcacgcctggagtttgttcaaccatagcgaactgtcgctgctggaagagtcgcttaaggccctgccgtgggacagtttgctggaaaatccgcagttggtattattgcaggcgtggctgatgcaaagccagcatcgctacggcgaagttaacaccctgctggcccgcgctgaacatgaaatcaaggacatcagagaaggcaccatgcacgcagaatttaacgctctgcgcgcccaggtggcgattaatgatggtaacccggatgaagcggaacggctggcaaaactggcactggaagagctgccgccaggctggttctatagccgcattgtggcaacctcggtgctgggtgaagtgttgcactgcaaaggcgaattgacccgctcactggcgttaatgcagcaaaccgaacagatggcacgccagcacgatgtctggcactacgctttgtggagtttaatccagcaaagtgaaattctgtttgcccaagggttcctgcaaaccgcgtgggaaacgcaggaaaaagcgttccagctgatcaacgagcagcatctggaacagctgccaatgcatgagtttctggtacgcatccgtgcgcagctgttatgggcctgggcacggctggatgaagccgaagcgtcggcgcgcagcgggattgaagtcttgtcgtcttatcagccacagcaacagcttcagtgcctggcaatgttgattcaatgctcgctggcccgtggtgatttagataacgcccgtagccagctgaaccgtctggaaaacctgctggggaatggcaaatatcacagcgactggatctctaacgccaacaaagtccgggtgatttactggcaaatgaccggcgataaagccgccgctgccaactggttgcgtcatacggctaaaccggagtttgcgaacaaccacttcctgcaaggtcaatggcgcaacattgcccgtgcacaaatcttgctgggcgagtttgaatctgcggaaattgtcctcgaagaactcaatgaaaatgcccgcagtctgcggttgatgagcgatctcaaccgtaacctgttgctgcttaatcaactgtactggcaggccggacgtaaaagtgacgcccagcgtgtgttgctggacgcattaaaactggcgaatcgtaccggatttatcagtcattttgtcatcgaaggcgaagcgatggcgcaacaactgcgccagcttattcaactcaatacgctgccggagctggaacagcatcgcgcacagcgtattctgcgagaaatcaatcaacatcatcggcataaattcgcccatttcgatgagaatttcgttgaacgtctgctaaatcatccggaagtgccagagctgatccgcactagcccgttgacccaacgtgaatggcaggtcctggggctgatttactccggttacagcaatgagcaaattgcaggcgagctggaagtggcggcaaccaccatcaaaacgcatatccgtaatctgtaccaaaaactcggtgtcgcccaccgtcaggccgcggtacaacacgcgcagaaactgctgaagatgatgggatatggggtatga

SEQ ID NO: 7966 - protein, 901 aa, Escherichia coli
MLIPSKLSRPVRLDHTVVRERLLAKLSGANNFRLALITSPAGYGKTTLISQWAAGKNDIGWYSLDEGDNQQERFASYLIAAVQQATNGHCAICETMAQKRQYASLTSLFAQLFIELAEWHSPLYLVIDDYHLITNPVIHESMRFFIRHQPENLTLVVLSRNLPQLGIANLRVRDQLLEIGSQQLAFTHQEAKQFFDCRLSSPIEAAESSRICDDVSGWATALQLIALSARQNTHSAHKSARRLAGINASHLSDYLVDEVLDNVDLATRHFLLKSAILRSMNDALITRVTGEENGQMRLEEIERQGLFLQRMDDTGEWFCYHPLFGNFLRQRCQWELAAELPEIHRAAAESWMAQGFPSEAIHHALAAGDALMLRDILLNHAWSLFNHSELSLLEESLKALPWDSLLENPQLVLLQAWLMQSQHRYGEVNTLLARAEHEIKDIREGTMHAEFNALRAQVAINDGNPDEAERLAKLALEELPPGWFYSRIVATSVLGEVLHCKGELTRSLALMQQTEQMARQHDVWHYALWSLIQQSEILFAQGFLQTAWETQEKAFQLINEQHLEQLPMHEFLVRIRAQLLWAWARLDEAEASARSGIEVLSSYQPQQQLQCLAMLIQCSLARGDLDNARSQLNRLENLLGNGKYHSDWISNANKVRVIYWQMTGDKAAAANWLRHTAKPEFANNHFLQGQWRNIARAQILLGEFESAEIVLEELNENARSLRLMSDLNRNLLLLNQLYWQAGRKSDAQRVLLDALKLANRTGFISHFVIEGEAMAQQLRQLIQLNTLPELEQHRAQRILREINQHHRHKFAHFDENFVERLLNHPEVPELIRTSPLTQREWQVLGLIYSGYSNEQIAGELEVAATTIKTHIRNLYQKLGVAHRQAAVQHAQKLLKMMGYGV

SEQ ID NO: 7967 - DNA, 1017 bp, Escherichia coli
atgaaaaggatgattgcgctggatggcgcacagggcgaaggcggcgggcagatcctgcgctcggcgctgagcctgtcgatgataaccggccagccatttaccatcaccggcattcgtgccgggcgggcgaaaccggggctgttgcgccaacatctgaccgcggtaaaagcggctgcggaaatttgtagggcaacggtggaaggcgctgagctggggtcgcagcgtctggtcttccgacctggcaccgtgcgcggcggcgattaccgctttgctatcggtagcgccggaagttgtacgctggtgctgcaaacggtgctgcccgcgctgtggtttgccgatggaccttcgcgtgttgaagtgagcggcggcaccgataacccgtcggccccgcctgcggattttatccgtcgggtgctggagccgctgctggcgaaaataggagttcatcagcaaaccacgctgttacgtcacggtttttatcctgccggaggcggcgtggtagcaacggaagtctcaccggtggcatcgtttaatagcttgcaacttggcgagcgcgggaacattgtgcagatgcgtggagaggtgctactggctggtgtgccgcgccatgttgctgagcgtgaaatcgctacactggcgggtagtttttccttgcatgaacagaatattcataacctgccgcgcgaccaggggccgggtaataccgtctcgcttgaagtcgaaagtgaaaatatcaccgaacgcttttttgtcgtcggtgaaaagcgcgtcagtgccgaggtggtcgcggcacagttggtgaaagaggtgaaacgctacctggcaagcccggcggcggtgggggaatatctcgccgaccaactggtgctaccgatggcgctggcgggtacgggggaatttacggtcgcccatccctcatgccatctgctgaccaatatcgccgtggtggagcgtttcttgccggtgcggtttggtttgatagaaacagatggcgtaacgcgggtgagcattgaatga

SEQ ID NO: 7968 - protein, 338 aa, Escherichia coli
MKRMIALDGAQGEGGGQILRSALSLSMITGQPFTITGIRAGRAKPGLLRQHLTAVKAAAEICRATVEGAELGSQRLVFRPGTVRGGDYRFAIGSAGSCTLVLQTVLPALWFADGPSRVEVSGGTDNPSAPPADFIRRVLEPLLAKIGVHQQTTLLRHGFYPAGGGVVATEVSPVASFNSLQLGERGNIVQMRGEVLLAGVPRHVAEREIATLAGSFSLHEQNIHNLPRDQGPGNTVSLEVESENITERFFVVGEKRVSAEVVAAQLVKEVKRYLASPAAVGEYLADQLVLPMALAGTGEFTVAHPSCHLLTNIAVVERFLPVRFGLIETDGVTRVSIE

SEQ ID NO: 7969 - DNA, 1290 bp, Escherichia coli
ttgattttctggcacgacggttgcaattatcaggacagcaaacaacgaaaagagaaaaacaaaatgaattacgaattactgaccactgaaaatgctccggtaaaaatgtggaccaaaggcgtgccggtagaagccgatgcgcgtcagcaacttattaataccgcgaagatgccgtttattttcaaacatattgcggtaatgcctgatgtacacctgggtaaaggttccaccattggtagcgtgatcccgaccaaaggggcgattattccggcggcggtgggcgtggatattggctgtggaatgaacgcactgcgtaccgcgttaacggcggcggacctgcctgaaaacctggcagagctgcgtcaggcgattgaaacggccgtaccgcacggacgtactaccgggcgttgtaaacgtgataaaggcgcatgggaaaatccgcctgttaacgtcgatgcgaaatgggctgagctggaagccggttatcagtggttaacgcaaaaatatccccgtttccttaacactaacaactataaacacctgggaacgctgggaacgggtaaccactttattgaaatctgccttgatgagtcggaccaggtgtggattatgctgcactccggttcacgcggaatcggtaatgccatcggaacttactttatcgatctggcgcaaaaagagatgcaggaaacgcttgaaacgttgccatcgcgtgacctggcgtactttatggaaggtacggaatactttgatgattacctgaaagccgtggcctgggcgcagctttttgccagccttaaccgcgatgcgatgatggaaaacgtggtaacggcgttgcagagcgttacgcagaaaacggtaaaacagccacaaacgctggcgatggaagagatcaactgtcaccacaactatgtgcaaaaagaacagcactttggcgaagagatctatgtgacgcgtaaaggcgcggtgtctgcgcgtgctggtcaatatggaattattcccggttcgatgggggcgaaaagctttatcgtccgtgggctgggaaatgaagagtcgttctgttcgtgcagccacggtgccgggcgggtaatgagccgtactaaagcgaaaaaactgttcagtgtggaagatcaaatccgtgccaccgcgcatgtggagtgccgtaaagatgccgaggtgatcgacgaaatcccgatggcgtataaagatattgatgcggtgatggcggcacaaagcgatctggtggaagttatctataccctgcgtcaggtggtgtgcgtaaaaggataa

SEQ ID NO: 7970 - protein, 429 aa, Escherichia coli
MIFWHDGCNYQDSKQRKEKNKMNYELLTTENAPVKMWTKGVPVEADARQQLINTAKMPFIFKHIAVMPDVHLGKGSTIGSVIPTKGAIIPAAVGVDIGCGMNALRTALTAADLPENLAELRQAIETAVPHGRTTGRCKRDKGAWENPPVNVDAKWAELEAGYQWLTQKYPRFLNTNNYKHLGTLGTGNHFIEICLDESDQVWIMLHSGSRGIGNAIGTYFIDLAQKEMQETLETLPSRDLAYFMEGTEYFDDYLKAVAWAQLFASLNRDAMMENVVTALQSVTQKTVKQPQTLAMEEINCHHNYVQKEQHFGEEIYVTRKGAVSARAGQYGIIPGSMGAKSFIVRGLGNEESFCSCSHGAGRVMSRTKAKKLFSVEDQIRATAHVECRKDAEVIDEIPMAYKDIDAVMAAQSDLVEVIYTLRQVVCVKG

SEQ ID NO: 7971 - DNA, 807 bp, Escherichia coli
ttgattcgctcaatgcgcgaaaacgaaaataattccagggatttatcaatgaaacaaacacaacgtcacaacggtattatcgaactggttaaacagcagggttatgtcagcaccgaggagctggtagagcatttctccgttagcccgcagactattcgccgcgatctcaacgagctggcagagcaaaacctgatcctgcgccatcatggcggtgcggcgctgccttccagttcggttaatacgccgtggcacgatcgcaaggccacccagaccgaagaaaaagagcgcatcgcccgcaaagtggcggagcaaattcccaatggctcgacgctgtttatcgatatcggcaccacgccggaagcggtggcgcacgcgctgcttaatcacagcaatttacgcattgtgaccaacaatctcaacgtcgctaacacgctgatggtaaaagaggatttccgtatcattcttgccggtggcgaattacgcagccgcgatggcgggatcattggcgaagcaacgctcgattttatctcccagttccgcctcgatttcggcattctggggataagcggcatcgatagcgacggctcgctactggagttcgattaccacgaagttcgcaccaaacgcgccatcattgagaactcgcgccacgttatgctggttgtcgaccactcaaaatttggccgtaacgcaatggtcaatatgggtagcatcagcatggtcgatgctgtctacaccgacacgatgccgcctgcgagcgtgatgcaggtgctgaaggaccatcatattcaactggagctgtgctga

SEQ ID NO: 7972 - protein, 268 aa, Escherichia coli
MIRSMRENENNSRDLSMKQTQRHNGIIELVKQQGYVSTEELVEHFSVSPQTIRRDLNELAEQNLILRHHGGAALPSSSVNTPWHDRKATQTEEKERIARKVAEQIPNGSTLFIDIGTTPEAVAHALLNHSNLRIVTNNLNVANTLMVKEDFRIILAGGELRSRDGGIIGEATLDFISQFRLDFGILGISGIDSDGSLLEFDYHEVRTKRAIIENSRHVMLVVDHSKFGRNAMVNMGSISMVDAVYTDTMPPASVMQVLKDHHIQLELC

SEQ ID NO: 7973 - DNA, 1599 bp, Escherichia coli
atgcgtaaaacagtggcttttggctttgtcggaacggtgctggattatgccgggcgcggcagtcagcgctggtcaaaatggcgtccgacactctgtctatgccagcaagaatcgttagttatcgatcggctggaattattgcacgacgcccgctcgcgctcgctgtttgaaacgcttaaacgcgatatcgccagcgtttcgccagaaacagaggtagtgggcgttgagattgaactgcataatccgtgggatttcgaagaggtttacgcctgcctgcatgatttcgcccgtggttacgcgttccaagctgataaagaagactatttaattcacatcaccaccggtacccacgtcgcgcagatttgctggtttctgctggcagaagcgcgttacctgcccgcccggttgatacaatcttcaccaccgcgcaaaaaagagcggcccgatagccctggcgcagtgacgattatcgatctcgatttaagccgttataacgccatcgccagccgctttgccgaggaacgccagcaaacgcttgattttcttaagtccggcattgccacgcgtaactcccacttcaaccgcatgattgagcagattgaaaaagtggcgataaaatcccgcgcaccgatcctgcttaacggcccgaccggtgcaggtaagtcatttctggcacgacgcatcttcgagctaaaacaggcgcggcatcagtttagcggcgcgtttgtggaagtgaactgcgccaccctgcgcggcgataccgccatgtcgacgctgtttggtcatgtgaaaggcgcgtttaccggggcgcgggaatcgcgtgaaggattattacgcagcgccaacggcggaatgttgtttcttgatgagattggcgaactgggcgcagacgaacaggcgatgttgctgaaagccattgaagagaaaaccttttacccgtttggcagcgatcgccaggtgagcagtgattttcagcttatcgccggaacggtgcgcgatttgcgccagttggttgccgaaggcaaatttcgtgaagacctgtacgcgcgaataaatctctggaccttcaccttgccaggattacgccaacgccaggaagatattgaaccgaacctggattatgaagtggagcgccacgcctcactcactggcgacagcgtgcgttttaacaccgaagcgcggcgtgcctggctggcctttgcgacctctccccaggcaacatggcgcggtaactttcgcgaactttctgccagcgtcacgcggatggccacctttgccactagcggacgcatcacactggatacggtggaagatgagatcaaccgtctgcgctataactggcaggagagtcgcccctccacgcttacggcgttgctgggcgcagaggcagaaaacatcgatctcttcgaccgtatgcaactggaacacgttatcgctatctgccgccaggcaaagtcgctttctgctgccggacgtgaactgtttgacatttcgcgccagggtaaagccagcgtcaatgacgcggatcggctacgcaaatacctggcgcgttttggtctgacatgggaagcaatgcaggatcagcacagctccagttga

SEQ ID NO: 7974 - protein, 532 aa, Escherichia coli
MRKTVAFGFVGTVLDYAGRGSQRWSKWRPTLCLCQQESLVIDRLELLHDARSRSLFETLKRDIASVSPETEVVGVEIELHNPWDFEEVYACLHDFARGYAFQADKEDYLIHITTGTHVAQICWFLLAEARYLPARLIQSSPPRKKERPDSPGAVTIIDLDLSRYNAIASRFAEERQQTLDFLKSGIATRNSHFNRMIEQIEKVAIKSRAPILLNGPTGAGKSFLARRIFELKQARHQFSGAFVEVNCATLRGDTAMSTLFGHVKGAFTGARESREGLLRSANGGMLFLDEIGELGADEQAMLLKAIEEKTFYPFGSDRQVSSDFQLIAGTVRDLRQLVAEGKFREDLYARINLWTFTLPGLRQRQEDIEPNLDYEVERHASLTGDSVRFNTEARRAWLAFATSPQATWRGNFRELSASVTRMATFATSGRITLDTVEDEINRLRYNWQESRPSTLTALLGAEAENIDLFDRMQLEHVIAICRQAKSLSAAGRELFDISRQGKASVNDADRLRKYLARFGLTWEAMQDQHSSS

SEQ ID NO: 7975 - DNA, 831 bp, Escherichia coli
atgttgatgattacctcttttgctaacccccgcgtggcgcaggcgtttgttgattacatggcgacgcagggtgttatcctcacgattcaacaacataaccaaagcgatgtctggctggcggatgagtcccaggccgagcgcgtgcgggcggagctggcgcgttttctcgaaaacccggcagatccgcgttatctggcggccagctggcaggcgggccataccggcagtggcctgcattatcgccgttatcctttctttgccgccttgcgtgaacgcgcaggtccggtaacctgggtgatgatgatcgcctgcgtggtggtgtttatcgccatgcaaattctcggcgatcaggaagtgatgttatggctggcctggccattcgatccgacgctgaagtttgagttctggcgttacttcacccacgcgttaatgcacttctcgctgatgcatatcctctttaacctgctctggtggtggtatctcggcggtgcggtggaaaaacgcctcggtagcggtaagctaattgtcattactctcattagcgccctgttaagcggctatgtgcagcaaaaattcagcgggccgtggtttggcgggctttctggcgtggtgtatgcgctgatgggctacgtctggctacgtggcgaacgcgatccgcaaagtggcatttacctgcaacgtgggttaattatctttgcgttgatctggattgtcgccggatggtttgatttgtttgggatgtcgatggcgaacggagcacacatcgccgggttagccgtgggtttagcgatggcttttgttgattcgctcaatgcgcgaaaacgaaaataa

SEQ ID NO: 7976 - protein, 276 aa, Escherichia coli
MLMITSFANPRVAQAFVDYMATQGVILTIQQHNQSDVWLADESQAERVRAELARFLENPADPRYLAASWQAGHTGSGLHYRRYPFFAALRERAGPVTWVMMIACVVVFIAMQILGDQEVMLWLAWPFDPTLKFEFWRYFTHALMHFSLMHILFNLLWWWYLGGAVEKRLGSGKLIVITLISALLSGYVQQKFSGPWFGGLSGVVYALMGYVWLRGERDPQSGIYLQRGLIIFALIWIVAGWFDLFGMSMANGAHIAGLAVGLAMAFVDSLNARKRK

SEQ ID NO: 7977 - DNA, 327 bp, Escherichia coli
atggatcagttcgaatgtattaacgttgccgacgcgcaccagaagttgcaggaaaaagaggcggtgctggtcgatattcgcgatccacagagtttcgcaatggggcatgcgacccaggctttccatttaactaacgacacactgggcgcgtttatgcgtgataacgactttgacacaccggtgatggtgatgtgttatcacggcaatagcagcaaaggcgcggcgcagtatctgctgcaacagggctacgatgtggtctacagcattgatggcggttttgaagcctggcagcgccagtttcccgcagaggtggcgtacggcgcgtaa

SEQ ID NO: 7978 - protein, 108 aa, Escherichia coli
MDQFECINVADAHQKLQEKEAVLVDIRDPQSFAMGHATQAFHLTNDTLGAFMRDNDFDTPVMVMCYHGNSSKGAAQYLLQQGYDVVYSIDGGFEAWQRQFPAEVAYGA

SEQ ID NO: 7979 - DNA, 1506 bp, Escherichia coli
atggaaaccaaagatctgattgtgataggtggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgactggtcagcgaggcgctggctgaacgtgaagtgctactgaaaatggccccgcatatcgccttcccgatgcgttttcgcctgccgcatcgtccgcatctacgcccggcgtggatgattcgcattggtctgtttatgtacgatcatctgggtaagcgcaccagcctgccgggatcaaccggtttgcgttttggcgcaaactcagtgttaaaaccggaaattaagcgcggattcgaatattctgactgttgggtagacgacgcccgtctggtactcgccaacgcccagatggtggtgcgtaaaggcggtgaagtgcttactcgtactcgtgccacgtctgctcgccgcgaaaacggcctgtggattgtggaggcggaagatatcgataccggcaaaaaatatacatggcaggcgcgcggcctggttaatgctaccggcccgtgggtgaaacaatttttcgacgacgggatgcatctgccttcgccttatggcattcgcctgatcaaaggcagccatattgtggtgccgcgtgtgcatacccagaagcaagcctacattctgcaaaacgaagataaacgtattgtcttcgtgatcccgtggatggacgagttttccatcatcggcaccaccgatgtggaatacaaaggcgatccaaaagcagtgaagattgaagagagtgaaatcaattacctgttgaaagtgtataacacgcactttaaaaagcagttaagccgggacgatatcatctggacctactccggcgtgcgtccgctatgtgatgatgagtccgactcgccacaggccattacccgtgattacacccttgatatccatgatgaagacggcaaagccccgctgctgtcggtattcggcggtaagctgaccacctaccgcaaactggcggagcacgcgctggaaaaactgacgccatattatcagggcattggtccggcgtggacgaaagagagcgtgctgccgggtggtgccattgaaggcgaccgtgacgattacgccgcccgcctgcgccgccgttacccgttcctgaccgaatcgctggcacgtcactacgcgcgcacttacggcagcaacagcgaactgttgctcggcaatgcaggggcgataagcgacctcggtgaaaatttcggtcatgagttctacgaagcggagctgaaatatctggtcgaccacgaatgggtccgccgcgccgacgatgccctgtggcgtcgcacgaaacaaggcatgtggctaaatgcggatcaacaatctcgtgtgagtcagtggctgatggaatatacgcagcagaggttgtcgctggcgtcgtaa

SEQ ID NO: 7980 - protein, 501 aa, Escherichia coli
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYTWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLKVYNTHFKKQLSRDDIIWTYSGVRPLCDDESDSPQAITRDYTLDIHDEDGKAPLLSVFGGKLTTYRKLAEHALEKLTPYYQGIGPAWTKESVLPGGAIEGDRDDYAARLRRRYPFLTESLARHYARTYGSNSELLLGNAGAISDLGENFGHEFYEAELKYLVDHEWVRRADDALWRRTKQGMWLNADQQSRVSQWLMEYTQQRLSLAS

SEQ ID NO: 7981 - DNA, 606 bp, Escherichia coli
atgattaaattccggctttatattccccctgtaattctcggttttgttatcgtaccattattggtatggccgacggttattgccttagccgtacttatattcacgttaacttttctggcggaaataatattctcctttccgctcctggttgtgcgtatttctcttcaggaattacaacttgagttattggttgaatatgcactttttttcagtgtaatgggtggcatcggttggcaattctcccgcagaacgcctcctgaattaaaaaacaggctacattgctggctggtcttttctccggtctatttctggttaattctctcgaatttcattctttatatttctccagagaaatcagcgttgctggaaaatatccgaaatttctttctgacatttgtctggcttcccctgaatttttcccctttttggccgcagccgtggactgattttgtcggcccgattagtgcccagcttggttttgcgttgggatattattgccagtggcgtagcaaaaatagaagccataggaagaagtggggcgattgggtaacgtgcttaagtttggcgattttagctctggggccgttattcaattatttacaatga

SEQ ID NO: 7982 - protein, 201 aa, Escherichia coli
MIKFRLYIPPVILGFVIVPLLVWPTVIALAVLIFTLTFLAEIIFSFPLLVVRISLQELQLELLVEYALFFSVMGGIGWQFSRRTPPELKNRLHCWLVFSPVYFWLILSNFILYISPEKSALLENIRNFFLTFVWLPLNFSPFWPQPWTDFVGPISAQLGFALGYYCQWRSKNRSHRKKWGDWVTCLSLAILALGPLFNYLQ

SEQ ID NO: 7983 - DNA, 768 bp, Escherichia coli
atgccccccactcctgccatgcaggcattaattgagcagatatatcatatttttcgtcgttatccggcgccgaagcaatttgtggtttgttgtgaatattgtctgagtcaacaggaacaaaaagcattacggaatacatcgttgcgagcgattccttattccttaatcaatgcctggaatagtagtccaggacctgatccgcaaaacagcgatgaggttcgttattttctgcctcgtttactggagtttgttgcgcaggggcaatttgacaatattcacgaagtattttctctacggcgtataaaccttgccagtaaagaaaactggcgtgaggatgaacgggaaatattgcagcaatttgcttgccagtatatgactgattgggtatccggggatgaggctgtcgaattacagtacaagctggaaatgtttttccgtgccgatatcgctctttcgccattgcttgatgccattatttcagttcccggattttggtcggcagcgtctcttgcctgtttattgaatacgtatcgtgacggttatatcagagataaccaggacgatatcgataaagccattaccgcccaaatcaatgcctgggccttcaacaatcaatccatcctgaaagaacgcgcgcggcaggcgattgagaacccgcttaagcagcccgaacagggcacacagtatcagatctgggaagacgactggatgattgatgagtgtttatgcgcgatgtatgacgcatcatccgaatcaccaggaaaataa

SEQ ID NO: 7984 - protein, 255 aa, Escherichia coli
MPPTPAMQALIEQIYHIFRRYPAPKQFVVCCEYCLSQQEQKALRNTSLRAIPYSLINAWNSSPGPDPQNSDEVRYFLPRLLEFVAQGQFDNIHEVFSLRRINLASKENWREDEREILQQFACQYMTDWVSGDEAVELQYKLEMFFRADIALSPLLDAIISVPGFWSAASLACLLNTYRDGYIRDNQDDIDKAITAQINAWAFNNQSILKERARQAIENPLKQPEQGTQYQIWEDDWMIDECLCAMYDASSESPGK

SEQ ID NO: 7985 - DNA, 711 bp, Escherichia coli
atggagttagttgatacgttatttgcaaacttctccggtactgatccattcactggcgtggatattacgattgcccactgcaaatcaacatactgggatgaaggcattgttcagcaactcattaaccaggtcctggatgaaggggaaaagttcgccggtgctgccggtcttgagggattatctcgatacgatgtcacattaaatattggtttaacgtccagcaatgtatggccgggattttccctcgataccgccaccattagccgtctttgtgcctgtggtgctgactttggatttgccctctatatcagtgatgtaccagatgttcaatgtgatctgaacacaacaaatgacttcaccgtacaatttacggcgatgctcaacccggatgagcgggtgatcatagcaaagcgcccgcttaaaaaatgtgacgcctggattgaggatgtttatatctttcaagtgtttaaagaagcctggcaatttcaaaacgataacagtttacgcggatttcgcgataagcaggctgaactgaaactctacgcgcgtcattactcagtggaaaattgcacagaggaaagctgttgggactgtaattattgcattcggcccagcttttccctctctcgtagtgccattattcgcctgaatgcggcgaatgctcgttttgtctatcaaccctttacacgcgatcagcgggcgagggggtaa

SEQ ID NO: 7986 - protein, 236 aa, Escherichia coli
MELVDTLFANFSGTDPFTGVDITIAHCKSTYWDEGIVQQLINQVLDEGEKFAGAAGLEGLSRYDVTLNIGLTSSNVWPGFSLDTATISRLCACGADFGFALYISDVPDVQCDLNTTNDFTVQFTAMLNPDERVIIAKRPLKKCDAWIEDVYIFQVFKEAWQFQNDNSLRGFRDKQAELKLYARHYSVENCTEESCWDCNYCIRPSFSLSRSAIIRLNAANARFVYQPFTRDQRARG

SEQ ID NO: 7987 - DNA, 423 bp, Escherichia coli
atgccggatgtgtgggccagtgaattgagccgggctggtgccggagcgaagcccgctggtgttactcctgtagcaaccactattccgattaattgtacgaataaagatacagatgcggtaatgacgttggtattcgacggtaacatttcagctacacgtgataccaatgggaaacaaagtattattcaggcacaagataatcctgatgttggtattatgattatggatagtcagcaaaactccgtagatttaaatgctctggcaacatcagtaggcgttccattcagattggtggaaaaccagacggcttctgcgcaaactgctgatgttactttcctgactttacctgttagtacaactggaaaagtgcctgcggcaggtcgttataatgcactggctatattgcgagtggaatatcagtaa

SEQ ID NO: 7988 - protein, 140 aa, Escherichia coli
MPDVWASELSRAGAGAKPAGVTPVATTIPINCTNKDTDAVMTLVFDGNISATRDTNGKQSIIQAQDNPDVGIMIMDSQQNSVDLNALATSVGVPFRLVENQTASAQTADVTFLTLPVSTTGKVPAAGRYNALAILRVEYQ

SEQ ID NO: 7989 - DNA, 780 bp, Escherichia coli
atgcgtcagtatcgtttattgtcacctatgattaaggtagtcatagtattattttcccttttattctctacagcacaagcaggcttagtgatcggtggaacgcgttttgcgtatccggaaaatcagtcctcaatatctgttgaactcaaaaacacttcagacagagatatgttagtcaaggttgctgtctcccctgatgatgctcgtcagttgacgggaacggttgaatctttgccctcatattctgaaacggtatttatcgcaactccgccactgtttgttttgaagcctgacaaaaatacaaaaataagaattaatcgtgttggtggcagtttatctgccgaccgggaaagtttatttatactgaatgttgcagcattaccaacgttggaaaatagtcattcagtcaaaactgataatcaattgcaaatagcagtccgcaatcgtatgaaaatattctatcggccatcaaatttgtctgaagacccgaatatgtcatatcagaaattacgctgggcacgaaaaaatgaaattgttaccgtttataatccaggccccagatatgtgacactctataacctacatgttgatggtaaagttatagatggtggtatggtcgcaccatttagccatcgccaacaatcatggtgtaaatcgcaaggggtttgtgaaatagcatggcagacattggatgtttataataatgttttacctgcatggaaagtaaagatgaatctgttgcagatggatgtgtcaggtttacaagttaaaacggattag

SEQ ID NO: 7990 - protein, 259 aa, Escherichia coli
MRQYRLLSPMIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLSADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDVYNNVLPAWKVKMNLLQMDVSGLQVKTD

SEQ ID NO: 7991 - DNA, 516 bp, Escherichia coli
atgaagatattcattagtttatttttgtttataatatcaacaaattcttttgctgatgatatcactcatgccggagtggttcgtattgaagggttaattaccgaaaaaacctgcattatttctgatgagtcaaaaaattttacagttaatatgccagacgtacccagtagttcggtaaggagtgcaggggatgttactgaaaaggtttatttttccataacgttaacccgctgtggtagtgatgttggcaacgcgtatataaagtttaccggcaatacagtttctgaagatgccagtttatataagctggaagatggctcggtagaggggcttgcacttacgatttttgataagaacaaaggcagtattagtaatgatgttaaaagcatgggtttttcacttacatcatcagttgataatatattgcatttttttgcggcttacaaagcattaaaaaataatgtccaaccaggggatgcaaatgcgtcagtatcgtttattgtcacctatgattaa

SEQ ID NO: 7992 - protein, 171 aa, Escherichia coli
MKIFISLFLFIISTNSFADDITHAGVVRIEGLITEKTCIISDESKNFTVNMPDVPSSSVRSAGDVTEKVYFSITLTRCGSDVGNAYIKFTGNTVSEDASLYKLEDGSVEGLALTIFDKNKGSISNDVKSMGFSLTSSVDNILHFFAAYKALKNNVQPGDANASVSFIVTYD

SEQ ID NO: 7993 - DNA, 564 bp, Escherichia coli
atgaatttaatattctctaaatattctgtattttttattcttttcgctttttttgcttttccgctctcagggcaggccaatgattcagttgttgttacatttactgggattttgttggcaaaaagctgtgacattactaccggaagtaaagatcagtcggtaaaaatgggcacttatgatgctaatgaatttttaaatgtaggtgatgtttctccgagtcaaacgtttacgattaatgtacaaggatgcccgactgcaaaaagtactgtttatagttctggtgtgagcgccaatgtgcggtttactggtgatgcagatgccattaatagcgcattactgcgtctctccgccggtgcagatagtgcgactggactgggaatagaaatattggataacaatgatgtggcgattgccattaatggtgaatcaggttttcgtgatttagtgttaaatgaaaacggtgatgctaatttgacgtttaaacttcgctataaatcaactcaggaaaatgtacatgccgggcaagcaaatgctctgttgtattttgatatcgattatcagtga

SEQ ID NO: 7994 - protein, 187 aa, Escherichia coli
MNLIFSKYSVFFILFAFFAFPLSGQANDSVVVTFTGILLAKSCDITTGSKDQSVKMGTYDANEFLNVGDVSPSQTFTINVQGCPTAKSTVYSSGVSANVRFTGDADAINSALLRLSAGADSATGLGIEILDNNDVAIAINGESGFRDLVLNENGDANLTFKLRYKSTQENVHAGQANALLYFDIDYQ

SEQ ID NO: 7995 - DNA, 2595 bp, Escherichia coli
atgaacctaaagctcaaaagatgcgaatattggatggcggcacaaaagcagatgaaacgggttgtgccgcttcttctggttattatgcctgcatgttcaatcgcgggaatgcgctttaaccctgcttttctgtcgggtgatactgaagctgttgctgacttatcccgcttcgagaaagggatgacttatcttcctggtagctatgaagtcgaagtttgggtcaatgattcccctttactctctcgtactgtaacttttaaagcagacgatgcgaatcaactgattccctgcctttcacttgctgacttattaagccttggaattaacaaaaatgcgctgccagagcaggctttggcttcatctgaaaatagttgccttgatttgcgtatctggtttcctgatgtgcattacatgccggagctggatgcacagagacttaaactgacctttccgcaggcgataataaaacgtgacgcccgcggatatattccaccagaacagtgggataacggtattacagcttttttgctgaattatgacttttctggtaataacgatcgtggtgattactcttcaaataactattatttaaatcttcgcgctgggatcaatattggtgcatggcgttttcgcgattattcaacctggagtcgtgggagtaattcagcaggtaaactggagcatatcagtagtacgttgcagcgcgttattattcctttcagaagtgaattaacgctaggagatacatggtcatcatcagatgttttcgacagtgttagtattcgtggcataaaactggaatctgacgaaaatatgttgcccgatagtcaaagtggtttcgctcccacggtgcgcggaattgcgaaaagtcgcgctcaggtaacaatcaaacagaatggttatgtcatttatcaaacctatatgccgccgggaccgtttgagattagcgatcttaacccgacatcatctgcgggagatctggaagttaccatcaaagagtctgataattcagaaactgtctataccgtaccttatgccgctgtccccatcctgcaacgagaaggtcattcaaaatattctactacggttggccaatatcgaagcaatagctataaccagaaaagtccttatatatttcagggggaattaatttggggtttaccctgggatattacggcttatggtggggcacaattctctgaggattaccgggcgttggcgctcggccttggcctgaatctgggtgtatttggtgcaacatcgtttgatgttactcaggctaacagttcgcttgtggatgggagcaaacatcaagggcaatcttatcgttttctttattccaaatcgttagttcagacaggaacagcattccatattattggctatcgttattcaacccagggcttttacactttaagtgatacgacataccaacaaatgtcagggactgttgttgatccaaaaacgttagatgataaagattacgtttataactggaatgatttttataacttgcgttatagcaaacgtggaaaatttcaggctagtgtatcgcaacctttcggtaactacgggtctatgtatttatcggctagtcagcaaacatactggaatactgataaaaaagattctttataccaagttggttataacaccagtattaagggtatctatctaaatgttgcgtggaattacagtaaatcaccagggacaaatgcggataaaattgtctcgctaaatgtctcattacctataagtaattggttatcttccacgaatgatgggcgctcatcatcgaatgccatgactgcaacgtatggttatagtcaggataaccacggacaggtaaaccaatatacgggggtatctggttctctgttggagcagcataatctcagttataacatacaacatggttttgctaatcaggataatagcagtagtggttctgttggtgttaattatcgtggggcatatggttccttgaattccgcctacagttacgataatgaaggtaatcaacaaataaactatggcatcagtggtgctcttgttgtacatgaaaatggtcttacgttgagtcaaccattaggtgaaactaatgttttgataaaagcgcctggagcgaataatgtggatgttcagcgggggacaggaatatccactgactggcgtggatatgcagttgttccttatgcaacagaatatagacgtaataatatttcattagatcctatgtcaatgaatatgcatactgaactggatatcacttccactgaagttattccgggaaaaggtgcgttagttcgtgcagagtttgctgctcatatcggtattcgtggtttgttcacagttcgttatcgtaataaatcagtcccattcggtgctacagccagcgctcagattaaaaacagtagtcaaattaccgggattgtcggcgataatggacaactttatctctcaggattgcctttagaaggtgttattaatatccagtggggagacggtgttcagcaaaaatgtcaggctaattacaagctccctgaaacagaactggataatcctgttagctatgcaactctggagtgccgctaa

SEQ ID NO: 7996 - protein, 864 aa, Escherichia coli
MNLKLKRCEYWMAAQKQMKRVVPLLLVIMPACSIAGMRFNPAFLSGDTEAVADLSRFEKGMTYLPGSYEVEVWVNDSPLLSRTVTFKADDANQLIPCLSLADLLSLGINKNALPEQALASSENSCLDLRIWFPDVHYMPELDAQRLKLTFPQAIIKRDARGYIPPEQWDNGITAFLLNYDFSGNNDRGDYSSNNYYLNLRAGINIGAWRFRDYSTWSRGSNSAGKLEHISSTLQRVIIPFRSELTLGDTWSSSDVFDSVSIRGIKLESDENMLPDSQSGFAPTVRGIAKSRAQVTIKQNGYVIYQTYMPPGPFEISDLNPTSSAGDLEVTIKESDNSETVYTVPYAAVPILQREGHSKYSTTVGQYRSNSYNQKSPYIFQGELIWGLPWDITAYGGAQFSEDYRALALGLGLNLGVFGATSFDVTQANSSLVDGSKHQGQSYRFLYSKSLVQTGTAFHIIGYRYSTQGFYTLSDTTYQQMSGTVVDPKTLDDKDYVYNWNDFYNLRYSKRGKFQASVSQPFGNYGSMYLSASQQTYWNTDKKDSLYQVGYNTSIKGIYLNVAWNYSKSPGTNADKIVSLNVSLPISNWLSSTNDGRSSSNAMTATYGYSQDNHGQVNQYTGVSGSLLEQHNLSYNIQHGFANQDNSSSGSVGVNYRGAYGSLNSAYSYDNEGNQQINYGISGALVVHENGLTLSQPLGETNVLIKAPGANNVDVQRGTGISTDWRGYAVVPYATEYRRNNISLDPMSMNMHTELDITSTEVIPGKGALVRAEFAAHIGIRGLFTVRYRNKSVPFGATASAQIKNSSQITGIVGDNGQLYLSGLPLEGVINIQWGDGVQQKCQANYKLPETELDNPVSYATLECR

SEQ ID NO: 7997 - DNA, 753 bp, Escherichia coli
atgaaatgtattattggaaataaaaaatgggtttgtggattcagggatgaattaaaagtatcacaaaatattatacgctcagggattctttttttactatcgatattatttattaataatgcgtccgcgggcgggtttggccttggcgtaacgcgattgatttatccggcagaaagtaagcaaataacactcagtgtgcaaaatagcggtgacaacaccagttatttaattcaatcatgggttgatgacagtaaaacggaaaaaaagagccaggattttgttatcactcctcccctctttatgttgccaacgcgtaaagaagcttcattacgtatcatgtttcttggtaagactaatttgccgaccgatcgtgaaactttgtattggatgaatgttaaagcaattccgccaacagatgagaaaaatacacagaagaataccttacagttggcattacaaaacaaaatcaagctattttatcgcccggaaaatctacctgtgcaaccaggaaaagcacgaaatatgttgcggtttaagtatgagggaaaacaactaaaagttatcaatccttcgccttattacctgacactgacaggaattaaagtacaagggagtaaattgcccaatatgtttgtaccaccgaaaagtgatattacggtctcgtcgccagtgacgttggctggtgaaattacttatcaaacaattaatgactttggcgctacgacggagcggcagaaaggaataatgcagtaa

SEQ ID NO: 7998 - protein, 250 aa, Escherichia coli
MKCIIGNKKWVCGFRDELKVSQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNMFVPPKSDITVSSPVTLAGEITYQTINDFGATTERQKGIMQ

SEQ ID NO: 7999 - DNA, 705 bp, Escherichia coli
atgaaattcaatttatctaatttatccgcagtattactggcatcaggtatgctgatgtctactgcggtaaccgcagcacccggcgatgcaacacaatttggtggggcggatactgactggagcaccgttgattatcccaggctcactgatatggatgacaacgttgattcaatgggggggaaaatccgctttactggccgtgtagtgaaagctacctgtaaggtcgcaaccgattcaaaacagattgaagttgtcctgccggttgtgccttccaaccttttcactggtatcgacgtagaagcacagggggcgagcaaccagaccgatttcaatattaatctgaccgaatgtagcaatacagatgatcagaaaattgagttccgttttaccggtactgcagatagcgctaataaaacgctcgctaacgaagtagaaggatcaacggatgctgacaacagcggcaatgcgggggcgactggtgtagggattcgaatttactccaaaggtacgacgaataatggtctgattaacctgaataccactgcggcagagggtagcgcctccaccgccgcttatacaattccaggaaatgctacgacccatgatttcagcgcggcctttactgcaggttatgctcaaaacggtagcactgttgcaccaggtgtagttaagtcaacagcaagttttgttgtgctgtacgagtaa

SEQ ID NO: 8000 - protein, 234 aa, Escherichia coli
MKFNLSNLSAVLLASGMLMSTAVTAAPGDATQFGGADTDWSTVDYPRLTDMDDNVDSMGGKIRFTGRVVKATCKVATDSKQIEVVLPVVPSNLFTGIDVEAQGASNQTDFNINLTECSNTDDQKIEFRFTGTADSANKTLANEVEGSTDADNSGNAGATGVGIRIYSKGTTNNGLINLNTTAAEGSASTAAYTIPGNATTHDFSAAFTAGYAQNGSTVAPGVVKSTASFVVLYE

SEQ ID NO: 8001 - DNA, 2448 bp, Escherichia coli
atgaatgctccgtttacatattcatcgcccacgcttagcgtagaagctcttaagcactctatcgcttacaagctgatgtttacgattggcaaggatccggtcgtcgccaataaacatgaatggctgaacgcaacgttatttgctgtgcgcgatcgtctcgtggagcgctggttacgctcaaaccgtgcccagttgtcgcaagaaactcgtcaggtttactacctgtcgatggagtttttgattggccgtacgctttccaacgccatgttgtcgctaggaatttacgaagatgtacagggcgcactggaagcgatgggattaaatctcgaagagctgattgatgaagaaaatgacccgggcctcggtaacggtggcctgggccgtctggcggcttgcttcctcgattctctggcgacgttagggttgccggggcgcggttacggcatccgctatgactacggtatgttcaagcagaacatcgttaacggtagccagaaagagtcgcctgactactggctggaatacggtaacccgtgggaattcaaacgccacaacacgcgctataaagtccgttttggcggtcgcattcagcaggaaggtaaaaaaacgcgctggattgaaaccgaagagattctgggagtagcttacgatcagataatcccaggttacgacaccgacgcgaccaacacgttgcgtttgtggagtgcccaagccagtagcgaaattaacctcggtaaattcaaccagggcgactacttcgcggcagtggaagataaaaaccactccgagaacgtatctcgcgtactgtatccggacgactccacctactccgggcgtgagctacgactgcgtcaggaatacttcctggtttcctcgaccattcaggacattttaagccgccattatcagttgcataaaacctacgataacctggcggataaaattgcgattcacctcaacgatactcatccggtgctgtcgattcctgagatgatgcgtctgctgatcgatgagcaccaatttagctgggacgacgcgtttgaagtgtgttgtcaggtcttctcctacaccaaccacacgctaatgagcgaggcgctggaaacctggccagtcgatatgctgggtaaaattctgccgcgtcacctgcagatcatctttgaaatcaacgactatttcctgaaaaccttgcaggaacagtatccgaacgataccgatctgctgggacgggcgtcgatcattgatgaatccaacggtcgtcgtgtgcgtatggcctggctggcggttgtggtgagccacaaagttaacggtgtatcggagctgcactctaacctgatggtgcaatcgctatttgccgactttgcgaaaatcttcccgggtcgtttcaccaacgtcaccaacggtgtgacgccgcgtcgctggctggcggtagcgaacccatcgctttcagccgtgttggacgaacacctgggccgcaactggcgcaccgaccttagcctgcttaatgatctgcaacaacactgtgatttcccaatggttaatcacgcggtgcatcaggcgaagctggagaacaaaaagcgtctggcggagtatatcgcccagcagctgaatgtggtggtaaatccgaaagcgctgttcgatgtgcaaatcaaacgtattcacgaatacaaacgtcaattgatgaatgtgttgcacgtgatcacccgctataaccgcatcaaggccgacccggatgcgaagtgggtaccgcgcgtgaatatttttggcggtaaggcggcttcggcctattacatggcgaagcacattattcatttgatcaatgacgtagcgaaagtgatcaacaacgatccgcagattggcgacaagctgaaagtcgtgttcatcccgaactacagtgttagcctggcgcagttgatcattccggcggccgatctgtctgaacagatttcgctggcggggacggaagcttccggcaccagtaacatgaagtttgcgcttaacggcgcgctgactatcggtacgctggacggtgcgaatgtcgagatgctggatcatgtcggtgctgacaatatctttatctttggtaacacagcggaagaagtggaagaactgcgtcgtcagggctacaaaccgcgtgaatactacgagaaagatgaggagctgcatcaggtgctgacgcaaatcggcagcggtgtattcagtccggaagatccgggtcgctatcgcgatctggttgattcgctgatcaacttcggcgatcactaccaggtactggcggattatcgcagttatgtcgattgtcaggataaagtcgacgaactctacgagcgtcaggaagagtggaccgcaaaagcgatgctgaacattgccaatatgggctacttctcttctgaccgtacgatcaaagagtacgccgatcatatctggcatattgatccggtgagattgtaa

SEQ ID NO: 8002 - protein, 815 aa, Escherichia coli
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNDLQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYERQEEWTAKAMLNIANMGYFSSDRTIKEYADHIWHIDPVRL

SEQ ID NO: 8003 - DNA, 1434 bp, Escherichia coli
atgcaggttttacatgtatgttcagagatgttcccgctgcttaaaaccggcggtctggctgatgttattggggcattacccgcagcacaaatcgcagacggcgttgacgctcgcgtactgttgcctgcatttcccgatattcgccgtggcgtgaccgatgcgcaggtagtatcccgtcgtgataccttcgccggacatatcacgcttttgttcggtcattacaacggggttggcatatacctgattgacgcgccgcatctctatgatcgtccgggaagcccgtatcacgataccaacttatttgcctataccgacaacgtattgcgttttgcgctgctggggtgggttggggcagaaatggccagcgggcttgacccattctggcgtcctgatgtggtgcatgcgcacgactggcatgcaggccttgcgcctgcgtatctggcggcgcgcgggcgtccggcgaagtcggtgtttactgtgcacaacctggcctatcaaggcatgttttatgcacatcacatgaatgacatccaattgccatggtcattctttaatattcatgggctggaattcaacggacaaatctctttcctgaaggccggtctgtactatgccgatcacattacggcagtcagcccaacctacgctcgcgagatcaccgaaccgcagtttgcctacggtatggaaggtctgttgcaacagcgtcaccgtgaagggcgtctttccggcgtactgaacggcgtggacgagaaaatctggagtccagagacggacttactgttggcctcgcgttacacccgcgatacgttggaagataaagcggaaaataagcgccagttacaaatcgcaatggggcttaaggttgacgataaagtgccgctttttgcagtggtgagccgtcttaccagccagaaaggtctcgacctggtgctggaagccttacctggtcttctggagcagggcgggcagctggcgctactcggcgcgggcgatccggtgctgcaggaaggtttccttgcggcggcagcggaataccccggccaggtgggcgttcagattggctatcacgaagcattttcgcatcgcattatgggcggcgcggacgtcattctggtgcccagccgttttgaaccgtgcggcttaacgcaactttatggattgaagtacggtacgctgccgttagtgcggcgcaccggtgggcttgctgatacggtttctgactgttctcttgagaaccttgcagatggcgtcgccagtgggtttgtctttgaagatagtaatgcctggtcgctgttacgggctattcgacgtgcttttgtactgtggtcccgtccttcactgtggcggtttgtgcaacgtcaggctatggcaatggattttagctggcaggtcgcggcgaagtcgtaccgtgagctttactatcgcttgaaatag

SEQ ID NO: 8004 - protein, 477 aa, Escherichia coli [sequence omitted]

SEQ ID NO: 8005 - DNA, 1296 bp, Escherichia coli
atggttagtttagagaagaacgatcacttaatgttggcgcgccagctgccattgaaatctgttgccctgatactggcgggaggacgtggtacccgcctgaaggatttaaccaataagcgagcaaaaccggccgtacacttcggtggtaagttccgcattatcgactttgcgctgtctaactgcatcaactccgggatccgtcgtatgggcgtgatcacccagtaccagtcccacactctggtgcagcacatccagcgcggctggtcattcttcaatgaagaaatgaacgagtttgtcgatctgctgccagcacagcagagaatgaaaggggaaaactggtatcgcggcaccgcagatgcggtcacccaaaacctcgacattatccgccgttataaagcggaatacgtggtgatcctggcgggcgaccatatctacaagcaagactactcgcgtatgcttatcgaccacgtcgaaaaaggtgcacgttgcaccgttgcttgtatgccagtaccgattgaagaagcctccgcgtttggcgttatggcggttgatgagaacgataaaattatcgaattcgttgaaaaaccagctaacccgccgtcaatgccgaacgatccaggcaaatctctggcgagtatgggtatttacgtctttgacgccgactatctgtatgaactgctggaagaagacgatcgcgatgagaactccagccacgactttggcaaagatttgattcccaagatcaccgaagccggtctggcctatgcgcacccgttcccgctctcttgcgtacaatccgacccggatgccgagccgtactggcgcgatgtgggtacgctggaagcttactggaaagcgaacctcgatctggcctctgtggtgccggaactggatatgtacgatcgcaattggccaattcgcacctacaatgaatcattaccgccagcgaaattcgtgcaggatcgctccggtagccacgggatgacccttaactcactggtatccggcggttgtgtgatctccggttcggtggtggtgcagtccgttctgttctcgcgcgttcgcgtgaattcattctgcaacattgattccgccgtattgttaccggaagtatgggtaggtcgctcgtgccgtctgcgccgctgcgtcatcgatcgtgcttgtgttattccggaaggcatggtgattggtgaaaacgcagaggaagatgcacgtcgtttctatcgttcagaagaaggcatcgtgctggtaacgcgcgaaatgctacggaagttagggcataaacaggagcgataa

SEQ ID NO: 8006 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPGKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 8007 - DNA, 1974 bp, Escherichia coli
atgacacaactcgccattggcaaacccactcccctcggcgcgcattacgacggtcagggcgtcaacttcacacttttctccgctcatgccgagcgggtagagctgtgtgtctttgatgccaatggccaggaacatcgctatgacttgccagggcacagtggcgacatttggcacggttatctgccggatgcgcgcccgggtttgcgttatggttatcgcgttcatggcccctggcaacccgccgaggggcatcgctttaacccggcgaagttgttgattgatccttgcgcgcggcaaattgacggggagtttaaagataacccgctgctgcacgccggtcataatgaacctgactatcgcgacaacgcctccattgcgccgaaatgcgtagtggtggttgatcactatgactgggaggatgatgccccgccgcgcatgccgtggggctgcaccatcatttatgaagcccatgtcaaaggattaacgtatctgcacccggagatcccggtcgagatccgtggcacttataaagccctggggcatccggtgatgatcaactatttgaaacagttgggcattaccgcgctggagttgctgccggtggcacaatttgccagcgaaccacgtctgcaacgcatggggcttagtaactactgggggtacaacccggtggcgatgtttgcgctgcatccggcgtatgcctgctcgccagaaacggcgctggatgagtttcgcgatgcaatcaaagcactgcataaagcgggtatcgaagtcattcttgatatcgtgctcaaccatagtgcggaactggacctcgacggcccgttattctcgctgcgtgggatcgacaaccgtagctattattggataagagaagacggcgattatcacaactggaccggttgtggtaacacgctcaatttgagtcatccggcggtggtagattatgccagcgcctgcctgcgttattgggtagaaacctgccacgtcgatggtttccgctttgatctggcggcagtcatgggccgtacgccagagtttcgtcaggatgcgccgttgtttaccgctatccagaactgcccggtgctctcgcaggtgaagttaattgctgaaccgtgggatatcgctcctggtggttatcaggtgggaaatttcccgccgctgtttgccgagtggaacgatcatttccgcgatgcagcccgtcgtttctggctgcattatgatttacctctgggagcgtttgccgggcgttttgctgcctccagcgatgtttttaaacgtaatggtcgtctgccgagtgccgcgattaatctcgtcaccgcgcatgacggttttacgcttcgcgactgcgtttgcttcaaccataaacacaatgaagcaaacggagaagaaaatcgcgacgggaccaacaacaattacagtaacaatcatggtaaagaagggttaggcggtactcttgatctggttgaacggcggcgcgacagcattcacgccctgttaacaacgttgttgctctcccagggtacgccgatgttactggccggtgacgaacatggtcacagccagcgtggcaataacaatgcctactgtcaggataaccaattaacctggttggactggtcgcaggcaagcagtggtttaaccgcatttaccgccgcgttaatccatctgcgcaagcgcattcccgctttgatggagaatcgctggtgggaagaaggcgacggcaatgtccgttggctaaatcgatatgctcaacctttaagcacggatgagtggcaaaacgggccgaaacagctgcaaattctgctctcggatcgctttttgatcgcaattaacgccacgcttgaggtaacagagattgttttacctgctggggagtggcacgccattcccccattcgctggagaggataacccagtgattacggctgtctggcagggacctgcacacggattgtgtgtgttccagagatga

SEQ ID NO: 8008 - protein, 657 aa, Escherichia coli
MTQLAIGKPTPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNASIAPKCVVVVDHYDWEDDAPPRMPWGCTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGTLDLVERRRDSIHALLTTLLLSQGTPMLLAGDEHGHSQRGNNNAYCQDNQLTWLDWSQASSGLTAFTAALIHLRKRIPALMENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 8009 - DNA, 2187 bp, Escherichia coli
atgtccgatcgtatcgatagagacgtgattaacgcgctaattgcaggccattttgcggatcctttttccgtactggggatgcataaaaccaccgcgggactggaagtccgtgcccttttacccgacgctaccgatgtgtgggtgattgaaccgaaaaccgggcgcaaactcgcaaaactggagtgtctcgactcacggggattctttagcggtgtcattccgcgacgtaagaattttttccgctatcagttggctgttgtctggcatggtcagcaaaacctgattgatgatccttaccgttttggcccgctaatccaggaaatggatgcctggctattatctgaaggtactcacctacgtccgtatgaaaccttaggcgcgcatgcagatactatggatggcgtcacaggtacgcgtttttctgtctgggctccaaacgcccgtcgggtctcggtggttgggcaattcaactactgggacggtcgccgtcatccgatgcgactgcgtaaagagagcggaatctgggaactgtttatccccggggcgcataacggtcagctctataaatacgagatgattgatgccaatggcaacttgcgcctgaagtccgacccttatgccttcgaagcgcaaatgcgcccggaaaccgcgtctcttatttgcggcctgccggaaaaggttgtgcagactgaagagcgcaaaaaagcgaatcagtttgatgcgccaatctctatttatgaagttcaccttggctcctggcgtcgccacaccgacaacaatttctggttgagctaccgcgagctggccgatcaactggtgccttatgctaaatggatgggctttacccatctcgagctactgcctattaacgagcatcccttcgatggcagttggggttatcagccaaccggcctgtatgcaccgacccgccgttttggtactcgcgacgacttccgttatttcattgatgccgcacacgcagctggtctgaacgtgattctcgactgggtgccaggccacttcccgaccgatgactttgcgcttgccgaatttgatggcacgaacttgtatgaacacagcgatccgcgcgaaggctatcatcaggactggaacacgctgatctacaactatggtcgccgcgaagtcagtaacttccttgtcggtaacgcactttactggattgaacgttttggtattgatgcgctgcgcgtcgatgcggtggcgtcaatgatttatcgcgactacagccgtaaagagggggagtggatcccgaacgaatttggcggtcgcgagaatcttgaagcgattgaattcttgcgtaataccaaccgtattcttggtgagcaggtttccggtgcagtgacaatggcggaggagtctaccgatttccctggcgtttctcgtccgcaggatatgggcggtctgggcttctggtacaagtggaacctcggctggatgcatgacaccctggactacatgaagctcgacccgatttatcgtcagtatcatcacgataaactgaccttcgggatgctctacaactacactgaaaacttcgtcctgccgttgtcgcatgatgaagtggtccacggtaaaaaatcgattctcgaccggatgccgggcgacgcatggcagaaattcgctaacctgcgcgcctactacggctggatgtgggcattcccgggcaagaaactactgttcatggggaacgaatttgcccagggccgcgagtggaaccatgacgccagcctcgactggcatctgttggaaggcggcgataactggcaccacggtgtccagcgtctggtgcgcgatctgaaccacacctaccgccaccataaagcaatgcatgaactggattttgacccgtacggctttgaatggctggtggtggatgacaaagaacgctcggtgctgatctttgtgcgtcgcgataaagagggtaacgaaatcatcgttgccagtaactttacaccggtgccgcgtcatgattatcgcttcggtattaaccagccgggtaaatggcgtgaaatcctcaataccgattccatgcactatcacggcagtaatgcaggcaatggcggcgcagtacacagcgatgagattgccagccacggtcgtcagcattcactgagcctgacgctaccacctctggccactatctggctggttcgggaggcagaatga

SEQ ID NO: 8010 - protein, 728 aa, Escherichia coli
MSDRIDRDVINALIAGHFADPFSVLGMHKTTAGLEVRALLPDATDVWVIEPKTGRKLAKLECLDSRGFFSGVIPRRKNFFRYQLAVVWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICGLPEKVVQTEERKKANQFDAPISIYEVHLGSWRRHTDNNFWLSYRELADQLVPYAKWMGFTHLELLPINEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTLDYMKLDPIYRQYHHDKLTFGMLYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNHTYRHHKAMHELDFDPYGFEWLVVDDKERSVLIFVRRDKEGNEIIVASNFTPVPRHDYRFGINQPGKWREILNTDSMHYHGSNAGNGGAVHSDEIASHGRQHSLSLTLPPLATIWLVREAE

SEQ ID NO: 8011 - DNA, 1104 bp, Escherichia coli
atgaaaaatgttggttttatcggctggcgcggtatggtcggctccgttctcatgcaacgcatggttgaagagcgcgacttcgacgccattcgccctgtcttcttttctacttctcagcttggtcaggctgcgccgtcttttggcggaaccactggcacacttcaggatgcctttgatctggaggcgctaaaggccctcgatatcattgtgacctgtcagggcggcgattataccaacgaaatctatccaaagcttcgtgaaagcggatggcaaggttactggattgacgcagcatcatctctgcgcatgaaagatgacgccatcatcattcttgaccccgtcaatcaggacgtcattaccgacggattaaataatggtatcaggacttttgttggcggtaactgtaccgtaagcctgatgttgatgtcgctggggggtttattcgccaatgatcttgttgattgggtgtccgttgcaacctaccaggccgcttccggcggtggtgcgcgacatatgcgtgagttattaacccaaatgggccatctgtatggccatgtggcagatgaactcgcgaacccgtcctctgctattctcgatatcgaacgcaaagtcacaaccttaacccgtagcggtgagctgccggtagataactttggcgtgccgctggcgggtagcctgattccgtggatcgacaaacagcttgataacggtcagagccgcgaagagtggaaagggcaggcggaaaccaacaagatcctcaacacatcttccgtaattccggtagatggtttatgtgtgcgtgtcggggcattgcgctgccacagccaggcattcactattaaattgaaaaaagatgtgtctattccgaccgtggaagaactgctggctgcgcacaatccgtgggcgaaagttgttccgaacgatcgggaaatcactatgcgtgagctaaccccagctgccgttaccggcacgctgaccacgccggtaggccgcctgcgtaagctgaatatgggaccggagttcctgtcagcctttaccgtgggcgaccagctgctgtggggggccgcggagccgctgcgtcggatgcttcgtcaactggcgtaa

SEQ ID NO: 8012 - protein, 367 aa, Escherichia coli
MKNVGFIGWRGMVGSVLMQRMVEERDFDAIRPVFFSTSQLGQAAPSFGGTTGTLQDAFDLEALKALDIIVTCQGGDYTNEIYPKLRESGWQGYWIDAASSLRMKDDAIIILDPVNQDVITDGLNNGIRTFVGGNCTVSLMLMSLGGLFANDLVDWVSVATYQAASGGGARHMRELLTQMGHLYGHVADELANPSSAILDIERKVTTLTRSGELPVDNFGVPLAGSLIPWIDKQLDNGQSREEWKGQAETNKILNTSSVIPVDGLCVRVGALRCHSQAFTIKLKKDVSIPTVEELLAAHNPWAKVVPNDREITMRELTPAAVTGTLTTPVGRLRKLNMGPEFLSAFTVGDQLLWGAAEPLRRMLRQLA

SEQ ID NO: 8013 - DNA, 594 bp, Escherichia coli
atgaatgaaatcatttctgcaacagttttattgatcctgattatggatccgctcggaaacctacctattttcatgtccgtactgaaacatactgaaccgaaaagacggcgggcaatcatggtgcgagagttgcttattgctctccttgtgatgctggtgttcctgtttgcgggcgagaaaattctggcatttcttagcctgcgggcagaaaccgtctccatttctggcggcatcattctgtttctgatcgccattaagatgattttccccagcgcttcaggaaatagcagcgggcttccggcaggtgaagagccatttatcgtgccgttggcaattccgctggtcgccgggccgactattctcgccacgctgatgttgttgtctcatcagtacccgaatcagatgggacatctggtgattgctctgctgctggcctggggcggcacctttgtcatcctgctacagtcttcgctatttttacgtctgctgggcgagaaaggggtgaacgcacttgaacgcctgatgggattgattctggtgatgatggcaactcagatgttcctcgacggcattcgaatgtggatgaaggggtaa

SEQ ID NO: 8014 - protein, 197 aa, Escherichia coli
MNEIISATVLLILIMDPLGNLPIFMSVLKHTEPKRRRAIMVRELLIALLVMLVFLFAGEKILAFLSLRAETVSISGGIILFLIAIKMIFPSASGNSSGLPAGEEPFIVPLAIPLVAGPTILATLMLLSHQYPNQMGHLVIALLLAWGGTFVILLQSSLFLRLLGEKGVNALERLMGLILVMMATQMFLDGIRMWMKG

SEQ ID NO: 8015 - DNA, 1341 bp, Escherichia coli
gtgactacattaacgcttgttttaacagcagtagggtctgttttactgctgctgtttttagtcatgaaggcgcgtatgcacgctttcctggctttaatggtggtgtccatgggggctggccttttttctggtatgccgctcgataaaatcgcagcgacgatggaaaaagggatgggaggcaccctcggcttcctggcggtggttgtcgccctgggagccatgtttggtaagatcttacatgaaaccggcgcggtcgatcagattgccgtcaaaatgctcaaatccttcggtcacagccgcgtgcattatgctatcggccttgcggggctggtttgtgcgctaccgctgttctttgaagtggcgattgttctgctgattagcgttgctttctcaatggcgcgccacaccggcacgaacctggtgaagctggtaatcccattatttgcaggcgtggcggcagcggctgcgttcctggtgcctgggccagcgccaatgctgctggcatcgcagatgaacgccgactttggctggatgatcctgattggcctgtgcgcggcaattccgggaatgattattgccgggccgctgtggggtaatttcatcagccgctacgtggagttgcatattcctgacgacatcagcgaaccgcatctcggcgaaggcaaaatgccgtccttcggattcagcctgtcgctgatcctgttgccactggtgctggtggggctgaaaaccattgccgcgcgttttgtgccagaaggttctaccgcttacgaatggtttgagtttatcggccatccgtttaccgcgattctggttgcttgcctggtggcgatttacggtctggcaatgcgtcagggtatgccaaaagacaaagtgatggagatttgcggtcacgcgctgcaaccggcggggatcattctgctggtgattggtgcgggcggcgtgttcaaacaggtgctggttgactctggtgtcggtccggcactgggcgaagcgttaaccggcatgggcctgccgattgccatcacctgcttcgtgctggcagctgcagtgcgcatcattcagggttctgccaccgttgcctgtttaacggcggtgggactggtgatgccggtcattgaacaactgaactactccggtgcgcaaatggcggcgctgtcgatttgtatcgccggtggttcgattgttgtcagccacgttaacgacgcgggtttctggttgttcggtaaatttaccggcgcgaccgaagccgaaacgcttaaaacctggaccatgatggaaaccatcctcggcactgtcggtgccatcgttgggatgattgcgttccagctgttgagttaa

SEQ ID NO: 8016 - protein, 446 aa, Escherichia coli
MTTLTLVLTAVGSVLLLLFLVMKARMHAFLALMVVSMGAGLFSGMPLDKIAATMEKGMGGTLGFLAVVVALGAMFGKILHETGAVDQIAVKMLKSFGHSRVHYAIGLAGLVCALPLFFEVAIVLLISVAFSMARHTGTNLVKLVIPLFAGVAAAAAFLVPGPAPMLLASQMNADFGWMILIGLCAAIPGMIIAGPLWGNFISRYVELHIPDDISEPHLGEGKMPSFGFSLSLILLPLVLVGLKTIAARFVPEGSTAYEWFEFIGHPFTAILVACLVAIYGLAMRQGMPKDKVMEICGHALQPAGIILLVIGAGGVFKQVLVDSGVGPALGEALTGMGLPIAITCFVLAAAVRIIQGSATVACLTAVGLVMPVIEQLNYSGAQMAALSICIAGGSIVVSHVNDAGFWLFGKFTGATEAETLKTWTMMETILGTVGAIVGMIAFQLLS

SEQ ID NO: 8017 - DNA, 528 bp, Escherichia coli
ttgagcacgactaaccatgatcaccacatttacgtcttgatgggcgtatcgggcagcggcaaatctgcggtcgccagtgaagtggcgcatcaacttcatgccgcgtttcttgatggcgatttcctccatccgcgctgcaatatcgaaaaaatggcgtctggcgaaccgctgaatgacgacgatcgcaaaccgtggttgcaggcgctgaacgacgccgcgtttgctatgcagcgcaccaataaagtatcgctgatcgtctgttctgcactgaaaaaacactatcgcgacttgctgcgtgaaggtaatcctaatctctctttcatctacctgaaaggcgattttgatgtgattgaaagccgcctgaaagcgcgcaaaggccatttctttaaaacccaaatgctggtgacgcagtttgaaacgctgcaggagccgggtgcggacgaaaccgatgtactggtggtggatattgatcaaccgctggaaggtgttgtggcaagcaccattgaggttattaaaaaaggcaaataa

SEQ ID NO: 8018 - protein, 175 aa, Escherichia coli
MSTTNHDHHIYVLMGVSGSGKSAVASEVAHQLHAAFLDGDFLHPRCNIEKMASGEPLNDDDRKPWLQALNDAAFAMQRTNKVSLIVCSALKKHYRDLLREGNPNLSFIYLKGDFDVIESRLKARKGHFFKTQMLVTQFETLQEPGADETDVLVVDIDQPLEGVVASTIEVIKKGK

SEQ ID NO: 8019 - DNA, 939 bp, Escherichia coli
atgacggtcagccgttttttacgcaacccggagcaggtttccgtcgctctacgcggcaagattgccgccgctcttgatgaactgggttatattcccaatcgcgcgcccgatatactctctaacgctaccagccgggcgattggcgtcctgttaccttctctcaccaaccaggttttcgcggaagtattacgcggaatcgaaagcgtcaccgacgcgcacggttatcaaaccatgctggcgcactacggttataaaccggaaatggagcaagaacgcctcgaatcaatgctctcatggaatatcgacggcctgatcctcaccgaacgtacccacacgccgcgtaccttaaagatgattgaagtggcggggattccggtggtggagttgatggacagtaagtcgccgtgcctcgatatcgccgtcggttttgataactttgaagcggcacgccagatgaccaccgccattattgctcgcgggcatcgtcacattgcctatctcggcgcacgcctcgacgaacgtactatcatcaaacagaagggatacgaacaggcgatgctggatgcaggcctggtgccgtatagcgtgatggttgagcaatcttcttcttactcttccggtattgaactgattcgccaggcgcggcgggaatatccgcagctggatggcgtgttctgtactaatgatgacctggcggtcggcgcggcgtttgaatgtcagcgtttggggttgaaagttcctgacgatatggcgattgccggtttccacggtcatgacattggtcaggtgatggagccacggctagcgagtgtgctgacgccgcgtgagcggatgggcagcattggcgctgagcgcctgctggcgcgtattcgtggcgaatctgtgataccgaaaatgttagatttaggtttcaccttgtcaccgggcggatctatttaa

SEQ ID NO: 8020 - protein, 312 aa, Escherichia coli
MTVSRFLRNPEQVSVALRGKIAAALDELGYIPNRAPDILSNATSRAIGVLLPSLTNQVFAEVLRGIESVTDAHGYQTMLAHYGYKPEMEQERLESMLSWNIDGLILTERTHTPRTLKMIEVAGIPVVELMDSKSPCLDIAVGFDNFEAARQMTTAIIARGHRHIAYLGARLDERTIIKQKGYEQAMLDAGLVPYSVMVEQSSSYSSGIELIRQARREYPQLDGVFCTNDDLAVGAAFECQRLGLKVPDDMAIAGFHGHDIGQVMEPRLASVLTPRERMGSIGAERLLARIRGESVIPKMLDLGFTLSPGGSI

SEQ ID NO: 8021 - DNA, 696 bp, Escherichia coli
atgatctacttacgcaaagcaaatgaacgcggtcatgcaaatcatggctggctggactcctggcatactttctcttttgccaactattacgatccgaattttatgggcttctctgcgctgcgcgtgattaacgacgacgtgattgaagcagggcagggcttcggcactcacccgcataaagatatggaaattttgacctacgtgctggaaggtactgttgagcatcaggacagcatgggcaataaagagcaggttccggcgggcgagttccagattatgagtgcgggtacgggtattcgtcactcagagtacaacccaagcagcaccgagcgtctgcatctgtatcagatctggatcatgcctgaagaaaacggcattacgccgcgttatgaacagcgtcgcttcgatgccgtgcagggcaaacaactggtgctttcgccggatgcgcgtgatggttcattgaaagtgcatcaggatatggaactgtatcgttgggcgctggtgaaagatgagcagtcggtgcatcagattgccgctgaacgccgcgtctggatccaggtggtgaaaggcaatgtcaccattaacggcgtgaaagcctcgaccagcgatggcctggcaatctgggatgagcaggcgatttccatccatgctgatagcgacagtgaaatcctgctgttcgatttaccgccagtctaa

SEQ ID NO: 8022 - protein, 231 aa, Escherichia coli
MIYLRKANERGHANHGWLDSWHTFSFANYYDPNFMGFSALRVINDDVIEAGQGFGTHPHKDMEILTYVLEGTVEHQDSMGNKEQVPAGEFQIMSAGTGIRHSEYNPSSTERLHLYQIWIMPEENGITPRYEQRRFDAVQGKQLVLSPDARDGSLKVHQDMELYRWALVKDEQSVHQIAAERRVWIQVVKGNVTINGVKASTSDGLAIWDEQAISIHADSDSEILLFDLPPV

SEQ ID NO: 8023 - DNA, 1038 bp, Escherichia coli
atggtcattaactgcgcctttattggcttcggcaaaagcaccacccgttaccatctgccgtatgtacttaaccgcaaggatagctggcatgtcgcgcatatttttcgccgccatgcgaagccggaagaacaggcccccatttattcccatatccatttcaccagcgatctcgacgaagtgctaaacgatcccgatgttaagctggttgtcgtctgcacccacgcggacagccacttcgagtacgcgaagcgcgcgctggaagccgggaaaaatgtgctggtcgaaaaaccgttcactccgacaattgcgcaggcgaaagagctgtttgcactggcgaaaagcaaagggctgatcgttacgccgtatcagaatcgtcgctttgattcctgcttcctgacagcgaaaaaagcgattgaaagcggcaagctgggagagattgtcgaagtggaaagccattttgactattaccgcccggtggcagaaaccaaaccggggctgccgcaggatggcgcgttctatggccttggtgtgcatacgatggaccagattatttctctgttcggtcgcccggatcacgtcgcttatgacatccgcagcctgcgtaataaagccaatccggacgacacctttgaagcgcagctgttttatggcgatctaaaagccatcgtcaaaaccagccatctggtgaaaatcgattatccgaaatttatcgttcacggtaagaaaggttcgtttattaaatacggtatcgaccagcaggaaaccagcctgaaggctaatattatgccgggcgaaccaggattcgcagcggatgattcggtcggtgtgctggagtatgtcaatgacgagggcgtgacggtaagagaagagatgaagccagagatgggcgattatgggcgcgtttatgatgcgttgtatcaaaccatcaccaacggtgcgccaaattacgtcaaggaatctgaagttcttacgaatctggaaatccttgaacgcggttttgagcaatcttctccctccgcagtgactctcgcgaggtaa

SEQ ID NO: 8024 - protein, 345 aa, Escherichia coli
MVINCAFIGFGKSTTRYHLPYVLNRKDSWHVAHIFRRHAKPEEQAPIYSHIHFTSDLDEVLNDPDVKLVVVCTHADSHFEYAKRALEAGKNVLVEKPFTPTIAQAKELFALAKSKGLIVTPYQNRRFDSCFLTAKKAIESGKLGEIVEVESHFDYYRPVAETKPGLPQDGAFYGLGVHTMDQIISLFGRPDHVAYDIRSLRNKANPDDTFEAQLFYGDLKAIVKTSHLVKIDYPKFIVHGKKGSFIKYGIDQQETSLKANIMPGEPGFAADDSVGVLEYVNDEGVTVREEMKPEMGDYGRVYDALYQTITNGAPNYVKESEVLTNLEILERGFEQSSPSAVTLAR

SEQ ID NO: 8025 - DNA, 195 bp, Escherichia coli
atgccagctatccttgcggttaagtacatacggcagatggtaacgggtggtgcttttgccgaagccaataaaggcgcagttaatgaccatgatttcgtcctttttaaggtggttatttacaccttagcgcaaagcggacgtggttcctactggagtgcgcataacgaacacaagcacttcccgaggataaattga

SEQ ID NO: 8026 - protein, 64 aa, Escherichia coli
MPAILAVKYIRQMVTGGAFAEANKGAVNDHDFVLFKVVIYTLAQSGRGSYWSAHNEHKHFPRIN

SEQ ID NO: 8027 - DNA, 567 bp, Escherichia coli
ttgcaaaaaaatgcatttgactcgcatttgaaagtcaatgatgttgaaagggacatttaccccaaagaggacaaaggaatgagtgagatagtaatacgccacgcagaaacacgcgatcacgaagccatcaggcagattcacgcccagccggaggtgtattacaacacgctacaggtgcctcatccttcagaacaaatgtggctggaacgactcaccgctcgccctggcatcaagcagttagtcgcctgtattgatggaatcgtcgtaggccatctcaccattgacgtgcaacaacgcccacgccgcagtcatgttgccgattttggtatctgtgtcgactctcgctggaagaaccgcggcgtcgccagcgccctgatgcgcgaaatgattgatatgtgcgacaactggttgcgggtagatcgcatcgagctaacggtgttcgtcgataacgcgccagcaattaaggtctataaaaaattcggctttgagattgaagggactggcaaaaagtacgcattacgtaatggtgaatatgtcgatgcgtattatatggcgcgggtgaagtaa

SEQ ID NO: 8028 - protein, 188 aa, Escherichia coli
MQKNAFDSHLKVNDVERDIYPKEDKGMSEIVIRHAETRDHEAIRQIHAQPEVYYNTLQVPHPSEQMWLERLTARPGIKQLVACIDGIVVGHLTIDVQQRPRRSHVADFGICVDSRWKNRGVASALMREMIDMCDNWLRVDRIELTVFVDNAPAIKVYKKFGFEIEGTGKKYALRNGEYVDAYYMARVK

SEQ ID NO: 8029 - DNA, 801 bp, Escherichia coli
atgagtaatattgtttatctgacagtaacgggagaacaacaaggaagcatctccgcaggttgtgggactactgaatctataggtaatcgctggcagagcgggcatgaggatgaaatatttacattctcactcttaaatagtattactaatacggggcttggttcacagttccatggtataacattttgtaaattaattgataaaagcactccattatttattaattccattaacaataatgaacaattatttatggaatttgacttctatcgaataaatagatttggtagatgggaaaagtattattatatacaactaagaggcgcttttttatcggctattcatcaccagatctttgaaaaccaactggatacagaaacaataactgttagttatgaatttatcctctgccaacatcttatcactaacaccgagttcagctatttggcactccctgaaaattataaccgcttgtttttaccaaattcaaaaaacaaaacaaataatggtttaaaaacgttaaacagcgaagctgttggcaggctacttgctgctggtggcgtatacaatgggaacattgaaggattcagagatactgcggaaaaactgggtggagatgcaatcaaaggctatgatcaaatactaaatgaaaaaacagcgggcatagcgatagcaacagcatctattcttttaacaaagcgttctaatgttgatacatatacagaaataaatagttacttaggcaaacttagaggccaacaaaaacttcttgatagtatagacataatagaaataatataa

SEQ ID NO: 8030 - protein, 266 aa, Escherichia coli
MSNIVYLTVTGEQQGSISAGCGTTESIGNRWQSGHEDEIFTFSLLNSITNTGLGSQFHGITFCKLIDKSTPLFINSINNNEQLFMEFDFYRINRFGRWEKYYYIQLRGAFLSAIHHQIFENQLDTETITVSYEFILCQHLITNTEFSYLALPENYNRLFLPNSKNKTNNGLKTLNSEAVGRLLAAGGVYNGNIEGFRDTAEKLGGDAIKGYDQILNEKTAGIAIATASILLTKRSNVDTYTEINSYLGKLRGQQKLLDSIDIIEII

SEQ ID NO: 8031 - DNA, 285 bp, Escherichia coli
atgattacttatcacgacgcattcgcgaaagcgaacaattaccttgatgatgcaaatctcccggtcgtcattactctacatggacgctttagccagggctggtatttctgtttcgaagcacgagaatttctcgaaactggagatgaggccgcgcgcttagctggtaacgcaccttttattgttgataaaggcagtggtgaaattcattctctgggaacggcaaagccactggaagaatatctacaggattatgaaataaaaaaggctaccttcggcttgccctga

SEQ ID NO: 8032 - protein, 94 aa, Escherichia coli
MITYHDAFAKANNYLDDANLPVVITLHGRFSQGWYFCFEAREFLETGDEAARLAGNAPFIVDKGSGEIHSLGTAKPLEEYLQDYEIKKATFGLP

SEQ ID NO: 8033 - DNA, 1734 bp, Escherichia coli
atgataaaaccgacgtttttacgccgggtggccattgctgctctgctcacaggaagttgttttagtacggtagccgcgccacctgtttcttatggtgtggaggaagatgtctttcatccggtacgcgctaagcagggaatggtggcgtctgtagatgctactgccactcaggtgggggtggatatcctcaaggagggcgggaatgccgttgatgccgccgtggcggtgggctacgcgctggcagtaacgcatccgcaggcagggaatctgggcggcggtggttttatgctgatccgctcgaaaaatggcaataccacggctatcgatttccgcgaaatggcacccgccaaagcgacccgcgatatgttcctcgatgatcagggcaacccggacagcaaaaaatcactcacttcgcatctggcttccggcacacccggtacggtagcgggtttctcgttggcgctggataaatacggcaccatgccgttgaataaagtggtgcaaccggcgtttaaactggcacgcgatggttttatcgttaacgacgcgctggctgacgatctcaaaacctacggcagtgaagtgctgccgaaccacgaaaacagcaaagctatcttctggaaagagggcgaaccgctgaaaaagggcgacaagctggtgcaggcgaacctggcaaagagcctggagatgattgccgaaaacggcccggatgaattctacaaaggcacgatagcggaacagattgcccaggagatgcagaaaaacggtggcttgatcagcaaagaagatttagcggcatataaagcggtcgaacgcacaccgataagcggcgattatcgcgggtatcaggtttactccatgccaccgccatcttccggcggtattcatatcgtacaaatcctcaatattctggaaaacttcgatatgcagaagtacggctttggcagtgccgacgcgatgcaaatcatggcagaagctgagaaatacgcctatgccgaccgctcggaatatcttggcgacccggattttgtcaaagtaccgtggcaggcgctgaccaataaagcctatgccaaatctattgccgatcaaatcgatatcaataaagcgaagccatccagcgaaattcgtcctggcaagcttgcgccttatgagagtaatcaaactacccattactcagtagtggataaagacggtaacgccgtggcggtgacctatacgctgaataccaccttcggtacgggcattgtcgcgggcgagagcggtattctgcttaataaccaaatggatgatttctccgccaaaccaggcgtaccgaacgtttacgggctggtgggcggtgatgccaacgccgtcgggccgaataaacgcccgctgtcgtcgatgtcaccaaccattgtggtcaaggatggtaaaacctggctggtcaccggaagcccaggcggtagccggattatcaccactgtgctgcaaatggtggtgaatagcatcgattatggaatgaacgtcgccgaagcgaccaatgcgccgcgtttccaccatcagtggttgccggacgagctgcgtgtcgaaaaagggtttagcccggatacgatcaagctgctggaagcaaaaggtcagaaagtggcgctgaaagaggcgatgggcagtacacaaagcattatgattgggccggacggtgagctgtacggtgcatccgacccgcgctcggtggatgatttaacggcggggtattaa

SEQ ID NO: 8034 - protein, 577 aa, Escherichia coli
MIKPTFLRRVAIAALLTGSCFSTVAAPPVSYGVEEDVFHPVRAKQGMVASVDATATQVGVDILKEGGNAVDAAVAVGYALAVTHPQAGNLGGGGFMLIRSKNGNTTAIDFREMAPAKATRDMFLDDQGNPDSKKSLTSHLASGTPGTVAGFSLALDKYGTMPLNKVVQPAFKLARDGFIVNDALADDLKTYGSEVLPNHENSKAIFWKEGEPLKKGDKLVQANLAKSLEMIAENGPDEFYKGTIAEQIAQEMQKNGGLISKEDLAAYKAVERTPISGDYRGYQVYSMPPPSSGGIHIVQILNILENFDMQKYGFGSADAMQIMAEAEKYAYADRSEYLGDPDFVKVPWQALTNKAYAKSIADQIDINKAKPSSEIRPGKLAPYESNQTTHYSVVDKDGNAVAVTYTLNTTFGTGIVAGESGILLNNQMDDFSAKPGVPNVYGLVGGDANAVGPNKRPLSSMSPTIVVKDGKTWLVTGSPGGSRIITTVLQMVVNSIDYGMNVAEATNAPRFHHQWLPDELRVEKGFSPDTIKLLEAKGQKVALKEAMGSTQSIMIGPDGELYGASDPRSVDDLTAGY

SEQ ID NO: 8035 - DNA, 744 bp, Escherichia coli
atgagtaactggccttatccccgcatcgtcgcccatcgtggtggcggtaagctggccccggagaacaccctggcggcaatcgacgtcggggcaaaatacggtcataagatgatcgaatttgacgcgaagttatcgaaagatggcgagatcttcctgctccatgacgacaatctcgaacgtaccagcaacggctggggcgttgcgggcgagctgaactggcaggatttactgcgcgtggatgcaggcagttggtacagcaaagcgtttaaaggtgagccgctgccgttgctttcgcaggtggcggaacgctgccgcgaacacgggatgatggcgaatatcgaaatcaaacccaccactggcactggaccattaacgggcaaaacggtggcgttggcggcacgcgaactgtggaccggtatgacgccgccgctgctgtcatcgtttgagattgatgctttagaagccgcgcaacaggcagcaccggaactgccgcgtggtttattgcttgatgaatggcgcgacgactggcgagaattgaccgcgcgactgggctgcgtctctattcatctcaatcataagttgctcgataaagcgcgagtgatgcagttgaaagatgccggattacggattctggtttataccgtcaataaaccccagcgcgcggcagagttgctgcgctggggcgtggattgcatctgtaccgatgcgattgacgtgattggtccgaactttacggcccaatag

SEQ ID NO: 8036 - protein, 247 aa, Escherichia coli
MSNWPYPRIVAHRGGGKLAPENTLAAIDVGAKYGHKMIEFDAKLSKDGEIFLLHDDNLERTSNGWGVAGELNWQDLLRVDAGSWYSKAFKGEPLPLLSQVAERCREHGMMANIEIKPTTGTGPLTGKTVALAARELWTGMTPPLLSSFEIDALEAAQQAAPELPRGLLLDEWRDDWRELTARLGCVSIHLNHKLLDKARVMQLKDAGLRILVYTVNKPQRAAELLRWGVDCICTDAIDVIGPNFTAQ

SEQ ID NO: 8037 - DNA, 441 bp, Escherichia coli
atgaaacgacttctgcttttgacggcactcctgccgtttgtcggctttgcacagcccattaatactctgaacaaccctaaccagccgggatatcagatccccagccagcagcggatgcaaactcaaatgcagacgcagcaaatccagcaaaaagggatgctgaaccagcaactgaaaacgcaaacgcagctgcaacagcagcatttagaaaaccagataaacaataattctcagcgggtgttgcagtcacagccgggggagcgaaatcccgcccggcagcaaatgctgcccaacaccaacggcgggatgttaaacagcaaccgtaatccggatagttcgttgaatcagcagcatatgctgccggagaggagaaacggcgacatgctgaatcagcccagcacgccgcagcctgacattccgttgaaaactattgggccgtaa

SEQ ID NO: 8038 - protein, 146 aa, Escherichia coli
MKRLLLLTALLPFVGFAQPINTLNNPNQPGYQIPSQQRMQTQMQTQQIQQKGMLNQQLKTQTQLQQQHLENQINNNSQRVLQSQPGERNPARQQMLPNTNGGMLNSNRNPDSSLNQQHMLPERRNGDMLNQPSTPQPDIPLKTIGP

SEQ ID NO: 8039 - DNA, 1071 bp, Escherichia coli
atggcaggactgaaattacaggcagtaaccaaaagctgggatggcaaaacccaggtcattaaaccgctgacccttgatgtggcggatggcgaatttatcgtgatggtcgggccgtctggctgcgggaaatcgacgttattgcgaatggttgccggactggagcgggtaacgacgggcgatatctggatcgaccgcaagcgtgtcaccgaaatggagccgaaagatcgcgggattgcgatggtgttccagaactacgcgctctatccgcatatgagcgtagaggagaacatggcgtgggggctgaaaattcgcggcatgggcaagcaacaaattgccgaacgtgttaaagaagcggcgcgcattctggagctggacggcctgcttaagcgccgcccgcgtgagctatctggcggtcagcgtcagcgtgtggcgatggggcgtgcgattgtgcgtgagccggcagtgttcctgtttgatgagccgctctctaacctcgatgccaagttgcgtgtgcagatgcgtcttgaactgcaacagctgcaccgtcgcctgaaaacgacttcactctacgttacccacgatcaggttgaggcgatgacgctcgcccagcgagtaatggtgatgaacggcggcgtcgccgaacagattggcacgccagttgaagtgtacgaaaagcccgccagcctgtttgtggcgagttttatcggcagcccggcgatgaacctactggctggccgcgtgaataacgaaggtacgcatttcgaactggatggtggtattacgctgccgctaaacggtggctaccgtcagtatgccgggcgtaaaatgaccctcggcattcgcccggaacatatagcgctaagctcgcaggcagaaggtggtgtgccgctggtgatggacacgctggagatcctcggcgcagataacctggcgcacggacgttggggcgaacagaagctggtggtgcgactggcacatcaggagcgcccgacggcaggcagcacgctgtggctgcatctgccggaaaatcagctgcatctttttgatggtgaaacaggacaacgagtatga

SEQ ID NO: 8040 - protein, 356 aa, Escherichia coli
MAGLKLQAVTKSWDGKTQVIKPLTLDVADGEFIVMVGPSGCGKSTLLRMVAGLERVTTGDIWIDRKRVTEMEPKDRGIAMVFQNYALYPHMSVEENMAWGLKIRGMGKQQIAERVKEAARILELDGLLKRRPRELSGGQRQRVAMGRAIVREPAVFLFDEPLSNLDAKLRVQMRLELQQLHRRLKTTSLYVTHDQVEAMTLAQRVMVMNGGVAEQIGTPVEVYEKPASLFVASFIGSPAMNLLAGRVNNEGTHFELDGGITLPLNGGYRQYAGRKMTLGIRPEHIALSSQAEGGVPLVMDTLEILGADNLAHGRWGEQKLVVRLAHQERPTAGSTLWLHLPENQLHLFDGETGQRV

SEQ ID NO: 8041 - DNA, 846 bp, Escherichia coli
atgattgagaaccgtccgtggctgacaatattcagccataccatgctgatcctcgggatcgcggtgatcctcttcccgctgtacgtggcgtttgtcgcggcgacgctggataaacaagaagtctatgccgcaccgatgacgctaatccccggcacacatctgctggaaaacatccacaacatctgggtaaacggggtaggcacgaatagcgcgccgttctggcggatgttgcttaacagctttgtgatggcgttcagcattacgctcggcaaaattaccgtctcgatgctctcggcatttgccattgtctggtttcgttttccgctacgtaacctcttcttctggatgatttttatcaccctgatgttgccggttgaagtgcgtatcttcccgacggtggaagtcatcgccaacctgaaaatgctcgacagctacgcaggtttaacgctgccgctgatggcctcggcgaccgccacgtttctgtttcgccagttctttatgaccctaccggatgaactggtggaagccgcgcggatcgacggcgcgtcgccaatgcgtttcttttgcgacatcgtttttccgctgtccaaaaccaatctggcggcgctgtttgtgattacctttatttacggctggaaccagtatttgtggccgttgttgattattaccgacgttgatctcggcaccaccgtggcagggattaaagggatgatcgccacaggcgaaggcacaacggaatggaactcggtgatggcggcgatgttgttaaccctgatcccaccagtagtgattgttttagtgatgcagcgtgccttcgtgcgcggcctggtcgatagtgagaaataa

SEQ ID NO: 8042 - protein, 281 aa, Escherichia coli
MIENRPWLTIFSHTMLILGIAVILFPLYVAFVAATLDKQEVYAAPMTLIPGTHLLENIHNIWVNGVGTNSAPFWRMLLNSFVMAFSITLGKITVSMLSAFAIVWFRFPLRNLFFWMIFITLMLPVEVRIFPTVEVIANLKMLDSYAGLTLPLMASATATFLFRQFFMTLPDELVEAARIDGASPMRFFCDIVFPLSKTNLAALFVITFIYGWNQYLWPLLIITDVDLGTTVAGIKGMIATGEGTTEWNSVMAAMLLTLIPPVVIVLVMQRAFVRGLVDSEK

SEQ ID NO: 8043 - DNA, 888 bp, Escherichia coli
atgtcatcatcccgtccggtgttccgctcgcgctggctgccttatttgctggtcgcgccgcagctcatcatcaccgttatcttttttatctggcctgcgggcgaagcgttgtggtactcgctacaaagcgtcgatccgtttggtttctccagccagtttgtcggcctggataatttcgtcacgctgtttcacgacagctactatctcgacgccttctggacgacgataaaattcagcacctttgtcaccgtcagcggtttgctggtatcgctgttcttcgcagcgctggtggagtacatcgtgcgcggcagtcgtttctatcaaaccttgatgctgctgccgtatgccgtggctcccgccgttgccgccgtattgtggatctttctgtttaaccctggtcgcgggctgatcacccattttctcgctgagttcggctacgactggaaccacgcgcaaaacagcggtcaggcgatgttcctggtggtgtttgcctcagtgtggaagcaaatcagctacaactttctgttcttctatgccgcgctgcaatccatcccccgttcgttgatcgaagccgcagccattgatggggcagggccgattcgccgcttctttaagattgcgctgccgcttatcgctccggtgagtttcttcctgctggtggtgaacctggtgtatgccttcttcgacaccttcccggtgatcgacgccgccacgtccggcgggccagtacaggccaccacgacgctgatttataagatttaccgtgaaggctttaccggactggatttggcttcgtctgccgcgcagtcggtggtgttgatgttcctcgtcatcgtgctgacggtggtgcagttccgctatgttgaaagcaaggtacgttaccaatga

SEQ ID NO: 8044 - protein, 295 aa, Escherichia coli
MSSSRPVFRSRWLPYLLVAPQLIITVIFFIWPAGEALWYSLQSVDPFGFSSQFVGLDNFVTLFHDSYYLDAFWTTIKFSTFVTVSGLLVSLFFAALVEYIVRGSRFYQTLMLLPYAVAPAVAAVLWIFLFNPGRGLITHFLAEFGYDWNHAQNSGQAMFLVVFASVWKQISYNFLFFYAALQSIPRSLIEAAAIDGAGPIRRFFKIALPLIAPVSFFLLVVNLVYAFFDTFPVIDAATSGGPVQATTTLIYKIYREGFTGLDLASSAAQSVVLMFLVIVLTVVQFRYVESKVRYQ

SEQ ID NO: 8045 - DNA, 1317 bp, Escherichia coli
atgaaaccgttacgttatacagcttcagcactggcgctcggactggctttaatggcaaatgcgcaggcagtgacgaccattccgttctggcattcgatggaaggggaactgggtaaagaggtggattctctggcccaacgttttaacgccgaaaacccggattacaaaattgtaccgacctataaaggcaactacgaacagaatttaagcgcggggattgccgcatttcgtaccggcaacgctccggctattttgcaggtttatgaagttggcaccgccaccatgatggcgtcgaaagccattaaaccggtgtatgacgtgtttaaagaggcggggattcaattcgatgagtcgcagtttgtgccgacggtttcaggctactactccgacagcaaaaccggccacttactctcccagccgttcaacagctcgactcccgttctctattacaacaaagacgccttcaagaaagcaggattagacccggaacagccgccaaaaacctggcaggatctggcggactatgccgcaaaactgaaagcctccggtatgaagtgcggctacgccagcggctggcagggatggatccaactggaaaactttagcgcctggaacggtttgccgtttgccagcaaaaacaacggctttgacggcacagacgcggtgcttgagttcaacaagccggagcaggtgaaacacatcgccatgctcgaagagatgaacaagaagggcgatttcagctacgttgggcgtaaggatgaatccaccgagaagttctataacggtgattgcgcgatgaccaccgcctcttccggttctctcgccaacattcgcgagtacgccaaatttaactatggcgtaggcatgatgccttacgatgccgatgcgaaagatgcgccacaaaacgccattatcggcggagccagtctatgggtaatgcagggtaaagataaagaaacctacaccggcgtggcgaagttcctcgacttcctcgcaaagccagaaaacgctgccgagtggcatcagaaaaccggctatctgccaatcactaaagcggcgtatgacctgacccgtgagcagggcttttacgagaaaaacccaggagcggatattgccacgcgtcagatgctgaacaagccaccgttgccgttcaccaaaggtttgcgtctgggcaacatgccgcagatccgcgtgattgtggatgaagagctggagagcgtgtggaccggtaagaagacaccacagcaggcgctggatactgccgttgagcgtgggaaccagttactgcgccgctttgagaaatcgacgaagtcttaa

SEQ ID NO: 8046 - protein, 438 aa, Escherichia coli
MKPLRYTASALALGLALMANAQAVTTIPFWHSMEGELGKEVDSLAQRFNAENPDYKIVPTYKGNYEQNLSAGIAAFRTGNAPAILQVYEVGTATMMASKAIKPVYDVFKEAGIQFDESQFVPTVSGYYSDSKTGHLLSQPFNSSTPVLYYNKDAFKKAGLDPEQPPKTWQDLADYAAKLKASGMKCGYASGWQGWIQLENFSAWNGLPFASKNNGFDGTDAVLEFNKPEQVKHIAMLEEMNKKGDFSYVGRKDESTEKFYNGDCAMTTASSGSLANIREYAKFNYGVGMMPYDADAKDAPQNAIIGGASLWVMQGKDKETYTGVAKFLDFLAKPENAAEWHQKTGYLPITKAAYDLTREQGFYEKNPGADIATRQMLNKPPLPFTKGLRLGNMPQIRVIVDEELESVWTGKKTPQQALDTAVERGNQLLRRFEKSTKS

SEQ ID NO: 8047 - DNA, 714 bp, Escherichia coli
atggaaaaagtcatgttgtcctttgacaaagtcagcgcccactacggcaaaatccaggcgctgcatgaggtgagcctgcatatcaatcagggcgagattgtcaccctcattggcgcgaacggggcggggaaaaccaccttgctcggcacgttatgcggcgatccgcgcgccaccagcgggcgaattgtgtttgatgataaagacattaccgactggcagacggcgaaaatcatgcgcgaagcggtagcgattgtcccggaagggcgtcgtgtcttctcgcggatgacggtggaagagaacctggcgatgggcggcttttttgccgaacgcgaccagttccaggagcgcataaagtgggtctatgaactgtttccacgtctgcatgagcgccgtgttcagcgagcgggcactatgtctggcggtgaacagcagatgctggcgattggtcgcgcgctgatgagcaacccgcgtttgttgttgcttgatgagccatcgctcgggctggcaccgattatcatccagcaaattttcgacaccatcgaacaactgcgcgagcaggggatgaccatcttccttgtcgagcagaacgccaaccaggcgctaaagctggcggatcgcggctacgtgctggaaaacggtcatgtagtgctctccgataccggcgacgcgctgctggcgaatgaagcggtgagaagtgcgtatttaggcgggtaa

SEQ ID NO: 8048 - protein, 237 aa, Escherichia coli
MEKVMLSFDKVSAHYGKIQALHEVSLHINQGEIVTLIGANGAGKTTLLGTLCGDPRATSGRIVFDDKDITDWQTAKIMREAVAIVPEGRRVFSRMTVEENLAMGGFFAERDQFQERIKWVYELFPRLHERRVQRAGTMSGGEQQMLAIGRALMSNPRLLLLDEPSLGLAPIIIQQIFDTIEQLREQGMTIFLVEQNANQALKLADRGYVLENGHVVLSDTGDALLANEAVRSAYLGG

SEQ ID NO: 8049 - DNA, 768 bp, Escherichia coli
atgagtcagccattattatctgttaacggcctgatgatgcgcttcggcggcctgctggcggtgaacaacgtcaatcttgaactgtacccgcaggagatcgtctcgttaatcggccctaacggtgccggaaaaaccacggtcttcaactgcctgaccggattctataaacccaccggcggtaccattttactgcgcgatcagcacctggaaggtttaccggggcagcaaattgcccgcatgggcgtggtgcgcaccttccagcatgtacgtctgttccgtgaaatgacggtgattgaaaacctgctggtggcacagcatcagcaactgaaaactgggctgttctccggcctgttgaaaaccccctctttccgtcgcgcccagagcgaagcgctcgaccgcgccgctacctggcttgagcgcattggtttgttggaacatgccaaccgtcaggcgagtaacctggcctatggtgaccagcgtcgtctggagattgcccgctgtatggtgacgcagccggagattttaatgctcgacgaaccggcagcaggtcttaacccgaaagagacgaaagagctggatgagctgattgccgaactgcgtaaccatcacaacaccactatcttgttgattgaacatgatatgaagctggtgatggggatttcagacagaatttacgtggtcaatcaggggacgccgctggcaaacggtacaccggagcagatccgtaataacccggatgtgatccgtgcctatttaggtgaggcataa

SEQ ID NO: 8050 - protein, 255 aa, Escherichia coli
MSQPLLSVNGLMMRFGGLLAVNNVNLELYPQEIVSLIGPNGAGKTTVFNCLTGFYKPTGGTILLRDQHLEGLPGQQIARMGVVRTFQHVRLFREMTVIENLLVAQHQQLKTGLFSGLLKTPSFRRAQSEALDRAATWLERIGLLEHANRQASNLAYGDQRRLEIARCMVTQPEILMLDEPAAGLNPKETKELDELIAELRNHHNTTILLIEHDMKLVMGISDRIYVVNQGTPLANGTPEQIRNNPDVIRAYLGEA

SEQ ID NO: 8051 - DNA, 1278 bp, Escherichia coli
atgaaaccgatgcatattgcaatggcgctgctctctgccgctatgttctttgtgctggcgggcgtctttatgggcgtgcaactggagctggatggcaccaaactggtggtcgacacggcttcagacatccgttggcagtgggtgtttatcggcactgcggtggtctttttcttccagcttttgcgacctgctttccagaaagggctaaaaagcgtttccgggccgaagtttattctgcccgcgattgatggctccacggtgaagcagaaactgttcctcgtggcgctgctggtgcttgcggtggcgtggccgtttatggtgtcgcgtgggacggtggatatcgccactctgaccatgatctacattattctcggtctcgggctgaacgtggttgttggtctttctggtctgctggtgctgggatacggcggcttttacgccatcggcgcttacacttttgcgctgctcaatcactattacggtctgggcttctggacctgtctgccgattgccgggttgatggcggcggcggcgggcttcctgctcggttttccggtgctgcgtctgcgcggtgactatctggcgatcgttaccctcgggttcggcgaaattgtgcgcatattgctgctcaataacaccgaaattaccggcggaccgaacggtatcagtcagattccgaaaccgacgctcttcggactcgagttcagccgtaccgcccgcgaaggcggctgggacacgttcagcaatttctttggcctgaaatacgatccctccgatcgcgtcatcttcctctacctggtggcgttgctgctggtggtgttaagcctgtttgtcattaaccgcctgctgcggatgccgctggggcgtgcgtgggaagcgttgcgtgaagatgaaatcgcttgtcgttcgctgggcttaagcccgcgtcgtatcaagctgactgcctttaccatcagcgctgcgtttgccggttttgccggaacgttgtttgctgcgcgccagggctttgtcagccctgaatccttcacttttgccgaatcggcgtttgtgctggcgatagtggtgctcggcggtatgggctcgcaatttgcagtgattctggcggctgttttgctggtggtatcgcgcgagttgatgcgtgatttcaacgaatacagcatgttaatgctcggtggtttgatggtgctgatgatgatctggcgtccgcagggcttgctgcccatgacgcgcccgcaactcaagctgaaaaacggcgcagcaaaaggagagcaggcatga

SEQ ID NO: 8052 - protein, 425 aa, Escherichia coli
MKPMHIAMALLSAAMFFVLAGVFMGVQLELDGTKLVVDTASDIRWQWVFIGTAVVFFFQLLRPAFQKGLKSVSGPKFILPAIDGSTVKQKLFLVALLVLAVAWPFMVSRGTVDIATLTMIYIILGLGLNVVVGLSGLLVLGYGGFYAIGAYTFALLNHYYGLGFWTCLPIAGLMAAAAGFLLGFPVLRLRGDYLAIVTLGFGEIVRILLLNNTEITGGPNGISQIPKPTLFGLEFSRTAREGGWDTFSNFFGLKYDPSDRVIFLYLVALLLVVLSLFVINRLLRMPLGRAWEALREDEIACRSLGLSPRRIKLTAFTISAAFAGFAGTLFAARQGFVSPESFTFAESAFVLAIVVLGGMGSQFAVILAAVLLVVSRELMRDFNEYSMLMLGGLMVLMMIWRPQGLLPMTRPQLKLKNGAAKGEQA

SEQ ID NO: 8053 - DNA, 927 bp, Escherichia coli
atgtctgagcagtttttgtatttcttgcagcagatgtttaacggcgtcacgctgggcagtacctacgcgctgatagccatcggctacaccatggtttacggcattatcggcatgatcaacttcgcccacggcgaggtttacatgattggcagctacgtctcctttatgatcatcgccgcactgatgatgctgggcattgataccggctggctgctggtggtggcgggattcgtcggcgcaatcgtcattgccagcgcctacggctggagtatcgaacgggtagcctatcgcccggtgcgcaactctaagcgcctgattgcactcatctcggcaatcggtatgtctatcttcctgcaaaactacgttagcctgaccgaaggttcgcgcgacgtggcgctgcccagcctgtttaacggtcagtgggtagtgggtcatagcgaaaacttctctgcctctattactaccatgcaggcggttatctggattgtcaccttcctcgccatgctggcactgacgattttcattcgctattcccgtatggggcgagcctgccgtgcctgcgcggaagatctgaaaatggcgagcctgcttggcatcaacaccgatcgggtgattgcgctgacctttgtgattggcgcggcgatggcggcagtggcgggcgtgctgctcggtcagttctacggcgtaattaacccttacatcggctttatggccgggatgaaagcctttaccgctgcggtgctcggtgggattggcagcattccgggggcgatgattggcgggctgatcctggggattgcggaggcgctctcttctgcctatctgagtacggaatataaagatgtggtctcattcgccctgctgatcctggtgctgctggtgatgccgaccggtattctgggtcgcccggaggtagagaaagtatga

SEQ ID NO: 8054 - protein, 308 aa, Escherichia coli
MSEQFLYFLQQMFNGVTLGSTYALIAIGYTMVYGIIGMINFAHGEVYMIGSYVSFMIIAALMMLGIDTGWLLVVAGFVGAIVIASAYGWSIERVAYRPVRNSKRLIALISAIGMSIFLQNYVSLTEGSRDVALPSLFNGQWVVGHSENFSASITTMQAVIWIVTFLAMLALTIFIRYSRMGRACRACAEDLKMASLLGINTDRVIALTFVIGAAMAAVAGVLLGQFYGVINPYIGFMAGMKAFTAAVLGGIGSIPGAMIGGLILGIAEALSSAYLSTEYKDVVSFALLILVLLVMPTGILGRPEVEKV

SEQ ID NO: 8055 - DNA, 1164 bp, Escherichia coli
ttgttaacacataaaaacaaagcaacacaacatcacgaatggggatttttgactatgaaacggaatgcgaaaactatcatcgcagggatgattgcactgacaatttcacacaccgctatggctgacgatattaaagtcgccgttgtcggcgcgatgtccggcccgattgcccagtggggcgatatggaatttaacggcgcgcgtcaggcaattaaagacattaatgccaaagggggaattaagggcgataaactggttggcgtggaatatgacgacgcctgcgacccgaaacaagccgttgcggtcgccaacaaaatcgttaacgacggcattaaatatgttattggtcatctgtgttcctcctctacccaacctgcatcagatatctatgaagacgaaggtattctgatgatctcgccgggagcgaccaatccggagctgacccaacgcggttatcaatacatcatgcgtactgccgggctggactcttcccaggggccaacggcggcaaaatacattcttgagacggtgaagccccagcgcatcgccatcattcacgacaaacaacagtatggcgaagggctggcacgttcggtgcaggacgggctgaaagcggctaacgccaacgtcgtcttcttcgacggcattaccgctggagagaaagatttctccgcgctgatcgcccgcctgaaaaaagaaaacatcgacttcgtttactacggcggttactacccggaaatggggcagatgctgcgccaggcccgttccgttggcctgaaaacccagtttatggggccggaaggtgtcggtaatgcgtcgctgtcgaacattgccggtgatgccgctgaaggcatgttggtcaccatgccaaaacgctatgaccaggatccgacaaaccagggcatcgttgatgcgctgaaagccgacaagaaagatccgtccgggccctatgtctggatcacctacgcggcggtgcaatctctggcaactgcccttgaacgtaccggcagcgatgagccgctggcgctggtgaaagatttagaagctaacggtgcaaacaccgtaattgggccgctgaactgggatgaaaaaggcgatcttaagggattcgattttggtgtcttccagtggcatgccgacggttcatccacggcagccaagtga

SEQ ID NO: 8056 - protein, 387 aa, Escherichia coli
MLTHKNKATQHHEWGFLTMKRNAKTIIAGMIALTISHTAMADDIKVAVVGAMSGPIAQWGDMEFNGARQAIKDINAKGGIKGDKLVGVEYDDACDPKQAVAVANKIVNDGIKYVIGHLCSSSTQPASDIYEDEGILMISPGATNPELTQRGYQYIMRTAGLDSSQGPTAAKYILETVKPQRIAIIHDKQQYGEGLARSVQDGLKAANANVVFFDGITAGEKDFSALIARLKKENIDFVYYGGYYPEMGQMLRQARSVGLKTQFMGPEGVGNASLSNIAGDAAEGMLVTMPKRYDQDPTNQGIVDALKADKKDPSGPYVWITYAAVQSLATALERTGSDEPLALVKDLEANGANTVIGPLNWDEKGDLKGFDFGVFQWHADGSSTAAK

SEQ ID NO: 8057 - DNA, 384 bp, Escherichia coli
atgaagctgaccatcattcgattagaaaactttagcgaccaggaccggattgacctgcaaaagatctggccggagtattccccttcctctttacaggttgacgataaccaccgtatctacgccgcgcgttttaacgagcgccttctcgcggccgtgcgggtaaccttaagcggcaccgagggggcactggattccctgcgtgtgagggaagtcacccgccgtcgcggtgtggggcaatatctgctggaagaggttttgcgtaacaatcctggcgtttcatgttggtggatggcggatgctggcgtggaagatcgcggcgtgatgacggcgtttatgcgagcactgggatttacggcacaacagggtggctgggagaagcgttaa

SEQ ID NO: 8058 - protein, 127 aa, Escherichia coli
MKLTIIRLENFSDQDRIDLQKIWPEYSPSSLQVDDNHRIYAARFNERLLAAVRVTLSGTEGALDSLRVREVTRRRGVGQYLLEEVLRNNPGVSCWWMADAGVEDRGVMTAFMRALGFTAQQGGWEKR

SEQ ID NO: 8059 - DNA, 1161 bp, Escherichia coli
gtgctgcacaacaacatcacaacacacgtaataaccagaagagtggggattctcaggatgaacataaagggtaaagcgttactggcaggatgtatcgcgctggcattcagcaatatggctctggcagaagatattaaagtcgccgtcgtaggcgcaatgtccggtccggtggcgcagtacggtgaccaggagtttactggcgcagagcaggcggttgcggatatcaatgctaaaggtggtatcaaaggcaacaaactgcaaatcgtaaaatatgacgatgcctgtgacccgaaacaggcggttgcggtggcgaacaaagtcgttaacgacggcattaaatacgtgattggtcacctctgctcttcatcaacgcagccagcgtctgacatctacgaagacgaaggcattttaatgatcaccccagcggcaaccgcaccagagctgaccgcccgtggctatcagctgatcctgcgcaccaccggcctggactcagaccaggggccgacggcggcgaaatatatacttgagaaagtgaaaccgcaacgcattgctatcgttcacgacaaacagcagtacggcgaaggtctggcgcgtgcagtgcaggacggcctgaagaaaggcaatgctaacgtggtgttctttgatggcatcaccgccggggaaaaagatttctctaccctggtggcgcgtttgaagaaagagaatatcgatttcgtttactacggcggttatcacccggaaatggggcaaatcctgcgtcaggcacgcgcggcagggctgaaaactcagtttatggggccagaaggcgtggctaacgtctcgctgtctaacattgcgggcgaatcagcggaagggctgctggtgaccaagccgaagaactacgatcaggttccggcgaacaaaccgattgttgacgcgatcaaagcgaaaaaacaggacccaagcggcgcgttcgtctggaccacctacgccgcgctgcaatctttgcaagcgggcctgaatcagtctgacgatccggcggagatcgctaaatacctgaaagcgaactcggttgatacggtgatggggccgctgacctgggatgagaaaggcgatctgaaaggctttgagttcggtgtgtttgactggcacgccaacggcacggcgactgatgcgaagtaa

SEQ ID NO: 8060 - protein, 386 aa, Escherichia coli
MLHNNITTHVITRRVGILRMNIKGKALLAGCIALAFSNMALAEDIKVAVVGAMSGPVAQYGDQEFTGAEQAVADINAKGGIKGNKLQIVKYDDACDPKQAVAVANKVVNDGIKYVIGHLCSSSTQPASDIYEDEGILMITPAATAPELTARGYQLILRTTGLDSDQGPTAAKYILEKVKPQRIAIVHDKQQYGEGLARAVQDGLKKGNANVVFFDGITAGEKDFSTLVARLKKENIDFVYYGGYHPEMGQILRQARAAGLKTQFMGPEGVANVSLSNIAGESAEGLLVTKPKNYDQVPANKPIVDAIKAKKQDPSGAFVWTTYAALQSLQAGLNQSDDPAEIAKYLKANSVDTVMGPLTWDEKGDLKGFEFGVFDWHANGTATDAK

SEQ ID NO: 8061 - DNA, 402 bp, Escherichia coli
ttgaaccagttcaatattataattctgacacacggtgaggcagggaatgctttactcgccagtagcgaaatgattgtaggtaaaacaccgcatactacagctatttctctgatgccgggaatgtcacctgaagcacttatgcaacaagtaaaaaccatactcaatcctgatgtagaaacaatcatatttacggatatttatggcggcacaccttcaaatatcgcctaccttctttcacgagaatttcccattcgctgcatcagcggtgtcaatctggcaatgttaattgaagccaacatgttacaggattctgacgaagaacagtcctttgatgaatatattcagcatatacatgatgctggtaaagagatgattcaaacttattgttttaataaaggatga

SEQ ID NO: 8062 - protein, 133 aa, Escherichia coli
MNQFNIIILTHGEAGNALLASSEMIVGKTPHTTAISLMPGMSPEALMQQVKTILNPDVETIIFTDIYGGTPSNIAYLLSREFPIRCISGVNLAMLIEANMLQDSDEEQSFDEYIQHIHDAGKEMIQTYCFNKG

SEQ ID NO: 8063 - DNA, 486 bp, Escherichia coli
atgagtatagtacatgcccgtattgattaccgtttaattcatggacaagtcataacaaaatggctaaaaaggagtgatgcaaataaaataattgttattgatgatcccttgtcacgcgatcctttcctggctgaagtctataagatggcagcgccaagtggtgttgaagtcataatgacctccattgaagatacgttacaacgctggaacagcaatagtttctatgaaggtaaattactaattcttttcaaatcgatcgattctgcattaaaaactatacaaggtggtttgatgttagaggaattacaagtcggtggtgttgaaaatactccgggaagaaaaattgtctttaaccaaatatcactcaaccacgaagatgccgacaaacttcaaatcatcgaagataagaatatcaaagtttatttccaaactattcctgaagaagatcctgccagcctacaaaaaatcaaaaataagttaccttaa

SEQ ID NO: 8064 - protein, 161 aa, Escherichia coli
MSIVHARIDYRLIHGQVITKWLKRSDANKIIVIDDPLSRDPFLAEVYKMAAPSGVEVIMTSIEDTLQRWNSNSFYEGKLLILFKSIDSALKTIQGGLMLEELQVGGVENTPGRKIVFNQISLNHEDADKLQIIEDKNIKVYFQTIPEEDPASLQKIKNKLP

SEQ ID NO: 8065 - DNA, 747 bp, Escherichia coli
atgtctatttttacagcagcaatgattgccctggtatattggatatcccaagcaaaagtatggtacggcttttctattatgcgtatgccattatcgatagcacctattatgggactcatctttaatgatatgccaactgctttatctgttggggccaccttacagatgatctatatcgggagtattgccccgggaggaaatcctcctgcagatgaaggtctagcctcgtgtatagcaattccaattgcacttaccgcaggtattaaaccagaaattgctatctctttggctattccactgggattgctcggcgttgttctggaaaacgtacgtaaaacactgaataccacatttatccacatggctgatcgctacgcagaaaaaggtgatataaaaggcatccaacgcgcagccacaatatatcctctcctgttagcctttccgatgcgttttgtaccggtattcatcgcctgcctgtatggcccggatgccattgcctcttttgtaaacctgcttcccgcctggtcgacgaatggcctggcaattgccggtaatattctgcctgcactcggttttgcgataaccataattgttatcggtaagaaacaatacatccctctgttcattattggctttttcctcgtgacctattcaggcttgaataccattggcatctctatttttggactctgtgccgtcctcttatatatgcagtcacaaaatacaaaaggaactaaaaatggataa

SEQ ID NO: 8066 - protein, 248 aa, Escherichia coli
MSIFTAAMIALVYWISQAKVWYGFSIMRMPLSIAPIMGLIFNDMPTALSVGATLQMIYIGSIAPGGNPPADEGLASCIAIPIALTAGIKPEIAISLAIPLGLLGVVLENVRKTLNTTFIHMADRYAEKGDIKGIQRAATIYPLLLAFPMRFVPVFIACLYGPDAIASFVNLLPAWSTNGLAIAGNILPALGFAITIIVIGKKQYIPLFIIGFFLVTYSGLNTIGISIFGLCAVLLYMQSQNTKGTKNG

SEQ ID NO: 8067 - DNA, 855 bp, Escherichia coli
atggataatataattgagtcaggatactcagaatcctcccctattacgaaaagagacgttcagattgtttggctaaaatggcacgcgttctctgaaacatcattgaactttgaacgtttacaagcactggcattttgcaatgcaatgacaggcgtattggcgaagctatacccagatgaaaaagatctcgccaaagccttacagcgccatttaaccatgttcaacacacaggctaactggggctcggttatcgctggtattagtattgcactggaggaaaaagccgcccaggaatcagaagaacaacgtgaatcaacaacacaacttgttacgggtttaaaaactggtcttatggggcctgtatcgggtattggtgacacgttagactttggtacattgcgtcccattgttattggtgtctgtatcccgtttgttattcagggatatgttattgctgcacttctccccctgatttaccaggttagttatatgttcttcgccagtcgatttgctcttaatatcggctataaaaaagggaaagagtcaattctggaaatcttgcattccgggagcatacatcgaattatcgaaggtgctggaatgttcgggctgttgatgatgggggcgctttcagcaacgtatgtaaaaattaagacgccattgcatattacaaccggcggtggcaataccattgtcttacaggatatgctagataaaattgtccctaacatgttgccacttattgccgtgttgggtatttatttttacatacaaaaatgtggccctcatttcttacgtattctggtcactattcttgttttgagtcttgcattttctttctttggccttttataa

SEQ ID NO: 8068 - protein, 284 aa, Escherichia coli
MDNIIESGYSESSPITKRDVQIVWLKWHAFSETSLNFERLQALAFCNAMTGVLAKLYPDEKDLAKALQRHLTMFNTQANWGSVIAGISIALEEKAAQESEEQRESTTQLVTGLKTGLMGPVSGIGDTLDFGTLRPIVIGVCIPFVIQGYVIAALLPLIYQVSYMFFASRFALNIGYKKGKESILEILHSGSIHRIIEGAGMFGLLMMGALSATYVKIKTPLHITTGGGNTIVLQDMLDKIVPNMLPLIAVLGIYFYIQKCGPHFLRILVTILVLSLAFSFFGLL

SEQ ID NO: 8069 - DNA, 951 bp, Escherichia coli
ttgcattttctttctttggccttttataaaatgaaaaagataattatcactccccggccttttgtgggtaaaggcaaggtctatattgataagttaaaatccgcaggttatcaagttgaatgtaataacagtggaggtcgatatagcaaggaagaactcatcgagaaaattaaagacgcgaatgccattatcaccggaaacgatcctctgagcagagaagttattgatcaggcaaaaaacctgaaggttatttcaaaatatggcgtagggttagataacatagatgtcgattacgcaaatagtaaagacatcgtggtacataaagctcttaatgctaactctatttctgttgcagaaatgaccattctgatgatgctctccagttcccgaaaatatgttgaaatcgagagtcaggcaagaaatggtaaggacatcaggcttgtcgggtatgagctatatcaaaaaaatctgggattaattggacttggtgcaattggtcaacatgttgctcatattgctcattctatgggaatgacgattactgctcatgatcctcatattgataaaagcaaggttccatcctatatagaacttaaatcacctgatgaaatatatcagtacagcgatgtaatttctctgcatttacctttactggacagtactcgcaatataattaacgactctgtatttgagaaaatgaaatcttcggctattttaatcaatacagccaggggtggattggtcgatgagaaaagtttatataccgcacttagcaatcagaaaattgcttttgccagtgaagatattgaactgagagaacgttcaaaagaactcaccgaacttaaaaattattctattacccctcatgccgcttcatttaccgatgaggccgaccataacacaatgcaaatttctattaaaaacgtattacaggaactggagaaagagtaa

SEQ ID NO: 8070 - protein, 316 aa, Escherichia coli
MHFLSLAFYKMKKIIITPRPFVGKGKVYIDKLKSAGYQVECNNSGGRYSKEELIEKIKDANAIITGNDPLSREVIDQAKNLKVISKYGVGLDNIDVDYANSKDIVVHKALNANSISVAEMTILMMLSSSRKYVEIESQARNGKDIRLVGYELYQKNLGLIGLGAIGQHVAHIAHSMGMTITAHDPHIDKSKVPSYIELKSPDEIYQYSDVISLHLPLLDSTRNIINDSVFEKMKSSAILINTARGGLVDEKSLYTALSNQKIAFASEDIELRERSKELTELKNYSITPHAASFTDEADHNTMQISIKNVLQELEKE

SEQ ID NO: 8071 - DNA, 885 bp, Escherichia coli
atgaaagagctcaaagggattattaccgcaatggtaacgcctttcgatgaaacggaaaaaatggatatcactgcggcgaaaaaaatggcgcgctggttagtagataatggtgttcatggtttattcatttgcggaactaatggtgaattccatttgctttccgatgacgaaaaagttgagttaacaaaagccgtcgttgaagaggtcggtaatgaagttaccatttgtgcaggtgctgggtgctgcagcacaaaacaaaccatcgaattgactaaacggttagttgatgcgggtgccgattatatttctgttgtcacgccgtactatctggtaccaaatcaggaagatttataccgtcactattacgatattgcctttagcacaacagcccccatcattctctataacctgccgggccagacaggattaagcatcgaatacgaaacggcaaatcgtttagccgatatcaaaaatatcgtagcgataaaagacagtagcggtaaattcgaagtccagaaacagtatctggaaatcgctaaacataaaaactttaaggtattaaacggctctgactcgttaatgctggatgcatttaaagaaggttctgtggctgctgtcgctgcaacgtcgaatgttctgcctacgattgaagtcgatttatataattacttcatggccggtgaaatggagaaggcgcaggaagagcgtaataaaatggatgcactgcgcatgacgatcaagaaaatgaccgcgcctgcagtaatgaaggaagcattaaacctgatgggtgtgaaggcaggtattacacgtagaccaattcatatgccaaacgacgcgatcgttgaagacatcaaggaaatgttgaaaggctataatttcctgtaa

SEQ ID NO: 8072 - protein, 294 aa, Escherichia coli
MKELKGIITAMVTPFDETEKMDITAAKKMARWLVDNGVHGLFICGTNGEFHLLSDDEKVELTKAVVEEVGNEVTICAGAGCCSTKQTIELTKRLVDAGADYISVVTPYYLVPNQEDLYRHYYDIAFSTTAPIILYNLPGQTGLSIEYETANRLADIKNIVAIKDSSGKFEVQKQYLEIAKHKNFKVLNGSDSLMLDAFKEGSVAAVAATSNVLPTIEVDLYNYFMAGEMEKAQEERNKMDALRMTIKKMTAPAVMKEALNLMGVKAGITRRPIHMPNDAIVEDIKEMLKGYNFL

SEQ ID NO: 8073 - DNA, 855 bp, Escherichia coli
atgactgacaaaatgcaaagtttagctttagccccagttggcaacctggattcctacatccgggcagctaacgcgtggccgatgttgtcggctgacgaggagcgggcgctggctgaaaagctgcattaccatggcgatctggaagcagctaaaacgctgatcctgtctcacctgcggtttgttgttcatattgctcgtaattatgcgggctatggcctgccacaggcggatttgattcaggaaggtaacatcggcctgatgaaagcagtgcgccgttttaacccggaagtgggtgtgcgcctggtctccttcgccgtccactggatcaaagcagagatccacgaatacgttctgcgtaactggcgtatcgtcaaagttgcgaccaccaaagcgcagcgcaaactgttctttaacctgcgtaaaaccaagcagcgtctgggctggtttaaccaggatgaagtcgaaatggtggcccgtgaactgggcgtaaccagtaaagacgtacgtgagatggaatcacgtatggcagcacaggacatgacctttgacctgtcttccgacgacgattccgacagccagccgatggctccggtgctctatctgcaggataaatcatctaactttgccgacggcattgaagatgataactgggaagagcaggcagcaaaccgtctgaccgacgcgatgcaaggtctggacgagcgtagccaggatatcatccgcgcgcgctggctggacgaagacaataagtccacgttgcaggaactggctgaccgttacggtgtttccgctgagcgtgtgcgccagctggaaaagaacgcgatgaaaaaacttcgcgctgctattgaagcgtaa

SEQ ID NO: 8074 - protein, 284 aa, Escherichia coli
MTDKMQSLALAPVGNLDSYIRAANAWPMLSADEERALAEKLHYHGDLEAAKTLILSHLRFVVHIARNYAGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVTSKDVREMESRMAAQDMTFDLSSDDDSDSQPMAPVLYLQDKSSNFADGIEDDNWEEQAANRLTDAMQGLDERSQDIIRARWLDEDNKSTLQELADRYGVSAERVRQLEKNAMKKLRAAIEA

SEQ ID NO: 8075 - DNA, 1059 bp, Escherichia coli
atgaataagcgcgatgcaatcaatcatattcggcagtttggcgggcgtctggatcgcttccgtaaatcggtcggcggctctggcgacggcggtcgtaacgcgccaaaacgggcgaaatcctcgccaaaaccggtaaatcgcaaaaccaacgttttcaacgaacaggtgcgctatgccttccacggcgcattgcaggatctgaaaagcaaaccgttcgccacgtttttaacggtgatggttatcgccatctccctgacgctgcccagcgtctgttatatggtgtacaaaaacgttaaccaggcggcgacgcagtattatccgtcaccgcaaatcactgtttatctgcaaaaaacgctggatgatgacgccgctgcgggtgtggtggcacagttacaggccgagcaaggcgtagagaaagtgaattatctttctcgtgaagacgcactgggcgagttccgtaactggtctggttttggtggtgcgctggatatgctggaagaaaacccgcttccggcagtggcggtggtgatcccgaaactcgattttcaggggacggaatcactgaatacgctgcgtgatcgtatcacccagatcaacggcattgacgaagtgcggatggatgacagctggtttgcccgtctggcggcgttaaccgggctggtcgggcgcgtttccgcgatgatcggcgtgttgatggtggcggcagtgttcctcgtcatcggtaacagtgtgcgcctgagtatctttgctcgccgtgactccattaacgtgcagaaactgattggtgcgacggatggtttcatcctgcgtccgttcctgtacggtggcgcattgctgggattttctggcgcattgttgtcactaattttgtcagaaattctggtactgcgtttgtcatcggcggttgcagaagtggcacaggttttcggaacgaagtttgatatcaatggcttatcgttcgatgaatgcctgctattgctgctggtatgctcgatgattggttgggtggcagcgtggcttgccacggtacaacatttacgccactttacgccggaataa

SEQ ID NO: 8076 - protein, 352 aa, Escherichia coli
MNKRDAINHIRQFGGRLDRFRKSVGGSGDGGRNAPKRAKSSPKPVNRKTNVFNEQVRYAFHGALQDLKSKPFATFLTVMVIAISLTLPSVCYMVYKNVNQAATQYYPSPQITVYLQKTLDDDAAAGVVAQLQAEQGVEKVNYLSREDALGEFRNWSGFGGALDMLEENPLPAVAVVIPKLDFQGTESLNTLRDRITQINGIDEVRMDDSWFARLAALTGLVGRVSAMIGVLMVAAVFLVIGNSVRLSIFARRDSINVQKLIGATDGFILRPFLYGGALLGFSGALLSLILSEILVLRLSSAVAEVAQVFGTKFDINGLSFDECLLLLLVCSMIGWVAAWLATVQHLRHFTPE

SEQ ID NO: 8077 - DNA, 669 bp, Escherichia coli
atgattcgctttgaacatgtcagcaaggcttatctcggtgggagacaggcgctgcagggcgttacgttccatatgcagccgggtgagatggcgtttctgaccggtcattccggcgcagggaaaagtaccctcctgaagctgatctgtgggattgagcggcccagcgccgggaaaatctggtttagcggccatgacatcacgcgtctgaaaaaccgtgaagttccgtttctgcgccgccagattggcatgattttccaggatcaccatctactgatggaccgtactgtctatgataacgtggcgatcccgctgattatcgccggtgccagcggtgatgacattcgtcgccgggtgtcggcggcgctggataaagtcgggctactggacaaagcgaagaacttccctattcagctttccggcggtgaacaacagcgtgttggcattgcccgcgcggtggtgaacaagcccgcggtactgctggcggatgaaccgaccggtaacctggacgacgcgttgtcggaaggcattttacgtctgtttgaagagtttaaccgcgttggggtaaccgtattgatggcaacgcacgacatcaacctgatctcgcggcgttcctatcgcatgctcaccctgagcgatggtcacttgcatggaggcgtgggccatgaataa

SEQ ID NO: 8078 - protein, 222 aa, Escherichia coli
MIRFEHVSKAYLGGRQALQGVTFHMQPGEMAFLTGHSGAGKSTLLKLICGIERPSAGKIWFSGHDITRLKNREVPFLRRQIGMIFQDHHLLMDRTVYDNVAIPLIIAGASGDDIRRRVSAALDKVGLLDKAKNFPIQLSGGEQQRVGIARAVVNKPAVLLADEPTGNLDDALSEGILRLFEEFNRVGVTVLMATHDINLISRRSYRMLTLSDGHLHGGVGHE

SEQ ID NO: 8079 - DNA, 1497 bp, Escherichia coli
atggcgaaagaaaaaaaacgtggctttttttcctggctgggctttggtcaaaaagagcagaccccggaaaaagagacagaagttcagaatgaacaaccagttgtagaagaaatcgttcaggcgcaagagcctgtgaaggcttctgaacacgccgttgaagagcagccgcaggcgcatactgaagccgaggcggaaacttttgctgccaacgttgtggaagttactgaacaggttgctgaaagtgaaaaagcgcagcctgaagcggaagtcgttgcacagccggaatcggtcgtagaagaaacgccggagccagtggctatcgaacgtgaagaactgccgttgccggaagacgtcaacgccgaagcggtttcgccagaagagtggcaggccgaagcggaaaccgtagagattgtcgaagcggcggaagaagaagcggctaaagaagaaatcaccgacgaagagccggaggcacaggcgctggctgccgaagtggcagaagaggcggtaatggtggtttctccggcagaagaagagcagccggtggaagaaatcgctcaggagcaggaaaaaccgaccaaagaaggtttcttcgcgcgcctgaaacgcagcctgttaaaaaccaaagaaaatctcggttccggatttatcagcctgttccgcggtaaaaaaatcgacgatgatctgtttgaagagctggaagaacagctgttgatcgccgatgtgggcgtggaaaccactcgtaaaattatcaccaatctgacggaaggcgcatcccgcaagcagcttcgtgatgccgaggcgctctatggcctgctgaaagaagagatgggcgagattctggcgaaagtcgatgagccgctgaatgttgaaggtaaaacgccgttcgtgatcctgatggtgggcgtcaacggtgtgggtaaaaccacgacgattggtaagctggcgcgtcagtttgagcagcagggtaaatcggtgatgctggcggcaggcgatactttccgtgcggcagcggttgaacagcttcaggtctgggggcagcgcaacaatattccggtgattgcccagcataccggtgcggattccgcttctgttatcttcgacgccattcaggccgctaaagcgcgtaacatcgacgtcctgattgccgataccgccggacgcctgcagaacaaatcgcacctgatggaagagttgaagaaaatcgtccgcgtgatgaagaaactcgacgttgaagctccgcatgaagttatgctgactattgatgccagcaccgggcagaatggggtaagccaggccaaactgttccacgaagccgttggcttaaccggcatcacgctaacgaaactggacggcacggcgaaaggcggggtaattttctcggtggctgaccagtttggtatccctatccgctacattggtgtcggcgaacgtattgaggatttgcgtccgtttaaggcggacgactttatagaggcactttttgcccgagaggattaa

SEQ ID NO: 8080 - protein, 498 aa, Escherichia coli
MAKEKKRGFFSWLGFGQKEQTPEKETEVQNEQPVVEEIVQAQEPVKASEHAVEEQPQAHTEAEAETFAANVVEVTEQVAESEKAQPEAEVVAQPESVVEETPEPVAIEREELPLPEDVNAEAVSPEEWQAEAETVEIVEAAEEEAAKEEITDEEPEAQALAAEVAEEAVMVVSPAEEEQPVEEIAQEQEKPTKEGFFARLKRSLLKTKENLGSGFISLFRGKKIDDDLFEELEEQLLIADVGVETTRKIITNLTEGASRKQLRDAEALYGLLKEEMGEILAKVDEPLNVEGKTPFVILMVGVNGVGKTTTIGKLARQFEQQGKSVMLAAGDTFRAAAVEQLQVWGQRNNIPVIAQHTGADSASVIFDAIQAAKARNIDVLIADTAGRLQNKSHLMEELKKIVRVMKKLDVEAPHEVMLTIDASTGQNGVSQAKLFHEAVGLTGITLTKLDGTAKGGVIFSVADQFGIPIRYIGVGERIEDLRPFKADDFIEALFARED

SEQ ID NO: 8081 - DNA, 597 bp, Escherichia coli
atgaaaaaaccgaatcattccggcagcggccaaatccgcattattggcgggcagtggcgaggccgtaaactcccggttcctgatagtccaggtctgcgccccaccaccgaccgcgtacgcgaaacgttgtttaactggctggctccggtcattgttgacgcccaatgtctggattgcttcgccgggagcggcgcgctggggctggaagcgttatcgcgctacgctgcgggggccacgttgattgagatggatcgtgcggtttctcagcagttaattaagaatctggcgacactaaaagcaggcaatgcacgcgtggtgaacagcaacgcgatgtcattcctggcgcaaaaaggcacaccgcataatatcgtgtttgtcgatccaccgttccgccgtggcttgttagaagagacgataaatttactggaagataacggctggctggctgacgaagccctgatttatgtcgaaagcgaagtcgaaaacggtctgcccactgttccggcaaactggtcattacatcgggaaaaagtggcgggtcaggtggcttatcggctgtatcaacgcgaagcacaaggagaaagtgatgctgattaa

SEQ ID NO: 8082 - protein, 198 aa, Escherichia coli
MKKPNHSGSGQIRIIGGQWRGRKLPVPDSPGLRPTTDRVRETLFNWLAPVIVDAQCLDCFAGSGALGLEALSRYAAGATLIEMDRAVSQQLIKNLATLKAGNARVVNSNAMSFLAQKGTPHNIVFVDPPFRRGLLEETINLLEDNGWLADEALIYVESEVENGLPTVPANWSLHREKVAGQVAYRLYQREAQGESDAD

SEQ ID NO: 8083 - DNA, 270 bp, Escherichia coli
atgctgattaatattggtcgtttgttaatgctctgtgtttggggatttttaatcctcaacctggtgcatcccttcccacgcccgctgaatattttcgttaacgtggcgctgatttttaccgtgctgatgcatggtatgcagctggcgctattgaaatccactttaccgaaagatggcccgcagatgaccaccgccgaaaaggtgcggattttccttttcggcgtgtttgaactgctggtctggcagaagaaatttaaagttaaaaaataa

SEQ ID NO: 8084 - protein, 89 aa, Escherichia coli
MLINIGRLLMLCVWGFLILNLVHPFPRPLNIFVNVALIFTVLMHGMQLALLKSTLPKDGPQMTTAEKVRIFLFGVFELLVWQKKFKVKK

SEQ ID NO: 8085 - DNA, 360 bp, Escherichia coli
atgagtaaaccacctcttttctttattgttatcattggcttaatcatcgtcgccgcatcgtttcgttttatgcaacaacgacgggaaaaagctgataatgatatggcaccgctccagcaaaagctggtggtggtgagcaacaagcgggaaaaaccgattaacgatcgccgttcgcgccagcaggaagtgactccggcaggcaccagtatgcgctatgaggcaagcttcaaaccgcaaagcggaggaatggagcagacgtttcgcctcgacgcccagcagtaccacgccctgacagtgggtgataaaggtacgctgagctataaaggaacgcgctttgtcagctttgtaggcgaacaataa

SEQ ID NO: 8086 - protein, 119 aa, Escherichia coli
MSKPPLFFIVIIGLIIVAASFRFMQQRREKADNDMAPLQQKLVVVSNKREKPINDRRSRQQEVTPAGTSMRYEASFKPQSGGMEQTFRLDAQQYHALTVGDKGTLSYKGTRFVSFVGEQ

SEQ ID NO: 8087 - DNA, 627 bp, Escherichia coli
atgctttggtcgtttatcgctgtctgtctttccgcatggctatctgtggatgcatcgtatcgtgggccaacctggcaacgctgggtgtttaaaccgttaacccttcttctcctgctgttgctggcctggcaagcgccgatgttcgacgccattagctatctggtgctggcggggctgtgtgcctcactgctgggcgatacgctaaccctgttgccacgtcaacgtctgatgtacgccatcggcgcgtttttcctctcgcacctgctgtacaccatctatttcgccagtcagatgacgctctccttcttctggcctctgccgttggtgctgctggttctgggcgcgctgttactggcgattatctggacgcgtctggaagagtatcgttggcctatctgcacgtttatcggcatgacgctggtgatggtgtggctggcaggtgaactgtggttcttccgtccgaccgctccggcgctctctgcgtttgtcggcgcttcgttgctgtttatcagtaactttgtctggctgggtagtcactatcgccgacgcttccgtgcggataacgccattgccgcggcctgctactttgctggtcacttcctcatcgtccgctcgctgtatctctga

SEQ ID NO: 8088 - protein, 208 aa, Escherichia coli
MLWSFIAVCLSAWLSVDASYRGPTWQRWVFKPLTLLLLLLLAWQAPMFDAISYLVLAGLCASLLGDTLTLLPRQRLMYAIGAFFLSHLLYTIYFASQMTLSFFWPLPLVLLVLGALLLAIIWTRLEEYRWPICTFIGMTLVMVWLAGELWFFRPTAPALSAFVGASLLFISNFVWLGSHYRRRFRADNAIAAACYFAGHFLIVRSLYL

SEQ ID NO: 8089 - DNA, 2199 bp, Escherichia coli
atgtcgactcctgacaatcacggcaagaaagcccctcaatttgctgcgttcaaaccgctaactacggtacagaacaccaacgactgttgctgcgacggcgcatgttccagcacgccaactctctctgaaaacgtctccggcacccgctatagctggaaagtcagcggtatggactgcgccgcctgtgcgcgcaaagtggaaaatgccgtgcgccagcttgcaggcgtgaatcaggtacaggtgttgttcgccaccgaaaaactggtggtggatgccgacaatgacatccgggcacaagttgaatctgcggtgcaaaaagcgggctattccctgcgcgatgaacaggcctccgacgaaccacaagaatcacgcctgaaagagaatctgccgctgattacgcttatcgtgatgatggcaatcagttgggggctggagcagttcaatcatccgtttggtcaactggcgtttatcgcgaccacgctggttgggctgtacccaattgctcgtcaggcattacggctgatcaaatctggcagctacttcgccattgaaaccttaatgagcatagccgctattggtgcactgtttattggcgcaacggctgaagctgcgatggtgttgctgctgtttttgattggtgaacgactggaaggctgggccgccagccgcgcgcgtcagggcgttagcgcgttaatggcgctgaaaccagaaaccgccacgcgcctgcgtaacggtgagcgtgaagaggtggcgattaacagcctgcgccctggcgatgtgattgaagtcgccgcaggtggacgtttgcctgccgacggtaaactgctctcaccgtttgccagttttgatgaaagcgccctgaccggcgaatccattccggtggagcgcgcaacgggcgataaagtccctgctggtgccaccagcgtagaccgtctggtaacgctggaagtgctgtcagaaccgggtgccagcgccattgaccggattctgaaactgatcgaagaagccgaagagcgtcgcgcacccattgagcggtttatcgaccgtttcagccgtatctatacgcccgcgattatggccgtcgctctgctggtgacgctggtgccaccactgctgtttgccgccagctggcaggagtggatttataaagggctgacgctgctgctgattggctgcccgtgtgcgttagttatctccacgcccgcggcgattacctccgggctggcggcagcagcgcgtcgtggggcgttgattaaaggcggcgcggcgctggagcagctgggtcgtgttacccaggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcacaggccattgtgcgcgaagcacaggttgctgaactcgccattcccaccgcccaatcacagcgggcgctggtcgggtctggcattgaagcgcaggttaacggtgagcgcgtgttgatatgcgctgccggaaaacatcctgctgatgcatttgctggtttgattaatgaactggaaagcgccgggcaaacggtagtgctggtagtacgtaatgatgacgtgctgggtgtcattgcgttgcaggataccttgcgcgccgatgctgcaactgctatcagtgaactgaacgcgctgggtgtcaaaggggtgatcctcaccggcgataatccacgcgcagcagcggcaatcgccggggaactggggctggaatttaaagcgggcctcttgccggaagataaagttaaagcggtgaccgagctgaatcaacatgcgccgctggcgatggtcggcgacggtattaacgacgcgccagcgatgaaagctgccgccatcgggattgcaatgggcagtggcacggacgtggccctggaaaccgcagatgcagcattaacccataaccacctgcgcggcctggtgcaaatgattgaactggcacgcgccactcacgccaatatccgccagaacatcaccattgcgctggggctgaaaggcgttttcctcgtcaccacgctgttagggatgaccggactatggctggcagtgctggcagatacgggtgcgacggtgctggtgacggcgaatgcgttacggttattgcgcaggaaataa

SEQ ID NO: 8090 - protein, 732 aa, Escherichia coli
MSTPDNHGKKAPQFAAFKPLTTVQNTNDCCCDGACSSTPTLSENVSGTRYSWKVSGMDCAACARKVENAVRQLAGVNQVQVLFATEKLVVDADNDIRAQVESAVQKAGYSLRDEQASDEPQESRLKENLPLITLIVMMAISWGLEQFNHPFGQLAFIATTLVGLYPIARQALRLIKSGSYFAIETLMSIAAIGALFIGATAEAAMVLLLFLIGERLEGWAASRARQGVSALMALKPETATRLRNGEREEVAINSLRPGDVIEVAAGGRLPADGKLLSPFASFDESALTGESIPVERATGDKVPAGATSVDRLVTLEVLSEPGASAIDRILKLIEEAEERRAPIERFIDRFSRIYTPAIMAVALLVTLVPPLLFAASWQEWIYKGLTLLLIGCPCALVISTPAAITSGLAAAARRGALIKGGAALEQLGRVTQVAFDKTGTLTVGKPRVTAIHPATGISESELLTLAAAVEQGATHPLAQAIVREAQVAELAIPTAQSQRALVGSGIEAQVNGERVLICAAGKHPADAFAGLINELESAGQTVVLVVRNDDVLGVIALQDTLRADAATAISELNALGVKGVILTGDNPRAAAAIAGELGLEFKAGLLPEDKVKAVTELNQHAPLAMVGDGINDAPAMKAAAIGIAMGSGTDVALETADAALTHNHLRGLVQMIELARATHANIRQNITIALGLKGVFLVTTLLGMTGLWLAVLADTGATVLVTANALRLLRRK

SEQ ID NO: 8091 - DNA, 246 bp, Escherichia coli
atgaccgatctcttttccagccctgaccacacactcgacgcgcttggcctgcgctgcccggaaccagtaatgatggtgcgcaaaactgtgcgcaatatgcagccaggtgaaacgttgctgattattgctgacgatccggcgacgacacgcgatattcctgggttttgtacctttatggaacacgaactggttgcgaaagagaccgatggactgccttatcgttatttgattcgtaaaggcggttga

SEQ ID NO: 8092 - protein, 81 aa, Escherichia coli
MTDLFSSPDHTLDALGLRCPEPVMMVRKTVRNMQPGETLLIIADDPATTRDIPGFCTFMEHELVAKETDGLPYRYLIRKGG

SEQ ID NO: 8093 - DNA, 666 bp, Escherichia coli
atgaacgttttctcgcaaacgcaacgctataaggcgttgttctggttatcgttatttcatcttctggtgatcacctccagtaactatctggttcagcttccggtctccatttttggttttcataccacctggggcgcgtttagctttccgtttatctttctcgctactgacctgaccgtgcgtatttttggcgcgccgctggctcgtcgcatcatctttgcggtaatgatccccgcattgctgatctcctacgtcatctcatcgctgttttatatggggtcatggcaaggattcggcgcgctcgcccacttcaacctgtttgtcgcccgtatcgccaccgccagtttcatggcctacgcgctggggcagatcctcgacgtgcacgtttttaaccgcctgcgtcagagtcgtcactggtggctggcaccgacagcgtccacactgttcggtaacgtcagcgacacgctggccttcttcttcattgccttctggcgtagcccggatgcctttatggctgaacactggatggaaatcgcgctggtcgattactgtttcaaagtgttaatcagtatcgttttcttcctgccaatgtatggcgtactactcaatatgctgttgaaaagactggcagataaatccgaaatcaacgctttgcaggcgagttaa

SEQ ID NO: 8094 - protein, 221 aa, Escherichia coli
MNVFSQTQRYKALFWLSLFHLLVITSSNYLVQLPVSIFGFHTTWGAFSFPFIFLATDLTVRIFGAPLARRIIFAVMIPALLISYVISSLFYMGSWQGFGALAHFNLFVARIATASFMAYALGQILDVHVFNRLRQSRHWWLAPTASTLFGNVSDTLAFFFIAFWRSPDAFMAEHWMEIALVDYCFKVLISIVFFLPMYGVLLNMLLKRLADKSEINALQAS

SEQ ID NO: 8095 - DNA, 558 bp, Escherichia coli
atgcgcaatctggttaaatatgtcggaattggcctgctggttatggggcttgcggcctgtgatgataaagacactaacgctacggcgcagggttcggtcgcagaaagtaacgcgaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagcattatctccgcgaaaggccagacggcgtactcttccgttattctgggtaacgtgggtaatcaactgctaaccatgcaaattacgctgcccgctgacaatcagcaaaaagcacagaccaccgcagaaaacatcattaatacgctggttattcagtaa

SEQ ID NO: 8096 - protein, 185 aa, Escherichia coli
MRNLVKYVGIGLLVMGLAACDDKDTNATAQGSVAESNATGNPVNLLDGKLSFSLPADMTDQSGKLGTQANNMHVWSDATGQKAVIVIMGDDPKEDLAVLAKRLEDQQRSRDPQLQVVTNKAIELKGHKMQQLDSIISAKGQTAYSSVILGNVGNQLLTMQITLPADNQQKAQTTAENIINTLVIQ

SEQ ID NO: 8097 - DNA, 1260 bp, Escherichia coli
atggtaaaaatgaaacactgttgtaaaaatgtggtgatcctcatgcccgaacccgtagccgaacccgcgctaaacggattgcgcctgaatttgcgcattgtctccattgtcatgtttaacttcgccagctacctcaccatcgggttgccgctcgctgtattaccgggctatgtccatgatgtaatgggatttagtgctttctgggcaggattggttatcagcctgcaatatttcgccaccttgctgagccgtcctcatgccggacgttacgccgatttgctgggacccaaaaagattgtcgtcttcggtttatgcggctgctttttgagcggtctgggatatctgacggcaggattaaccgccagtctgcccgtcatcagcctgttattactgtgcctggggcgcgtaatccttgggattggacaaagttttgccggaacgggatcgaccctgtggggcgttggcgtggttggttcgctacatatcgggcgggtgatttcgtggaacggtattgtcacttacggggcgatggcgatgggtgcgccgttaggtgtcgtgttttatcactggggcggattgcaggcgttagcgttaatcattatgggcgtggcactggtagccattttgttggcgatcccgcgtccgacggtaaaagccagtaaaggcaaaccgctgccgtttcgtgcggtgcttgggcgcgtctggctgtacggtatggcgctggcactggcttccgccggatttggcgttatcgccacctttatcacgctgttttatgacgctaaaggttgggacggtgcggctttcgcgctgacgctgtttagctgtgcgtttgtcggtacgcgtttgttattccctaacggcattaaccgtatcggcggcttaaacgtggcgatgatttgctttagcgttgagataatcggcctgctactggttggcgtggcgactatgccgtggatggcgaaaatcggcgtcttactggcgggggcggggttttcgctggtgttccctgcattgggcgtagtggcggtaaaagcggttccgcagcaaaatcagggggcggcgctggcaacttacaccgtatttatggatttatcgcttggcgtgaccggaccactggctgggctggtgatgagttgggcgggcgttccggtgatttatctggcggcggcgggactggttgcaatcgcgttattactgacgtggcgattaaaaaaacggcccccggtggaaatacctgaggccgcctcatcatcttaa

SEQ ID NO: 8098 - protein, 419 aa, Escherichia coli
MVKMKHCCKNVVILMPEPVAEPALNGLRLNLRIVSIVMFNFASYLTIGLPLAVLPGYVHDVMGFSAFWAGLVISLQYFATLLSRPHAGRYADLLGPKKIVVFGLCGCFLSGLGYLTAGLTASLPVISLLLLCLGRVILGIGQSFAGTGSTLWGVGVVGSLHIGRVISWNGIVTYGAMAMGAPLGVVFYHWGGLQALALIIMGVALVAILLAIPRPTVKASKGKPLPFRAVLGRVWLYGMALALASAGFGVIATFITLFYDAKGWDGAAFALTLFSCAFVGTRLLFPNGINRIGGLNVAMICFSVEIIGLLLVGVATMPWMAKIGVLLAGAGFSLVFPALGVVAVKAVPQQNQGAALATYTVFMDLSLGVTGPLAGLVMSWAGVPVIYLAAAGLVAIALLLTWRLKKRPPVEIPEAASSS

SEQ ID NO: 8099 - DNA, 1050 bp, Escherichia coli
atggaaacccctcaacccgataaaacgggcatgcacattctgctcaagttggcctcgctggtagtgatcctcgcgggcattcacgcagcggcagatatcattgtgcagctattactggcgctgttttttgccatcgttctcaacccgctcgtcacctggtttattcgtcggggggtacaacgccccgttgccattacgattgtggttgtggtgatgctgatcgcactcaccgcgctggtcggcgtactggcggcatcgtttaacgaatttatctctatgctgccgaggtttaataaggagctgacgcgcaaactttttaaattgcaggagatgttgccttttcttaatttgcatatgtcgccggagcgaatactacagcggatggactcggaaaaagtggttaccttcaccacggcgctaatgaccgggctttccggggcaatggcgagcgtgcttttgctggtgatgaccgtagtttttatgctgtttgaagtgcgccacgtcccttacaaaatgcgtttcgcgttgaataatccacagattcacatcgccggactacaccgcgcacttaaaggcgtttcgcattatctggcgttaaagacgctactcagtttatggacaggcataatcgtctggctggggctggagctgatgggggtgcagtttgcgctgatgtgggcagtactggcgtttttgctcaactacgtgcccaatatcggtgcggtaatttccgccgtaccgccaatgattcaggtgctgctgtttaatggtatttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggcagcaaactggcgattctactggggccaggcagaccgaaaagtcggttaccgggatga

SEQ ID NO: 8100 - protein, 349 aa, Escherichia coli
METPQPDKTGMHILLKLASLVVILAGIHAAADIIVQLLLALFFAIVLNPLVTWFIRRGVQRPVAITIVVVVMLIALTALVGVLAASFNEFISMLPRFNKELTRKLFKLQEMLPFLNLHMSPERILQRMDSEKVVTFTTALMTGLSGAMASVLLLVMTVVFMLFEVRHVPYKMRFALNNPQIHIAGLHRALKGVSHYLALKTLLSLWTGIIVWLGLELMGVQFALMWAVLAFLLNYVPNIGAVISAVPPMIQVLLFNGIYECILVGALFLVVHMVIGNILEPRMMGHRLGMSTMVVFLSLLIWGWLLGPVGMLLSVPLTSVCKIWMETTKGGSKLAILLGPGRPKSRLPG

SEQ ID NO: 8101 - DNA, 588 bp, Escherichia coli
atgtatcggatagttctggggaaagtttcgaccttaagcgcagctcctctgccaccgggtttacgcgagcaagcaccgcaaggtccacgacgtgaacgctggctggcggggcgtgcattgctttcgcacacgctttccccgctaccggagatcatctatggcgaacaaggcaaacctgcattcgcgccggaaacgccgctatggttcaacttaagccatagcggtgacgatatcgccctgctgttgagcgatgaaggcgaagtcggctgcgatatcgaagtgattcgcccgcgcgccaactggcgctggctggcgaacgccgtattcagccttggggaacatgccgagatggacgccgtgcatcctgatcagcaactggaaatgttctggcgcatctggacgcgcaaagaagccatcgttaaacagcgtggcggcagcgcctggcaaatcgtcagcgtagacagcacctataactcctcgctgtcagtcagccattgtcagctagaaaatttaagcctggcgatctgcacccctaccccctttacgctcaccgccgacagtgtgcaatggatcgattcagttaactga

SEQ ID NO: 8102 - protein, 195 aa, Escherichia coli
MYRIVLGKVSTLSAAPLPPGLREQAPQGPRRERWLAGRALLSHTLSPLPEIIYGEQGKPAFAPETPLWFNLSHSGDDIALLLSDEGEVGCDIEVIRPRANWRWLANAVFSLGEHAEMDAVHPDQQLEMFWRIWTRKEAIVKQRGGSAWQIVSVDSTYNSSLSVSHCQLENLSLAICTPTPFTLTADSVQWIDSVN

SEQ ID NO: 8103 - DNA, 1575 bp, Escherichia coli
atgttctctacactccgccgcactctatttgcgctgctggcttgtgcgtcttttatcgtccatgccgctgcaccagatgaaatcaccaccgcctggccggtgaatgtcgggccactaaacccgcacctttacacgcctaaccaaatgttcgcccagagcatggtttatgaaccgctggtgaaatatcaggcagacggttcggtgatcccgtggctggcaaaaagctggactcattcagaagatggtaaaacctggaccttcaccctgcgtgatgacgtgaaattctccaacggcgaaccgtttgatgcagaggcggcggcagaaaacttccgtgcagtgctcgataaccgtcaacgtcacgcctggctggagctggcaaaccagattgttgatgtcaaagcactcagcaaaaacgagctgcaaatcaccctgaaaagcgcctactatcctttcctgcaagaactggccctgccccgtcctttccgttttatcgcaccctcgcagtttaaaaaccacgaaaccatgaacggaattaaagcgccgattggcaccgggccgtgggttttacaggaatcgaaactgaatcagtacgatgtcttcgtccgtaacgaaaactactggggcgaaaagccagcgattaaaaagatcacctttaacgtgatcccggacccgactacccgcgcggtggcgtttgaaactggcgatatcgacctgctgtacggaaacgaagggttattaccgctcgataccttcgcccgctttagccagaacccggcttaccacactcaactgtcacagccgatcgaaaccgtgatgctggcgctcaataccgccaaagcccccaccaacgagctggcagtacgtgaagctcttaattacgcggtgaacaaaaaatcgctgattgataacgcgttgtatggtacccagcaggtcgccgacaccctgtttgccccttctgtgccctacgccaacctcggcctgaaaccgcgccagtacgatccgcagaaagcgaaagcgttgctggaaaaagccggttggacgctgcctgcaggcaaagacatccgcgagaaaaatggtcagccgctgcgcattgaactgtcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatacgatccacacgccttcctgagttcaatgcgcgtaccgtcgcacgctgacttccaggcacagcaaggtttagccgacaagccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtttcaaaaccggaactgggtaacatcccctacgcgccgatcgccaccgaaatcccgttcgaacagattaaaccggtgaaaccttaa

SEQ ID NO: 8104 - protein, 524 aa, Escherichia coli
MFSTLRRTLFALLACASFIVHAAAPDEITTAWPVNVGPLNPHLYTPNQMFAQSMVYEPLVKYQADGSVIPWLAKSWTHSEDGKTWTFTLRDDVKFSNGEPFDAEAAAENFRAVLDNRQRHAWLELANQIVDVKALSKNELQITLKSAYYPFLQELALPRPFRFIAPSQFKNHETMNGIKAPIGTGPWVLQESKLNQYDVFVRNENYWGEKPAIKKITFNVIPDPTTRAVAFETGDIDLLYGNEGLLPLDTFARFSQNPAYHTQLSQPIETVMLALNTAKAPTNELAVREALNYAVNKKSLIDNALYGTQQVADTLFAPSVPYANLGLKPRQYDPQKAKALLEKAGWTLPAGKDIREKNGQPLRIELSFIGTDALSKSMAEIIQADMRQIGADVSLIGEEESSIYARQRDGRFGMIFHRTWGAPYDPHAFLSSMRVPSHADFQAQQGLADKPLIDKEIGEVLATHDETQRQALYRDILTRLHDEAVYLPISYISMMVVSKPELGNIPYAPIATEIPFEQIKPVKP

SEQ ID NO: 8105 - DNA, 945 bp, Escherichia coli
atgttgcgttatgtattacgccgctttctgctgctgatcccgatggtgctcgccgcctcggtgatcatttttttgatgctgcgcctcggcaccggcgacccggcgcttgattatttgcgtttatctaacctgccgccgacgccggagatgctggcctctacccgcaccatgctggggctggatcagccgctgtatgtccagtacggcacctggttgtggaaggcgctgcatcttgactttggtatctcattcgccagccaacgcccggtgctggacgatatgctgaatttcctgcccgccacgctggaacttgcaggtgcggcgctggtattaattctgctcacctccgtgccgctcggtatctgggcggcgcgccatcgcgatcgtctgccggatttcgccgtccgtttcatcgcgtttctcggcgtgtcgatgcctaacttctggctggcgtttttactggtgatggcgttttcggtgtatctgcaatggctacccgcgatgggttacggcggctggcagcacatcattttgcctgcggtatccatcgcctttatgtcgctggcgattaacgcgcgtttgctgcgcgccagtatgctgggcgtcgccggtcagcgtcacgtcacctgggcacgactgcgtggtctgagcgacaaacagaccgaacgccgccatattctgcgcaatgcctcgctgccgatgatcactgccgtggggatgcacattggcgaactgattggcgggacgatgattatcgaaaacatctttgcctggccgggcgtcgggcgctatgcggtgtcggcgatttttaaccgtgactatccggtgatccaatgctttacgctgatgatggtggtggtttttgtggtctgtaatttgattgtcgatttgctcaacgccgcgctggacccgcgtattcgtcgtcatgaaggagcgcacgcgtga

SEQ ID NO: 8106 - protein, 314 aa, Escherichia coli
MLRYVLRRFLLLIPMVLAASVIIFLMLRLGTGDPALDYLRLSNLPPTPEMLASTRTMLGLDQPLYVQYGTWLWKALHLDFGISFASQRPVLDDMLNFLPATLELAGAALVLILLTSVPLGIWAARHRDRLPDFAVRFIAFLGVSMPNFWLAFLLVMAFSVYLQWLPAMGYGGWQHIILPAVSIAFMSLAINARLLRASMLGVAGQRHVTWARLRGLSDKQTERRHILRNASLPMITAVGMHIGELIGGTMIIENIFAWPGVGRYAVSAIFNRDYPVIQCFTLMMVVVFVVCNLIVDLLNAALDPRIRRHEGAHA

SEQ ID NO: 8107 - DNA, 834 bp, Escherichia coli
gtgaactttttcctctcctcccgctggtcggttcgcctggcgctgatcattatcgccctgctggcgctgattgcgctcaccagccagtggtggctgccgtatgaccctcaggctattgatttgccgtcgcgcctgctctcgccggatgcgcagcactggctgggcaccgatcatttagggcgcgatattttctcgcggctgatggcagcgacccgcgtgtcgctcggctcggtaatggcctgcctgctgttggtgctgacattagggctgattattggcggcagcgccgggctgattggcgggcgcgttgatcaggccaccatgcgcgtcgcggatatgtttatgaccttcccaacctcgattctgtcgttctttatggtcggcgtgcttggcaccgggttgaccaacgtaattatcgctatcgccctttcgcactgggcatggtacgcgcgcatggtgcgcagtctggtgatttcactgcgccagcgcgagtttgtgctggcatcacggctttctggcgcgggccatgtgcgggtgtttattgatcatctggcaggtgcggtgatcccctcgctgctggtgctggcgacgctggatatcggtcatatgatgctacacgtcgcggggatgtccttcctcggcctcggcgtgaccgcgccgaccgccgaatggggcgtgatgattaacgatgcacgtcagtatatctggacccagccgctgcaaatgttctggccggggctggcgctgtttatcagcgtgatggcctttaacctggtgggtgacgcactgcgcgatcatctggaccctcatctggtgacggagcacgcacactaa

SEQ ID NO: 8108 - protein, 277 aa, Escherichia coli
MNFFLSSRWSVRLALIIIALLALIALTSQWWLPYDPQAIDLPSRLLSPDAQHWLGTDHLGRDIFSRLMAATRVSLGSVMACLLLVLTLGLIIGGSAGLIGGRVDQATMRVADMFMTFPTSILSFFMVGVLGTGLTNVIIAIALSHWAWYARMVRSLVISLRQREFVLASRLSGAGHVRVFIDHLAGAVIPSLLVLATLDIGHMMLHVAGMSFLGLGVTAPTAEWGVMINDARQYIWTQPLQMFWPGLALFISVMAFNLVGDALRDHLDPHLVTEHAH

SEQ ID NO: 8109 - DNA, 765 bp, Escherichia coli
atgccacaacagattgagctccgtaatatcgcgctacaggccgcgcagccgctggtgcacggcgtatcgttaaccctgcaacgtgggcgtgtgctggcgttagtcggcggtagtggcagcgggaagtcgctgacctgcgccgcgacgctgggcattctgcctgctggcgttcgccagacggcgggggaaattttggccgatggaaaaccggtttctccctgcgccctgcgcggaatcaaaattgccaccatcatgcagaacccgcgcagtgcctttaatccgctgcacaccatgcacacccacgcgcgtgaaacctgcctggcgctggggaaacccgccgatgacgctacgcttaccgctgccatagaagcggtggggctggaaaacgccgcgcgcgtgctgaagctctacccgttcgagatgagcggcggcatgttgcagcgcatgatgattgcgatggcggtgctgtgcgaatcaccatttatcatcgccgatgaaccgaccaccgatctcgacgtggtagcacaggcgcgcatcctcgatctgctggaaagcattatgcaaaaacaagcaccgggaatgctgctggttacccatgatatgggcgtggtagcgcgtctggcagacgatgtggcggtaatgtctcacggtaagattgttgaacagggcgatgtagaaacgctgtttaacgcccccaaacatgcggtaacgcgcagcctggtttccgctcatctcgccctctacggtatggagctggcatcatga

SEQ ID NO: 8110 - protein, 254 aa, Escherichia coli
MPQQIELRNIALQAAQPLVHGVSLTLQRGRVLALVGGSGSGKSLTCAATLGILPAGVRQTAGEILADGKPVSPCALRGIKIATIMQNPRSAFNPLHTMHTHARETCLALGKPADDATLTAAIEAVGLENAARVLKLYPFEMSGGMLQRMMIAMAVLCESPFIIADEPTTDLDVVAQARILDLLESIMQKQAPGMLLVTHDMGVVARLADDVAVMSHGKIVEQGDVETLFNAPKHAVTRSLVSAHLALYGMELAS

SEQ ID NO: 8111 - DNA, 807 bp, Escherichia coli
atgactttacttaacgtctccgacctttcccatcactacgcgcacggtggatttagcggcaaacatcaacaccaggcggtgctgaataacgtttccctggccctgaaaagcggtgaaaccgtcgccctgctggggcgcagcggctgcggaaaaagtaccctcgcgcggctgctggtagggttagagtcgccctcacagggaaatattagctggcgcggcgaaccgttggcgaagctcaatcgcgcgcaacgtaaagcgttccgccgtgatattcaaatggtgtttcaggactccatcagcgccgtgaatccgcgcaaaaccgtgcgcgagatcctgcgtgaaccgatgcgccacctgctatcgctgaaaaaagccgaacaactggcgcgcgccagtgaaatgctgaaggcggtcgatctcgacgacagcgtgctcgacaaacgcccaccgcagttaagcggcggccagctccagcgtgtctgcctggcacgcgcgctggcggtcgaaccgaaactgctgattctggatgaagcggtttcgaaccttgatctcgtgttacaagcgggcgtcattcgcctgctgaaaaagctgcaacaacagtttggcaccgcctgcctgttcatcacccacgacttacgcctggtggaacgcttctgtcagcgggtgatggtgatggacaacggacaaatcgtcgaaacccaggtggtgggagataaattaaccttttcctctgacgccggacgtgtgctacaaaacgcggtattacccgcattccccgtgcgccgtcgcaccacagaaaaggtttaa

SEQ ID NO: 8112 - protein, 268 aa, Escherichia coli
MTLLNVSDLSHHYAHGGFSGKHQHQAVLNNVSLALKSGETVALLGRSGCGKSTLARLLVGLESPSQGNISWRGEPLAKLNRAQRKAFRRDIQMVFQDSISAVNPRKTVREILREPMRHLLSLKKAEQLARASEMLKAVDLDDSVLDKRPPQLSGGQLQRVCLARALAVEPKLLILDEAVSNLDLVLQAGVIRLLKKLQQQFGTACLFITHDLRLVERFCQRVMVMDNGQIVETQVVGDKLTFSSDAGRVLQNAVLPAFPVRRRTTEKV

SEQ ID NO: 8113 - DNA, 402 bp, Escherichia coli
atgcaacgagtcaccatcacgcttgatgacgatttactggagacgctggacagcctgagccagcgtcgtggttataacaaccgttccgaggcgatccgcgatattctgcgtagcgccctggcgcaggaagccactcaacaacacggcacacaaggtttcgcggtgctgtcgtatgtgtatgaacacgaaaaacgtgacttagccagccgtattgtctccacccagcatcatcaccacgatctctcggttgctactctgcatgtgcacattaatcacgacgactgtctggaaatcgccgtgttgaaaggtgacatgggcgacgtgcagcattttgccgatgacgtcatcgcccagcgcggcgtgcggcacgggcatttgcagtgcctgccgaaggaagattaa

SEQ ID NO: 8114 - protein, 133 aa, Escherichia coli
MQRVTITLDDDLLETLDSLSQRRGYNNRSEAIRDILRSALAQEATQQHGTQGFAVLSYVYEHEKRDLASRIVSTQHHHHDLSVATLHVHINHDDCLEIAVLKGDMGDVQHFADDVIAQRGVRHGHLQCLPKED

SEQ ID NO: 8115 - DNA, 747 bp, Escherichia coli
atgaaatcattgagtaagtcgtcacaaataccgctctatcaacaagcggtggagtggataagagaaagtatttataccggggatctggtggaagacgatcgcattccttcggaataccagattatggatatgctggaagtgagccggggaaccgttaaaaaagcggtcgcccaactggtaaaagaaggcgtgttgatacaggtccaggggaagggaacatttgtcaaaaaagagaacgtggcatatccgttaggtgaaggattattgtcattcgcggaatcgctggaaagccagaaaatacattttaccactgaagttattacgtcacggattgaaccggctaatcgttatgtggcagagaaattaagaataacgcccggtcaggatattctttaccttgagcgtttacgttcaattggtgatgaaaaagcgatgctgatagagaaccgtatcaatattgagctatgccccggcatcgtggaaatcgattttaatcaacacaatttatttccaacaatagaaagtttgtcgcaaagaaaaattcgttactcggaaagtcgctatgccgcgcgattaattggtaatgaacgcggtcattttttagatatcagtgaagatgcacccgttttgcatctggagcagttagtctttttctcccgaggattacccgttgagtttggcaacgtctggttaaaaggaaataaatactatcttggcaccgtgctgcaacggcgggaagtgagttaa

SEQ ID NO: 8116 - protein, 248 aa, Escherichia coli
MKSLSKSSQIPLYQQAVEWIRESIYTGDLVEDDRIPSEYQIMDMLEVSRGTVKKAVAQLVKEGVLIQVQGKGTFVKKENVAYPLGEGLLSFAESLESQKIHFTTEVITSRIEPANRYVAEKLRITPGQDILYLERLRSIGDEKAMLIENRINIELCPGIVEIDFNQHNLFPTIESLSQRKIRYSESRYAARLIGNERGHFLDISEDAPVLHLEQLVFFSRGLPVEFGNVWLKGNKYYLGTVLQRREVS

SEQ ID NO: 8117 - DNA, 474 bp, Escherichia coli
atgcaaggcatacagtttcaggaaaattttattcaacgacttccggcagggttaagcgttgaacagatcatccatcagttagcgcaaccgttggttaccgccgaactggtggtccctgattttgccgatcatgtactggaacgtgaggcgacgtacccaacgggactgcctaccgaaccaccgtgtgtcgccattccgcacacggaccataaacatgtcaggcacaatgcaattgccgtcggtatcctgccggaaccggtagtgtttgccgatatgggcggcgactctgatcccgtacctgtcagggtgatttttttgctcgccttaggcgaaagtaataaacaattaaatgccctgggctggattatggagatgattcaggatacgccctttatgcgcgccctgcttacgatggaaacaacagaaatacacacagcaatcttaaacaaaatgaaagaacgaggtgaaatatga

SEQ ID NO: 8118 - protein, 157 aa, Escherichia coli
MQGIQFQENFIQRLPAGLSVEQIIHQLAQPLVTAELVVPDFADHVLEREATYPTGLPTEPPCVAIPHTDHKHVRHNAIAVGILPEPVVFADMGGDSDPVPVRVIFLLALGESNKQLNALGWIMEMIQDTPFMRALLTMETTEIHTAILNKMKERGEI

SEQ ID NO: 8119 - DNA, 282 bp, Escherichia coli
atgagtcaaaccattttatttgtctgcgccacgggtattgccacatccacggcagtaacagaaaaagtcatggaatattgtaaagagcacggtcttaacgtcaattattcccaaaccaacgttgcctctttacctggaaatactgacggcgtagcactggtagtctcaacgactaaagtgccttatgaactcgacgtcccggtggttaacggcttgccgattattaccggtattggcgaagagaaagtactggcgcaaattgtttcgatccttaaaaagtaa

SEQ ID NO: 8120 - protein, 93 aa, Escherichia coli
MSQTILFVCATGIATSTAVTEKVMEYCKEHGLNVNYSQTNVASLPGNTDGVALVVSTTKVPYELDVPVVNGLPIITGIGEEKVLAQIVSILKK

SEQ ID NO: 8121 - DNA, 1359 bp, Escherichia coli
atgaacgatatcgcgcataccctctataatattgtgcaatatatattgggatttggtcccacggtaatgttgccgttggtgttatttattcttgctctcttttttaaagtaaaacccgctaaagccttacgttcgtcattaacggtcggcattggttttgtcggtatttatgccattttcgatattcttaccagcaatgtcgggccagcggcccaggcgatggttgaacgcaccggaattaatttaccggtggtggatttaggctggccgccgctttccgctattacatggggttcgccaattgccccgtttgttattcccctgactattctgattaacgtggcgatgctggcgttaaataaaacccgcaccgttgacgtagatatgtggaactactggcattttgcccttgccggtacgctggtttattacagcaccggcagcctgttctttggtttgctggcagcggcgattgctgcggtggtagtacttaaactcgccgactggtctgcgccactggtacaaaaatactttggcctggaagggatctctttgccgacgctctcttcggtggtgttctttccggtcggtctgttggtcgacaaaatcatcgaccatatccccggcctcaatcgtattcatatcgatccggaaaccgtacagaaaaagtttggcatattcggcgaaccgatgatggttggtactattctgggcattctgctcggcgtaattgccggatacgatttcaaaaaagtcttgctgcttggcatcagcattggcggtgtgatgttcatcctgccacgcatggttcgcattctgatggaaggtttattaccgctgtctgaagccattaaaaagtatctcaatgccaaataccctgaccgtgacgatctctatatcggcctggatatcgccgttgccgtaggtaacccggcgattatctccaccgccctgctgctgacgccaatctcggtctttatcgcgtttgtccttccgggtaatgaagtcctgccgcttggggaccttgccaacctggcggtaatggcgtcgatgattgctttagccagccgtggcaacattttccgcaccgttctggcggcgattccggtgattattgccgatctgtggattgcgactaaaatcgcgccgtttattaccggaatggcgaaagacgttaatttcaaatttgccgaaggctccagcggccaggtctccagtttccttgatggcggtaacccgttccgcttctggctgctggaaatcttcaacggcaatctcatcgccattggtctggtgccggttatcgccctggtactgtatggtattttccgaatgacgcggagcacggtttatgcctga

SEQ ID NO: 8122 - protein, 452 aa, Escherichia coli
MNDIAHTLYNIVQYILGFGPTVMLPLVLFILALFFKVKPAKALRSSLTVGIGFVGIYAIFDILTSNVGPAAQAMVERTGINLPVVDLGWPPLSAITWGSPIAPFVIPLTILINVAMLALNKTRTVDVDMWNYWHFALAGTLVYYSTGSLFFGLLAAAIAAVVVLKLADWSAPLVQKYFGLEGISLPTLSSVVFFPVGLLVDKIIDHIPGLNRIHIDPETVQKKFGIFGEPMMVGTILGILLGVIAGYDFKKVLLLGISIGGVMFILPRMVRILMEGLLPLSEAIKKYLNAKYPDRDDLYIGLDIAVAVGNPAIISTALLLTPISVFIAFVLPGNEVLPLGDLANLAVMASMIALASRGNIFRTVLAAIPVIIADLWIATKIAPFITGMAKDVNFKFAEGSSGQVSSFLDGGNPFRFWLLEIFNGNLIAIGLVPVIALVLYGIFRMTRSTVYA

SEQ ID NO: 8123 - DNA, 1509 bp, Escherichia coli
atgcctgataacagcgcagctatcgttatcgatattggcaccaccaattgcaaagtcacctgcttttcctgcctggacgcaacgacgttgggcgcgcataaattcgtgacggcaaaacagatctccccacagggcaatgtcgatttcgatatcgacgccctctggcaggaggtccgccaggcgatagcgcaactgaacgccgcttcgccgctgccagtcaggcggatcagcattgccagttttggcgagtcaggggtgtttcttgacaaacatggcgagattctgacgccaatgctggcatggtatgaccgtcgcggtgaagagtatctggcaacgcttagcgaggcagacagtgcggcactttatgacatttgcgggttaccactgcacagcaattactctgccttcaaaatgcgttggttgctggagcattatccgctgcgcaatcgtcgcggcctgcgctggctacatgcaccggaagtgctgctctggcggctgactggcgaacagcgaacggatatcaccttagccagccgtacactgtgtctggacgtgcgcaaaggcgaatggtcagcgaaagcggcggcgttgttacacgttccctgttcagcatttgcgccattgttgcagccaggtgagcacgccggatgggtcagtgagtcgctctgcaaaacgcttgggttctcgcaatcggtcagcgtgacgctggccggacatgaccatatggtgggtgcgcgggcgttgcagatgatgccgggcgatatccttaactcgacgggcaccacggaaggcattctgcaactggatacacaaccgacgctggatgaacaggccaaacgtgacaagctggcaaacggctgttactcgcttgccaaccagttcaccctgtttgcttctctgcccgtgggcggtttcgcgctggagtggctgcgtaacacgttccggctaaccgatgaggagatcgccgtgtcgctcaatcgtgggtatgcggattacctggcggggaactggtcgctcgatgacattcccgtttttattccgcatcttcgcggttcgggttcgccctataaaaatcgccatacccgaggattattttatgggcttggcgatacgttaaatatcgatatgttaattgccagcgtctcactgggattaaccatggaatttgccaactgcttcgcctgttttaatgtgcccggcaccagcgcgttaaaagtgataggtccggcaacccataatcccctttggctgcaattaaaggcggatattttacagcgtccggttgaagcaattgcatttaacgaggcggtttctgtcggagcattattaaccgccgcaccggatattccaccgccgcaagtcaccatagcccaacgtttgttaccgaatcgggcgagataccatcaattacagcgttatcagcacaaatggaaaagctggtatcagttgaaattacagcaagaaggcgtgatgccattacatcatcgggaggagcactatgttgagtaa

SEQ ID NO: 8124 - protein, 502 aa, Escherichia coli
MPDNSAAIVIDIGTTNCKVTCFSCLDATTLGAHKFVTAKQISPQGNVDFDIDALWQEVRQAIAQLNAASPLPVRRISIASFGESGVFLDKHGEILTPMLAWYDRRGEEYLATLSEADSAALYDICGLPLHSNYSAFKMRWLLEHYPLRNRRGLRWLHAPEVLLWRLTGEQRTDITLASRTLCLDVRKGEWSAKAAALLHVPCSAFAPLLQPGEHAGWVSESLCKTLGFSQSVSVTLAGHDHMVGARALQMMPGDILNSTGTTEGILQLDTQPTLDEQAKRDKLANGCYSLANQFTLFASLPVGGFALEWLRNTFRLTDEEIAVSLNRGYADYLAGNWSLDDIPVFIPHLRGSGSPYKNRHTRGLFYGLGDTLNIDMLIASVSLGLTMEFANCFACFNVPGTSALKVIGPATHNPLWLQLKADILQRPVEAIAFNEAVSVGALLTAAPDIPPPQVTIAQRLLPNRARYHQLQRYQHKWKSWYQLKLQQEGVMPLHHREEHYVE

SEQ ID NO: 8125 - DNA, 270 bp, Escherichia coli
atgttgagtaaaaccgtggaagtcagaaacagtactggcctgcatgcacgtccggcggcctgtctggcgaaagccgccaaaaaatatagctgtaaagtgacgctgcactatgaaggtaatgatattaatgccaccagcatgatgaatattatgcgcgccggaataaaaggcggaaaaacggtggaaatacgctgcgaaggtgatgatgaaaacgaggcaatacaaactctcactaccttatttcgcgaccgcttcggtgaagctgaataa

SEQ ID NO: 8126 - protein, 89 aa, Escherichia coli
MLSKTVEVRNSTGLHARPAACLAKAAKKYSCKVTLHYEGNDINATSMMNIMRAGIKGGKTVEIRCEGDDENEAIQTLTTLFRDRFGEAE

SEQ ID NO: 8127 - DNA, 852 bp, Escherichia coli
atgccattagttaatggacggatactgctcgaccgcattcaggaaaaacgggtattagcgggcgcatttaataccaccaatctggagacaacgatttcaattttaaacgccattgagcgttcaggattacccaacttcattcagattgcgcccaccaatgcacaactgtcgggatacgattacatttatgaaatcgtgaaacgtcacgctgataaaatggatgttccggtcagtcttcatcttgatcacgggaaaactcaggaggatgttaaacaggcggtgcgcgcgggctttacctcggtcatgattgacggtgccgcattctcttttgaagagaatatcgctttcacccaggaagctgtcgatttctgtaaatcctatggcgtaccggttgaagcggagctgggggcgattctcggcaaagaagacgatcacgtcagcgaagccgattgcaaaacggaaccggaaaaggtgaagacctttgtcgaacgcaccggttgcgacatgctggcagtttctattggtaacgttcatggcctggacgatataccgcggatcgatatccccctgctgaagcgcattgccgaagtcagcccggtgccgctggttattcacggcggctccggtatcgccccggagatattacgcagtttcgttaattatcgcgtcgctaaagtgaatatcgccagcgatctgcgcaaagcgtttatcaccgcagtcggcaaagcgtatgtgaataatcacaacgaggcgaatctggcacgggtgatggcatcagcaaaaaacgccgtcgaggaagatgtgtatagcaaaatcctgatgatgaatgaggggcatcggttgggtaagtaa

SEQ ID NO: 8128 - protein, 283 aa, Escherichia coli
MPLVNGRILLDRIQEKRVLAGAFNTTNLETTISILNAIERSGLPNFIQIAPTNAQLSGYDYIYEIVKRHADKMDVPVSLHLDHGKTQEDVKQAVRAGFTSVMIDGAAFSFEENIAFTQEAVDFCKSYGVPVEAELGAILGKEDDHVSEADCKTEPEKVKTFVERTGCDMLAVSIGNVHGLDDIPRIDIPLLKRIAEVSPVPLVIHGGSGIAPEILRSFVNYRVAKVNIASDLRKAFITAVGKAYVNNHNEANLARVMASAKNAVEEDVYSKILMMNEGHRLGK

SEQ ID NO: 8129 - DNA, 1125 bp, Escherichia coli
atgcgccatttacgcaatatttttaatctgggtatcaaagagttgcgcagtctgctcggtgataaagcgatgctgacgctgattgtcttctcgtttacggtgtcggtgtattcgtcagcgaccgttacgccaggatcgttgaacctcgcgccgatcgccatagccgatatggatcaatcgcagttgtcgaaccggatcgttaacagcttctatcgcccgtggtttttgccaccggagatgatcaccgccgatgagatggatgccggactggacgccggacgttataccttcgcgataaatattccgcctaattttcagcgtgatgtcctcgccggacgccagccggatattcaggtgaacgtcgatgccacgcgcatgagccaggcattcactggcaacggttatatccagaatattatcaacggtgaagtgaacagctttgtcgcgcgctaccgtgataacagcgaaccgttggtatcgctggaaacccggatgcgctttaacccgaacctcgatcccgcgtggtttggcggggtgatggcgatcatcaacaacattaccatgctggcgattgtgttgaccggatcggcactgatccgcgagcgtgaacacggcacggtggaacacttactggtgatgccgataacgccgtttgagatcatgatggcaaaggtctggtcgatggggctggtggtgctggtggtgtcgggattatcgctggtgctgatggtgaaaggcgtgctgggcgtaccgattgaaggctcgatcccgctgtttatgctgggcgtggcgctcagtttgtttgccaccacgtcaatcggcatttttatggggacgatagcgcgttcaatgccgcaactggggctgctggtgattctggtgctgctgccgctgcaaatgctttccggtggttccacgccgcgcgaaagtatgccgcagatggtgcaggacattatgctgaccatgccgacgacacactttgttagcctcgcgcaggccatcctctaccgtggtgccggattcgaaatcgtctggccgcagttcctgacactgatggcaattggcggcgcgtttttcaccatcgcactgctgagattcaggaagacaattgggacaatggcgtaa

SEQ ID NO: 8130 - protein, 374 aa, Escherichia coli
MRHLRNIFNLGIKELRSLLGDKAMLTLIVFSFTVSVYSSATVTPGSLNLAPIAIADMDQSQLSNRIVNSFYRPWFLPPEMITADEMDAGLDAGRYTFAINIPPNFQRDVLAGRQPDIQVNVDATRMSQAFTGNGYIQNIINGEVNSFVARYRDNSEPLVSLETRMRFNPNLDPAWFGGVMAIINNITMLAIVLTGSALIREREHGTVEHLLVMPITPFEIMMAKVWSMGLVVLVVSGLSLVLMVKGVLGVPIEGSIPLFMLGVALSLFATTSIGIFMGTIARSMPQLGLLVILVLLPLQMLSGGSTPRESMPQMVQDIMLTMPTTHFVSLAQAILYRGAGFEIVWPQFLTLMAIGGAFFTIALLRFRKTIGTMA

SEQ ID NO: 8131 - DNA, 2736 bp, Escherichia coli
atgacgcatctggaactggttcccgtcccgcctgtcgcgcaactggcgggcgtgagccagcattatggaaaaaccgttgcgctgaacaatatcacactcgatattccggcccgttgcatggtcgggctgattggaccggatggtgtcggtaaatcgagcttgttgtcgttgatttccggtgcccgcgtcattgagcagggcagcgtgatggtgctgggcggcgatatgcgcgacccgaagcatcgccgcgacgtctgcccgcgcatcgcctggatgccgcaggggctgggcaaaaatctctaccacaccttgtcggtgtatgaaaacgtcgattttttcgcccgcctgttcggtcacgacaaagcggagcgggaagtgcgaattaatgagctgctgaccagcaccggattagcaccgtttcgcgatcgtccggcagggaaactctccggtgggatgaagcaaaaacttgggctgtgctgtgcgttaatccacgacccggaattgttgattcttgatgagccaacaacgggggttgacccgctctcccgcgcccagttctgggatctgatcgacagtattcgccagcggcagagcaatatgagcgtgctggtcgccaccgcctacatggaagaggccgaacgcttcgactggctggtagcgatgaatgccggaaaagtgctggcaactggcagcgccgaagagctgcgacagcaaacgcaaagcgccacgctggaagaagcatttattaatctgttaccgcaagcgcaacgccaggcgcatcaggcggtagtgatcccaccgtatcaacctgaaaacgcagagattgccatcgaagcgcgcgatctgaccatgcgttttggttccttcgttgccgttgatcacgtcaatttccgcattccacgcggggagatttttggttttcttggttcgaatggctgcggtaaatccaccaccatgaaaatgcttaccggattgctgcccgccagcgaaggtgaggcgtggctgttcgggcagccggttgatccaaaagatatcgatactcgtcgccgggtgggctatatgtcgcaggcgttttcgctctataacgaactcaccgtgcggcaaaacctggagttacatgctcgtctgtttcatatcccggaagcggaaattcccgcgcgagtggctgaaatgagcgagcgttttaagctcaacgacgtcgaagatgtattgccggagtcattgccgctcggcattcgccagcggctatcgctggcggtggcggtgattcatcgcccggagatgctaatcctcgatgagccgacttctggcgtcgatccggtggcgagggatatgttctggcagttgatggtggatctctcgcgtcaggacaaagtgactatcttcatctccacccactttatgaacgaagcggaacgttgtgaccgtatctcactgatgcacgctggaaaagtgctcgccagcggtacaccgccggaactggttgagaaacgcggagccgccagtctggaagaggcatttatcgcttatttgcaggaagcggcagggcagagcaacgaagccgaagcgccgcctgtggtacatgacactacccacgcgccacgtcagggattcagcctgcgccgtctgtttagctacagccgccgcgaagcgctggaactgcgacgcgatccggtacgttcgacgctggcgctgatgggaacggtgatcctgatgctgataatgggttatggcatcagtatggatgtggaaaacctgcgctttgcggtgcttgaccgcgatcaaaccgtcagtagccaggcgtggacgctcaatctctccggttcccgttactttatcgaacagccgccgctcaccagttatgacgagcttgatcgtcggatgcgtgcgggcgatatcacggtggcaattgagatccctcctaatttcgggcgcgatatcgcgcgtggtacgcccgtggaactcggtgtctggatcgacggtgcgatgccgagccgcgccgaaacggtaaaaggttacgtgcaggccatgcaccagagctggctacaggatgtggcgagccgacagtccacacccgccagccaaagcgggctgatgaatattgagacgcgctatcgctataacccggacgtaaaaagcctgccggcgattgttccggcggtgatcccgcttctgctgatgatgatcccgtcaatgctaagcgcccttagcgtggtgcgggaaaaagagctagggtcgattatcaacctttacgtgacccccaccacccgtagcgaatttttacttggcaaacagctgccatacatcgcgctggggatgctgaactttttcctgctctgcgccctgtcggtgtttgtgtttggcgtaccgcataaaggcagtttcctgactctcaccctggcggcgctgctgtatatcatcatcgccaccggaatggggctgctgatctccacctttatgaaaagccagattgccgccattttcggtacggcaattatcacgttgatcccggcgacacagttttccgggatgatcgatccggtagcttcgctggaaggtccaggacgttggatcggcgaggtttatcccaccagtcattttctgactatcgcccgcggaacgttctcgaaagcgctggatctgactgatttgtggcaactttttatcccgttgctgatagccataccgctggtgatgggcttaagcatcctgctgctgaaaaaacaggagggatga

SEQ ID NO: 8132 - protein, 911 aa, Escherichia coli
MTHLELVPVPPVAQLAGVSQHYGKTVALNNITLDIPARCMVGLIGPDGVGKSSLLSLISGARVIEQGSVMVLGGDMRDPKHRRDVCPRIAWMPQGLGKNLYHTLSVYENVDFFARLFGHDKAEREVRINELLTSTGLAPFRDRPAGKLSGGMKQKLGLCCALIHDPELLILDEPTTGVDPLSRAQFWDLIDSIRQRQSNMSVLVATAYMEEAERFDWLVAMNAGKVLATGSAEELRQQTQSATLEEAFINLLPQAQRQAHQAVVIPPYQPENAEIAIEARDLTMRFGSFVAVDHVNFRIPRGEIFGFLGSNGCGKSTTMKMLTGLLPASEGEAWLFGQPVDPKDIDTRRRVGYMSQAFSLYNELTVRQNLELHARLFHIPEAEIPARVAEMSERFKLNDVEDVLPESLPLGIRQRLSLAVAVIHRPEMLILDEPTSGVDPVARDMFWQLMVDLSRQDKVTIFISTHFMNEAERCDRISLMHAGKVLASGTPPELVEKRGAASLEEAFIAYLQEAAGQSNEAEAPPVVHDTTHAPRQGFSLRRLFSYSRREALELRRDPVRSTLALMGTVILMLIMGYGISMDVENLRFAVLDRDQTVSSQAWTLNLSGSRYFIEQPPLTSYDELDRRMRAGDITVAIEIPPNFGRDIARGTPVELGVWIDGAMPSRAETVKGYVQAMHQSWLQDVASRQSTPASQSGLMNIETRYRYNPDVKSLPAIVPAVIPLLLMMIPSMLSALSVVREKELGSIINLYVTPTTRSEFLLGKQLPYIALGMLNFFLLCALSVFVFGVPHKGSFLTLTLAALLYIIIATGMGLLISTFMKSQIAAIFGTAIITLIPATQFSGMIDPVASLEGPGRWIGEVYPTSHFLTIARGTFSKALDLTDLWQLFIPLLIAIPLVMGLSILLLKKQEG

SEQ ID NO: 8133 - DNA, 1068 bp, Escherichia coli
atggataagagtaagcgccatctggcgtggtggggtgtcggggcactggcggtggctgccgtcgtggcgtggtggctgttgcgcccggcgggtgtgccggaaggctttgctgtcagcaatgggcgcattgaagcgacggaagtggatatcgccagcaaaattgccgggcgtatcgacaccattctggtgaaagaaggccagtttgttcgagaaggtgaagtgctggcgaagatggatactcgcgtgttgcaggaacagcgactggaagccatcgcgcaaatcaaagaagcacaaagtgccgttgccgccgcgcaggctttgctggagcaacgccaaagcgaaactcgtgccgcacagtcgctggttaatcaacgccaggcagaactggactccgtagcaaaacgtcatacgcgttcccgctcactggcacaacggggggcaatttctgcgcaacagttggatgacgaccgcgccgccgctgagagcgcccgagctgcgctggaatcggcaaaagctcaggtttctgcttctaaagccgctatagaggcggcacgcaccaatatcattcaggcgcaaactcgcgtcgaagcggcacaagccactgaacggcgcattgccgcagatatcgatgacagcgaactgaaagccccgcgtgacggacgcgtgcagtatcgggttgccgagccaggcgaagtgctggcagcaggcggtcgggtgctgaatatggtcgatctcagcgacgtctatatgaccttctttctgccaaccgaacaggcgggcacgctgaaactgggcggtgaagcacgtttgattcttgatgctgcaccagatctgcgtattcctgcaaccatcagttttgtcgccagcgtcgcccagttcacgccaaaaaccgtcgaaaccagcgatgagcggctgaaactgatgttccgcgtcaaagcgcgtatcccaccggaattactccagcagcatctggaatatgtcaaaaccggattgccgggcgtagcgtgggtgcgggtgaatgaagaacttccgtggcctgacgacctggtggtgaggttgccgcaatga

SEQ ID NO: 8134 - protein, 355 aa, Escherichia coli
MDKSKRHLAWWGVGALAVAAVVAWWLLRPAGVPEGFAVSNGRIEATEVDIASKIAGRIDTILVKEGQFVREGEVLAKMDTRVLQEQRLEAIAQIKEAQSAVAAAQALLEQRQSETRAAQSLVNQRQAELDSVAKRHTRSRSLAQRGAISAQQLDDDRAAAESARAALESAKAQVSASKAAIEAARTNIIQAQTRVEAAQATERRIAADIDDSELKAPRDGRVQYRVAEPGEVLAAGGRVLNMVDLSDVYMTFFLPTEQAGTLKLGGEARLILDAAPDLRIPATISFVASVAQFTPKTVETSDERLKLMFRVKARIPPELLQQHLEYVKTGLPGVAWVRVNEELPWPDDLVVRLPQ

SEQ ID NO: 8135 - DNA, 1065 bp, Escherichia coli
atggggtttaaaatgaatatatatatcggatggttgtttaaattaattcctttactgatgggtataatatgcatcgcattaggtgagtttgtattaaccggttctgggcaaagtgaatatttcgttgcagggcatgttctgatttctctttctgcgatatgtctagcattgttcactaccgcatttattattatatctcagttaactcacggcatgaataaattctacaacaggttatttcctgttattggttatgccggttctgctacaactatgatttggggatggtcactgttggcaagcaataatgtgatggcagatgaatttgtcgccggtcatgttattttcggcgttggcatgattgccgcttgtgtatcaaccgtagcggcatcttccggacattttctgttgatccccaaaaacgcctcgggcagtaagagtgacggtacgccattgcaggcctattcttcaacaatcggtaattgcttaattgccgttcccgttctgcttactctctttggtttcatttggtcagtcgtactgttacgtagtgcagatatcacaccacattatgttgcaggtcacgtactaatggggttaacggcaatttgcgcttgtcttattggccttgtcgccactattgtccatcaaacgcggaatacgttctcagtgaaagaacattggctgtggtgctattgggttattttgcttggctcacttaccattatttttggtatctacgtattaatcagttcagatgcaagcgcccgcctggcccccggcattattctcatttgcctggggatgatctgctacagtattttctccaaagtgtggttgttagcgctggtatggcgacgcacatgttcgttagccaacagaatacccatgattccggtatttacctgtctgttttgtctgttccttgctgcgttcctggctgaaattgcgcaaaccgatatggcttactttattccttcgcgagttctggttggcttaggtgcagtttgttttacactgttttccatcgtttctatattagaagcgggttcagcgaaaaaataa

SEQ ID NO: 8136 - protein, 354 aa, Escherichia coli
MGFKMNIYIGWLFKLIPLLMGIICIALGEFVLTGSGQSEYFVAGHVLISLSAICLALFTTAFIIISQLTHGMNKFYNRLFPVIGYAGSATTMIWGWSLLASNNVMADEFVAGHVIFGVGMIAACVSTVAASSGHFLLIPKNASGSKSDGTPLQAYSSTIGNCLIAVPVLLTLFGFIWSVVLLRSADITPHYVAGHVLMGLTAICACLIGLVATIVHQTRNTFSVKEHWLWCYWVILLGSLTIIFGIYVLISSDASARLAPGIILICLGMICYSIFSKVWLLALVWRRTCSLANRIPMIPVFTCLFCLFLAAFLAEIAQTDMAYFIPSRVLVGLGAVCFTLFSIVSILEAGSAKK

SEQ ID NO: 8137 - DNA, 1194 bp, Escherichia coli
gtggaaaggtttgatgccattattataggcgctggtgcggcagggatgttctgttctgcgttggcaggtcaggcaggacgccgggttctgctgatcgataatggtaaaaaaccagggcgcaaaatcctcatgtctggcggtgggcgctgcaactttaccaacctttatgtcgaaccgggcgcttatctgagccagaatccgcatttttgtaagtctgcactcgcgcgttttacccagtgggatttcattgatctggtcaataaacacggcatcgcctggcacgagaaaacgttagggcagctcttctgcgatgactccgcgcagcagattgtcgacatgctggtggatgagtgcgagaagggcaatgtggccttcagattgcgtagcgaagtgctgagcgtggcgaaggatgatacaggcttcacgcttgaactgaacggcatgactgtcggttgcgaaaagctggtcattgcgaccggtggactgtcaatgccggggctgggtgcatcgccgtttggttataagattgccgaacaattcggcctcaacgtgctgccgacccgtgcgggtctggtgccattcactctgcataaaccgttgctcgaggagttacaggtgctggcgggcgtggcggtgccttccgtgattaccgctgaaaacggtatcgttttccgtgagaacttactcttcacccaccgcggcttatctggaccggcggtgttgcagatttccagctactggcaaccgggtgaatttgtcagcatcaatctgctaccggatgtggacctcgaaaccttcctgaatgagcagcgtaatgcacatccgaatcaaagcctgaaaaacacgctggcggttcatctgccgaagcggttggttgaacggttacaacaactcgggcaaatcccggatgtctcgctaaaacagctcaacgtgcgtgaccaacagacactgattagcacattgactgactggcgcgtacaacccaacggcactgaaggctatcgcactgccgaagtgacgctcggcggcgtggacaccaacgaactctcttcacggacgatggaagcgcgcaaagtgcctgggctgtacttcatcggcgaagtgatggacgtcaccggctggctggggggctataacttccagtgggcgtggtcgagtgcatgggcttgtgcgcaggatttggtggcagaataa

SEQ ID NO: 8138 - protein, 397 aa, Escherichia coli
MERFDAIIIGAGAAGMFCSALAGQAGRRVLLIDNGKKPGRKILMSGGGRCNFTNLYVEPGAYLSQNPHFCKSALARFTQWDFIDLVNKHGIAWHEKTLGQLFCDDSAQQIVDMLVDECEKGNVAFRLRSEVLSVAKDDTGFTLELNGMTVGCEKLVIATGGLSMPGLGASPFGYKIAEQFGLNVLPTRAGLVPFTLHKPLLEELQVLAGVAVPSVITAENGIVFRENLLFTHRGLSGPAVLQISSYWQPGEFVSINLLPDVDLETFLNEQRNAHPNQSLKNTLAVHLPKRLVERLQQLGQIPDVSLKQLNVRDQQTLISTLTDWRVQPNGTEGYRTAEVTLGGVDTNELSSRTMEARKVPGLYFIGEVMDVTGWLGGYNFQWAWSSAWACAQDLVAE

SEQ ID NO: 8139 - DNA, 1500 bp, Escherichia coli
atgctacatttgtttgctggcctggatttgcataccgggctgttattattgcttgcactggcttttgtgctgttctacgaagccatcaatggtttccatgacacagccaacgccgtggcaaccgttatctatacccgcgcgatgcgttctcagctcgccgtggttatggcggcggtattcaactttttgggtgttttgctgggtggtctgagtgttgcctatgccattgtgcatatgctgccgacggatctgctgcttaatatgggatcgtctcatggccttgccatggtgttctctatgttgctggcggcgattatctggaacctaggtacctggtactttggtttacctgcatccagctctcatacgctgattggcgcgatcatcgggattggtttaaccaatgcgttgatgaccgggacgtcagtggtggatgcactcaatatcccgaaagtattaagtattttcggttccctgatcgtttcccctattgtcggcctggtgtttgctggcggtctgattttcttgctgcgtcgctactggagcggcaccaagaaacgcgcccgtatccacctgaccccagcggagcgtgaaaagaaagacggcaagaaaaagccgccgttctggacgcgtattgcgctgatcctttccgctatcggcgtggcgttttcgcatggcgcgaacgatggtcagaaaggcattggtctggttatgttggtattgattggtgtcgcaccagcaggcttcgtggtgaacatgaatgccactggctacgaaatcacccgtacccgtgatgccatcaacaacgtcgaagcttactttgagcagcatcctgcgctgctgaaacaagcgaccggtgctgatcagttagtaccggctccggaagctggcgcaacgcaacccgcggagttccattgccatccgtcgaataccattaacgcgctcaaccgcctgaaaggcatgttgactaccgatgtggaaagctacgacaagctgtcgcttgatcaacgtagccagatgcgccgcattatgctgtgcgtttctgacactatcgacaaagtggtgaagatgcctggcgtgagtgctgacgatcagcgcctgttgaagaaactgaagtccgacatgcttagcaccatcgagtatgcgccggtgtggatcatcatggcggtcgcgctggcgttaggtatcggtacgatgattggctggcgtcgtgtggcaacgactatcggtgagaaaatcggtaagaaaggcatgacctacgctcaggggatgtctgcccagatgacggcggctgtgtctatcggcctggcaagttataccgggatgccggtttccactactcacgtactctcctcttctgtcgcggggacgatggtggtagatggcggcggcttacagcgtaaaaccgtaaccagtattctgatggcctgggtatttacccttccggctgcggtactgctttccggcgggctgtactggctctccttgcagttcctgtaa

SEQ ID NO: 8140 - protein, 499 aa, Escherichia coli
MLHLFAGLDLHTGLLLLLALAFVLFYEAINGFHDTANAVATVIYTRAMRSQLAVVMAAVFNFLGVLLGGLSVAYAIVHMLPTDLLLNMGSSHGLAMVFSMLLAAIIWNLGTWYFGLPASSSHTLIGAIIGIGLTNALMTGTSVVDALNIPKVLSIFGSLIVSPIVGLVFAGGLIFLLRRYWSGTKKRARIHLTPAEREKKDGKKKPPFWTRIALILSAIGVAFSHGANDGQKGIGLVMLVLIGVAPAGFVVNMNATGYEITRTRDAINNVEAYFEQHPALLKQATGADQLVPAPEAGATQPAEFHCHPSNTINALNRLKGMLTTDVESYDKLSLDQRSQMRRIMLCVSDTIDKVVKMPGVSADDQRLLKKLKSDMLSTIEYAPVWIIMAVALALGIGTMIGWRRVATTIGEKIGKKGMTYAQGMSAQMTAAVSIGLASYTGMPVSTTHVLSSSVAGTMVVDGGGLQRKTVTSILMAWVFTLPAAVLLSGGLYWLSLQFL

SEQ ID NO: 8141 - DNA, 336 bp, Escherichia coli
atgataagcaccgtcgcattattttgggctttatgtgtcgtttgcattgttaacatggcgcgctatttctcatcactacgcgcgttgttagtggtactgcgtaactgcgatccattgctctatcaatatgttgatggagggggcttttttacctcacatggccaacccaacaaacaggtgcgtctcgtttggtatatctatgcccaacgttatcgcgatcatcacgatgatgagtttattcgccgctgtgagcgggtgcgtcggcagtttattctgaccagcgcattgtgtggtctggtggtggtcagcctgattgcattgatgatttggcattaa

SEQ ID NO: 8142 - protein, 111 aa, Escherichia coli
MISTVALFWALCVVCIVNMARYFSSLRALLVVLRNCDPLLYQYVDGGGFFTSHGQPNKQVRLVWYIYAQRYRDHHDDEFIRRCERVRRQFILTSALCGLVVVSLIALMIWH

SEQ ID NO: 8143 - DNA, 435 bp, Escherichia coli
atggcttataaacacattctcatcgcggtcgacctctccccggaaagcaaagttctggtagagaaagcagtctctatggctcgcccctacaatgcgaaagtttctctgatccacgtagatgtaaactactctgacctatacaccgggcttatcgatgtgaatctgggtgatatgcagaaacgcatctctgaagagacacatcatgcactgaccgagctttcaaccaatgcaggctacccaatcactgaaaccctgagcggcagcggcgatctgggccaggtactggtcgatgcaatcaagaaatacgatatggatctggtggtttgtggtcaccaccaggacttctggagcaaactgatgtcttccgcacgtcagctgatcaacaccgttcacgttgatatgctgattgttccgctgcgcgacgaagaagaataa

SEQ ID NO: 8144 - protein, 144 aa, Escherichia coli
MAYKHILIAVDLSPESKVLVEKAVSMARPYNAKVSLIHVDVNYSDLYTGLIDVNLGDMQKRISEETHHALTELSTNAGYPITETLSGSGDLGQVLVDAIKKYDMDLVVCGHHQDFWSKLMSSARQLINTVHVDMLIVPLRDEEE

SEQ ID NO: 8145 - DNA, 99 bp, Escherichia coli
ttgctttttggcgcgccttgttacctgatgcagcgtaaacgccttatctggcctgcggtctgcgtacgcaatcaaaacccctgccaatacaacatttaa

SEQ ID NO: 8146 - protein, 32 aa, Escherichia coli
MLFGAPCYLMQRKRLIWPAVCVRNQNPCQYNI

SEQ ID NO: 8147 - DNA, 1470 bp, Escherichia coli
atgaatacaacaacacccatggggatgctgcagcaacctcgcccatttttcatgatcttttttgtcgagttatgggagcgattcggctactacggcgtgcagggcgtactggcggttttcttcgttaaacagcttgggttctcgcaagaacaggcttttgtcacttttggtgcttttgctgcgctggtctatggcctcatttccattggtggctatgttggcgaccacctgctgggaaccaaacgcaccattgttctcggagcacttgtgctggcgattggctacttcatgaccggcatgtcgctacttaagcctgacctgattttcatcgccctggggactatcgctgtcggtaacggcctgtttaaagctaacccagccagcttgctttcgaagtgctacccgccgaaagatccgcggcttgatggcgcattcaccctgttctatatgtcgatcaatatcggctcgttgatagcgttatcgctggcccctgtgatcgctgataaattcggctattcagtcacctacaacctgtgcggtgcagggttaattatcgcattactggtttacatcgcctgtcgtggaatggtgaaagacattggttctgaacccgacttccggccgatgagcttcagtaaactgttgtacgtattacttggcagcgtggtgatgatcttcgtctgcgcctggctgatgcacaacgtagaagtcgccaatctggttctgattgttctctccatcgtcgtcaccatcatcttctttcgtcaggcattcaagctggataaaaccgggcgcaataaaatgtttgtcgcctttgtcctgatgctcgaagcggtggtgttttacattctctacgcccagatgccaacgtcgctgaacttctttgccatcaacaacgtgcatcatgaaattctcggcttttccatcaacccggtcagcttccaggcgcttaacccgttctgggtggtactcgccagcccaatactggcaggcatttacacgcatctgggtaacaaaggcaaagatctctcgatgccgatgaagtttactctcggcatgtttatgtgctcactgggctttttgacggctgcagctgctggaatgtggtttgcggatgcccaggggctgacatcgccatggtttatcgtgctggtgtacttattccagagcttaggtgaactgtttattagcgcccttggcctggcgatgattgctgccctggtgccgcagcatttgatgggctttattctcgggatgtggttcctgacgcaggctgccgcgttcttgctgggcggctatgtggcaacatttaccgcagtaccagacaacattaccgatccacttgagacgttgcccgtctataccaacgtgtttggtaagattggcctggttacgctgggcgttgcagtagtgatgctattgatggtgccgtggctgaaacgcatgattgcgacgccggaaagccattaa

SEQ ID NO: 8148 - protein, 489 aa, Escherichia coli
MNTTTPMGMLQQPRPFFMIFFVELWERFGYYGVQGVLAVFFVKQLGFSQEQAFVTFGAFAALVYGLISIGGYVGDHLLGTKRTIVLGALVLAIGYFMTGMSLLKPDLIFIALGTIAVGNGLFKANPASLLSKCYPPKDPRLDGAFTLFYMSINIGSLIALSLAPVIADKFGYSVTYNLCGAGLIIALLVYIACRGMVKDIGSEPDFRPMSFSKLLYVLLGSVVMIFVCAWLMHNVEVANLVLIVLSIVVTIIFFRQAFKLDKTGRNKMFVAFVLMLEAVVFYILYAQMPTSLNFFAINNVHHEILGFSINPVSFQALNPFWVVLASPILAGIYTHLGNKGKDLSMPMKFTLGMFMCSLGFLTAAAAGMWFADAQGLTSPWFIVLVYLFQSLGELFISALGLAMIAALVPQHLMGFILGMWFLTQAAAFLLGGYVATFTAVPDNITDPLETLPVYTNVFGKIGLVTLGVAVVMLLMVPWLKRMIATPESH

SEQ ID NO: 8149 - DNA, 816 bp, Escherichia coli
gtggtcgtgaaccacagctggatgcgatgctggagcattacggcattaagggctgaacattcagtgaaaatctgcttaattgatgaaacaggcgccggagacggcgccttatctgttctggcggcccgctgggggctggagcacgatgaagacaacctgatggcgctggtgttaacgccggagcacctggaactgcgcaagcgtgatgagccgaagctgggcggcatctttgttgattttgttggcggggcgatggcgcaccgacgcaaattcggcggtggtcgcggagaggcggtggcgaaagcggtgggcattaaaggcgattatttgccggatgtggtggacgccaccgcaggattagggcgcgatgcctttgtgctggcttcggtcggctgccgcgtgcggatgctggagcgtaatccagtggttgccgcgctgctcgacgatggcctggcgcgtggttatgcggatgcggaaatcggcggctggttacaggaacgtttgcagttgattcacgcctccagtctgacggcgctgagcgatatcaccccgcgtccgcaggtagtttatcttgacccaatgttcccgcataagcagaaaagcgcgctggtgaaaaaagagatgcgcgtgtttcagtcgctggtggggccggatcttgatgccgatggattgttggagcctgcgcggttgctggcaaccaaacgcgtggtggtgaagcgtccggactatgcgccgccgctggcgaatgtcgccacgccaaacgcggtagtcactaaagggcatcgctttgatatttacgccggaacgccggtgtaa

SEQ ID NO: 8150 - protein, 271 aa, Escherichia coli
MVVNHSWMRCWSITALRAEHSVKICLIDETGAGDGALSVLAARWGLEHDEDNLMALVLTPEHLELRKRDEPKLGGIFVDFVGGAMAHRRKFGGGRGEAVAKAVGIKGDYLPDVVDATAGLGRDAFVLASVGCRVRMLERNPVVAALLDDGLARGYADAEIGGWLQERLQLIHASSLTALSDITPRPQVVYLDPMFPHKQKSALVKKEMRVFQSLVGPDLDADGLLEPARLLATKRVVVKRPDYAPPLANVATPNAVVTKGHRFDIYAGTPV

SEQ ID NO: 8151 - DNA, 2082 bp, Escherichia coli
ttgagcgcttccttaacctctttaaccaggactgcgctaatgacgaatccgttactgactccctttgaattgcctccgttttctaaaattctcccggaacatgtcgttccagccgtgactaaggcgctgaacgactgccgcgaaaatgtggagcgcgtagtagcgcaaggggcaccgtacacctgggaaaatctctgccagccgttggcggaagtggacgatgtgctggggcgtatcttctccccggtcagccatctgaactcggtgaaaaatagcccggaactgcgtgaagcgtacgaacaaaccctgccgctgctgtcagaatacagcacctgggtagggcaacatgaagggctgtataaggcatatcgcgacctgcgcgatggcgatcattacgccacgctgaacacggcgcagaaaaaagcggttgataacgcactgcgcgacttcgaactctctggcatcggtctgccgaaagagaaacagcagcgttacggcgaaattgctacccgtctttctgaactgggcaaccagtacagcaacaacgtcctcgatgcgacgatgggctggaccaaactcgttaccgacgaagcggagctggcggggatgccagaaagcgcgctggctgcggcaaaagcccaggctgaagcgaaagagctggaaggttatttgctgacgctggatatcccaagctacctgccggtaatgacctactgcgacaaccaggccctgcgcgaagagatgtatcgcgcttatagcactcgtgcttccgatcaaggtccgaacgccggtaagtgggacaacagcaaggtgatggaagagatcctcgcgctgcgtcacgaactggcgcaactgctgggctttgaaaactacgccttcaaatcacttgccactaaaatggcagaaaacccgcagcaggtgctggatttcttaaccgatctggcaaaacgcgcgcgcccgcaaggcgaaaaagagctggcgcaactgcgcgccttcgccaaagccgaatttggcgtcgatgagttacaaccgtgggatatcgcttactacagcgaaaaacagaaacagcacctctacagcatcagcgatgaacaactgcgtccgtacttcccggaaaacaaagcggttaacggcctgtttgaagtggtgaaacgtatttacggcatcaccgctaaagagcgtaaagatgttgatgtctggcatccggatgtacgtttcttcgagctgtatgacgagaacgacgaactgcgcggcagcttctacctcgacctgtatgcccgtgaaaacaaacgcggcggggcgtggatggatgactgcgtaggccagatgcgtaaagccgacggttcgctgcaaaaaccggtcgcgtatctgacctgcaacttcaaccgcccggtaaatggtaaaccggcgctgtttacccatgacgaagtgatcaccctgttccacgagttcggtcacggcctgcaccatatgctgacccgcattgaaaccgctggtgtttccgggatcagtggggtgccgtgggatgcggtcgaactgccgagccagtttatggaaaactggtgctgggagccggaggcgctggcgtttatctccggtcactatgaaaccggcgagccgctgccgaaggagctgctggataaaatgctggcagcgaaaaattaccaggcggcgctgtttattctgcgccagctggagttcggcctgttcgatttccgcctccatgccgagttccgtccggatcagggggcgaaaatcctcgaaactctggcagaaatcaagaaactggttgccgtggtaccgtctccgtcatggggccgtttcccgcatgctttcagccacatttttgccggtggttatgcggcaggttactacagctacctgtgggccgatgtgctggcggcagatgccttctcgcgttttgaggaagagggcattttcaaccgtgaaactgggcagtcgttcctcgacaacattctgagccgtggcggttcagaagagccgatggagctgttcaaacgcttccgtggtcgtgaaccacagctggatgcgatgctggagcattacggcattaagggctga

SEQ ID NO: 8152 - protein, 693 aa, Escherichia coli
MSASLTSLTRTALMTNPLLTPFELPPFSKILPEHVVPAVTKALNDCRENVERVVAQGAPYTWENLCQPLAEVDDVLGRIFSPVSHLNSVKNSPELREAYEQTLPLLSEYSTWVGQHEGLYKAYRDLRDGDHYATLNTAQKKAVDNALRDFELSGIGLPKEKQQRYGEIATRLSELGNQYSNNVLDATMGWTKLVTDEAELAGMPESALAAAKAQAEAKELEGYLLTLDIPSYLPVMTYCDNQALREEMYRAYSTRASDQGPNAGKWDNSKVMEEILALRHELAQLLGFENYAFKSLATKMAENPQQVLDFLTDLAKRARPQGEKELAQLRAFAKAEFGVDELQPWDIAYYSEKQKQHLYSISDEQLRPYFPENKAVNGLFEVVKRIYGITAKERKDVDVWHPDVRFFELYDENDELRGSFYLDLYARENKRGGAWMDDCVGQMRKADGSLQKPVAYLTCNFNRPVNGKPALFTHDEVITLFHEFGHGLHHMLTRIETAGVSGISGVPWDAVELPSQFMENWCWEPEALAFISGHYETGEPLPKELLDKMLAAKNYQAALFILRQLEFGLFDFRLHAEFRPDQGAKILETLAEIKKLVAVVPSPSWGRFPHAFSHIFAGGYAAGYYSYLWADVLAADAFSRFEEEGIFNRETGQSFLDNILSRGGSEEPMELFKRFRGREPQLDAMLEHYGIKG

SEQ ID NO: 8153 - DNA, 894 bp, Escherichia coli
ttgtgcgccccgaatacgggccgatttttacttaccggaacacctttacccatgctcagttatcgccacagctttcacgctggcaaccacgccgacgtccttaaacataccgttcagagcctgatcattgagtcgctgaaagagaaagataaaccgtttctctatctcgacacccacgcaggggccgggcgttatcagttaggcagcgaacatgccgagcgtaccggcgaatatctcgaaggcatcgcccgtatctggcagcaggacgatttgcctgcggagctggaggcgtacatcaatgtggtaaaacacttcaaccgtagcgggcagttgcgttattaccccggttcgccgttgattgctcgccagctactgcgtgaacaggacagcctgcaactgaccgaactgcacccgagcgattacccgttgctgcgttctgaatttcagaaagacagccgtgcgcgcgtcgaaaaagccgacggtttccagcagcttaaggccaagctgccgccggtttcccgccgtggtttaatccttatcgacccgccgtatgaaatgaaaaccgactatcaggcggtggtcagcgggatagcagaaggttacaaacgtttcgccactggcacttacgcattgtggtatccagtggtgctgcgccagcaaattaagcgcatgatccacgacctggaagcgaccggcattcgcaaaattctgcaaattgaactggcggtgctgccagacagcgatcgccgtggcatgaccgcttccggcatgattgtgattaacccgccgtggaagctggaacagcagatgaataacgtgctgccgtggctgcacagcaaactggttccggcaggcaccgggcacgccaccgtaagctggatcgtgccagagtaa

SEQ ID NO: 8154 - protein, 297 aa, Escherichia coli
MCAPNTGRFLLTGTPLPMLSYRHSFHAGNHADVLKHTVQSLIIESLKEKDKPFLYLDTHAGAGRYQLGSEHAERTGEYLEGIARIWQQDDLPAELEAYINVVKHFNRSGQLRYYPGSPLIARQLLREQDSLQLTELHPSDYPLLRSEFQKDSRARVEKADGFQQLKAKLPPVSRRGLILIDPPYEMKTDYQAVVSGIAEGYKRFATGTYALWYPVVLRQQIKRMIHDLEATGIRKILQIELAVLPDSDRRGMTASGMIVINPPWKLEQQMNNVLPWLHSKLVPAGTGHATVSWIVPE

SEQ ID NO: 8155 - DNA, 1353 bp, Escherichia coli
atgactaaacactatgattacatcgccatcggcggcggcagcggcggtatcgcctccatcaaccgcgcggctatgtacggccagaaatgcgcactgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgagaacgtgctcggtaaaaataacgttgatgtaatcaaaggctttgcccgcttcgttgatgccaaaaccattgaagtcaacggcgaaaccatcacggccgatcatattctgatcgccaccggtggtcgtccgagccacccggatattccgggcgtggaatacggtattgattctgatggcttcttcgcccttccggctttgccagagcgcgtagcggttgttggcgcgggttacatcgccgttgaactggcgggcgtgattaacggcctcggtgcgaagacgcatctgtttgtgcgtaaacatgcgccgctgcgcagcttcgacccgatgctctctgaaacgctggttgaagtgatgaacgccgaaggcccgcagttgcacaccaacgccatcccgaaagcggtagtgaaaaatgccgatggtagcctgacgctggagctggaagatggtcgcagtgaaacggtggattgcctgatttgggcgattggtcgcgagcctgccaatgacaacatcaacctggaagccgctggcgttaaaaccaacgaaaaaggctatatcgtcgtcgataaatatcaaaacaccaacgttgaaggtatttacgcggtgggcgataacacgggtgcagtggaactgacaccggtggctgttgcagcaggtcgccgtctctctgaacgcctgtttaataacaagccggatgagcatctggattacagcaacattccgaccgtggtcttcagccatccgccgattggtactgttggtttaacggagccgcaggcgcgcgagcagtacggcgacgatcaggtgaaagtgtataaatcctctttcaccgcgatgtataccgccgtcaccactcaccgccagccgtgtcgcatgaaactggtatgcgttggaccggaagagaagattgtcggtattcacggcattggttttggtatggacgaaatgttgcagggcttcgcggtggcgctgaagatgggtgcaaccaaaaaagacttcgacaacacggttgccattcacccgacagcggcagaagagttcgtgacaatgcgttaa

SEQ ID NO: 8156 - protein, 450 aa, Escherichia coli
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTIEVNGETITADHILIATGGRPSHPDIPGVEYGIDSDGFFALPALPERVAVVGAGYIAVELAGVINGLGAKTHLFVRKHAPLRSFDPMLSETLVEVMNAEGPQLHTNAIPKAVVKNADGSLTLELEDGRSETVDCLIWAIGREPANDNINLEAAGVKTNEKGYIVVDKYQNTNVEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGPEEKIVGIHGIGFGMDEMLQGFAVALKMGATKKDFDNTVAIHPTAAEEFVTMR

SEQ ID NO: 8157 - DNA, 150 bp, Escherichia coli
atgcgccgtgacaggcaatggatgagtaagcggatgcattctcactccatcgcatggagaaaacgggtgattgataaagcaatcatcgttcttggggcgttaattgcgctgctggaactgatccgctttctgcttcagcttctgaactga

SEQ ID NO: 8158 - protein, 49 aa, Escherichia coli
MRRDRQWMSKRMHSHSIAWRKRVIDKAIIVLGALIALLELIRFLLQLLN

SEQ ID NO: 8159 - DNA, 426 bp, Escherichia coli
atgagcaacattaccatttatcacaacccggcctgcggtacgtcacgtaatacgctggagatgatccgcaacagcggtacagaaccgaccattatctattatctggaaacaccaccgacgcgcgatgagctggtaaaactcattgccgatatggggattaccgtacgcgcgctgctacgtaaaaacgtcgagccgtatgaggaactgggccttgcagaagataaatttactcacgatcagttaatcgactttatgcttcagcacccgattctgattaatcgcccgattgtggtgacgccgctgggaactcgcctgtgccgcccttcagaagtcgtgctggaaattctgccagatgcgcaaaaaggcgcgttcaccaaggaagatggcgagaaagtggttgatgaggcgggtaatcgcctgaaataa

SEQ ID NO: 8160 - protein, 141 aa, Escherichia coli
MSNITIYHNPACGTSRNTLEMIRNSGTEPTIIYYLETPPTRDELVKLIADMGITVRALLRKNVEPYEELGLAEDKFTHDQLIDFMLQHPILINRPIVVTPLGTRLCRPSEVVLEILPDAQKGAFTKEDGEKVVDEAGNRLK

SEQ ID NO: 8161 - DNA, 567 bp, Escherichia coli
atgaacatgacaaaaggtgcactcatcctcagcctttcatttttgcttgccgcatgtagttcaattccgcaaaatatcaaaggcaataaccaacctgatattcaaaaaagttttgttgctgttcataaccagccggggttatatgttggtcaacaagcgcgctttggcgggaaggttatcaacgttatcaatggcaaaacggatacgttgttagaaatcgctgtattaccgttggatagctatgcgaagcctgatattgaagccaactatcagggccgactgctcgccagacaaagcggcttccttgatccagtgaactatcgtaatcactttgttaccatcctcggtaccattcagggtgaacaacctggctttatcaataaagtcccgtataacttcctggaagtgaatatgcagggcatccaggtgtggcatttgagagaagtggttaataccacctataacttgtgggattacggctatggtgcattctggccggaaccgggctggggggctccttactacaccaatgcggtgagtcaggtaacacctgagctggtcaaataa

SEQ ID NO: 8162 - protein, 188 aa, Escherichia coli
MNMTKGALILSLSFLLAACSSIPQNIKGNNQPDIQKSFVAVHNQPGLYVGQQARFGGKVINVINGKTDTLLEIAVLPLDSYAKPDIEANYQGRLLARQSGFLDPVNYRNHFVTILGTIQGEQPGFINKVPYNFLEVNMQGIQVWHLREVVNTTYNLWDYGYGAFWPEPGWGAPYYTNAVSQVTPELVK

SEQ ID NO: 8163 - DNA, 531 bp, Escherichia coli
atgtttcttataattaccagggatacgatgtttttcaccgcgatgaaaaacattctgagtaaaggtaatgtcgttcatatacagaacgaagaagagatcgacgtaatgttgcatcagaatgccttcgtcattattgatacattaatgaataatgtatttcattctaattttctcactcaaattgaacgattaaaacctgtccatgtaattattttctccccctttaatattaaacgctgcctggggaaagtaccggtgacctttgttccgcgaactatcgccatcatcgactttgtcgcactcatcaatggcagttactgctctgtgcctgaagcggatgtgtccctctcgcgcaagcagcatcaggttctgagctgcattgcgaatcaaatgacaacggaagatattctggagaaactgaaaatatcgctaaaaacgttctactgccataaacacaatatcatgatgatcctcaatcttaagcggatcaatgagctggtacgccatcagcatattaattatctggtgtga

SEQ ID NO: 8164 - protein, 176 aa, Escherichia coli
MFLIITRDTMFFTAMKNILSKGNVVHIQNEEEIDVMLHQNAFVIIDTLMNNVFHSNFLTQIERLKPVHVIIFSPFNIKRCLGKVPVTFVPRTIAIIDFVALINGSYCSVPEADVSLSRKQHQVLSCIANQMTTEDILEKLKISLKTFYCHKHNIMMILNLKRINELVRHQHINYLV

SEQ ID NO: 8165 - DNA, 1029 bp, Escherichia coli
atgaaccactacacacgctggcttgagttaaaagaacaaaatcccggaaagtacgcgcgtgacatcgcaggtttaatgaatatcagcgaagcagaactggcatttgcacgcgtcacgcacgacgcgtggcggatgcgcggcgatattcgtgaaattctggcggcgctggaaagcgttggtgaaaccaaatgtatttgtcgtaatgaatatgcagtccatgagcaagttggctcgttcacaaaccagcatttgaacggacatgccggattgatcctcaatccgcgcgcgctggatttacgtctgtttctcaatcaatgggccagtgttttccacatcaaagaaaacacggctcgtggcgaacgccagagtattcagttctttgatcatcagggcgatgcattactaaaagtttatgccaccgacaataccgatatggcggcatggagtgagcttctggcacggtttatcaccgatgagaatacgccgcttgagttaaaagccgttgatgcgccagttgttcaaacgcgagccgatgccagtgtggtcgagcaagagtggcgggcgatgaccgacgttcatcagttttttacgttgctcaagcgccacaacctgacgcgccaacaggcgttcaatctggtggcagacgatttggcctgcaaagtatccaacagtgcgttggcgcaaattcttgaatctgcacagcaggatggcaatgaaatcatggtgtttgttggcaaccgtggctgcgtacagattttcaccggtgtggtagaaaaagtggtgccaatgaaaggttggctgaatattttcaacccgacgtttacccttcatctattagaagagagcattgctgaagcctgggttacccgtaaaccgaccagcgatggtcacgtaaccagtctggaattgtttgcccatgatggtacgcagatagcgcaactttatggtcaacgtacagaaggtgaacaggagcaagcgcaatggcgtaagcaaattgcttcgttgataccggaaggcgttactgcataa

SEQ ID NO: 8166 - protein, 342 aa, Escherichia coli
MNHYTRWLELKEQNPGKYARDIAGLMNISEAELAFARVTHDAWRMRGDIREILAALESVGETKCICRNEYAVHEQVGSFTNQHLNGHAGLILNPRALDLRLFLNQWASVFHIKENTARGERQSIQFFDHQGDALLKVYATDNTDMAAWSELLARFITDENTPLELKAVDAPVVQTRADASVVEQEWRAMTDVHQFFTLLKRHNLTRQQAFNLVADDLACKVSNSALAQILESAQQDGNEIMVFVGNRGCVQIFTGVVEKVVPMKGWLNIFNPTFTLHLLEESIAEAWVTRKPTSDGHVTSLELFAHDGTQIAQLYGQRTEGEQEQAQWRKQIASLIPEGVTA

SEQ ID NO: 8167 - DNA, 1983 bp, Escherichia coli
atgtcacgtccgcaatttacctcgttgcgtttgagtttgttggctttggctgtttctgccaccttgccaacgtttgcttttgctactgaaaccatgaccgttacggcaacggggaatgcacgtagttccttcgaagcgcctatgatggtcagcgttatcgacacttccgctcctgaaaatcaaactgctacttcagccactgatttgctgcgtcatgttcctggaattactcttgatggtaccggacgaaccaacggtcaggatgtaaatatgcgtggctatgatcatcgcggcgtgctggttcttgtcgatggtgttcgccagggaacggataccggacacctgaatggcacttttctcgatccggcgctgatcaagcgtgttgagattgttcgcggaccttcagcattactgtatggcagtggcgcgctgggtggagtgatctcctacgatacggtcgatgcaaaagatttattgcaggaaggacaaagtagtggttttcgtgtctttggtactggcggcacgggggaccatagcctgggattaggcgcgagcgcgtttgggcgaactgaaaatctggatggtattgtggcttggtccagtcgcgatcggggtgatttacgccagagcaatggtgaaaccgcgccgaatgacgaatccattaataacatgctggcgaaagggacctggcaaattgattcagcccagtctctgagcggtttagtgcgttactacaacaacgacgcgcgtgaaccaaaaaatccgcagaccgttgaagcttctgatagcagcaacccgatggtcgatcgttcaacaattcaacgcgatgcgcagctttcttataaactcgccccgcagggtaacgactggttaaatgcagatgcaaaaatatactggtcggaagtccgtattaatgcgcaaaacacggggagttccggcgagtatcgtgaacagataacaaaaggagccaggctggagaaccgttccactctatttgccgacagtttcgcttctcacttactgacatatggcggtgagtattatcgtcaggaacaacatccgggtggcgcgacgacgggcttcccgcaagcaaaaatcgattttagctctggctggctacaagatgagatcaccttacgcgatctgccgattaccctgcttggcggaacccgctatgacagttatcgcggtagcagcgacggctacaaagatgttgatgccgacaaatggtcatctcgtgcggggatgactatcaacccgaccaactggctgatgttatttggctcatatgctcaggcattccgcgccccgacgatgggcgaaatgtataacgattctaaacacttctcgattggtcgcttctataccaactattgggtgccaaacccgaacttacgtccggaaactaacgaaactcaggagtacggttttgggctgcgttttgatgacctgatgttgtccaatgatgctctggaatttaaagccagctactttgataccaaagcgaaagattatatctccacgaccgtcgatttcgcggcggcgacaactatgtcgtataacgtcccgaacgccaaaatctggggctgggatgtgatgacgaaatataccactgatctgtttagccttgatgtggcctataaccgtacccgcggcaaagacaccgataccggggaatatatctccagcattaacccggataccgttaccagtaccctgaatattccgatcgctcacagtggcttctctgttggttgggtcggtacgtttgccgatcgctcaacacatatcagcagcagctacagcaaacaacctggctatggtgtgaatgatttctacgtcagttatcaaggacaacaggcgctcaaaggcgtgaccactactctggtattgggcaacgccttcgataaagagtactggtcgccgcaaggcatcccacaggatggtcgtaacggaaaaattttcgtgagttatcaatggtaa

SEQ ID NO: 8168 - protein, 660 aa, Escherichia coli
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGVTTTLVLGNAFDKEYWSPQGIPQDGRNGKIFVSYQW

SEQ ID NO: 8169 - DNA, 162 bp, Escherichia coli
atgaaatctatccagcatccagaaaaccatcctgtgtttatggctatccccccacaacctcatcacaaaacgttgtcgttaacagtgataattttctcttctctttgctctgcaagccgcgatatctccgggttctcagctttttcccgcgctgaaatttaa

SEQ ID NO: 8170 - protein, 53 aa, Escherichia coli
MKSIQHPENHPVFMAIPPQPHHKTLSLTVIIFSSLCSASRDISGFSAFSRAEI

SEQ ID NO: 8171 - DNA, 993 bp, Escherichia coli
ttgaatcgacggttgtatttcatatataactcaaatgataatcatgatcattctcaatttgataagagttctcacattatgccaaggatcatcaccaggccgtttcttttttccccactaacgttatgtatttcagccgtggcctctgccgcgaagaccatggtaaaacgaaaaaaattgtttacggcattactggctcttagctggacttttagcgtaacggctgccgaacgtatcgtggtcgcaggaggatcgctgacggagctaatctacgcgatgggcgctggcaaacgcgtggttggtgtcgatgaaacgacatcttatccaccagaaaccgccaaactgccgcatattggttactggaaacaactcagcagcgaaggcattttgtcacttcgcccggatagcgtaattacctggcaggatgcaggaccgcaaattgtgctcgaccaactgcgggcgcaaaaagtcaacgtcgtcactctgccgcgtgtaccagccacccttgagcagatgtacgccaacattcgccaactggcaaaaacgttacaggttcctgaacaaggcgaggcgctggtgacacagatcaaccaacgcctggagcgagtacagcaaaacgtggcggccaaaaaagccccggttaaagccatgtttattctctccgcaggcggaagtgcgccacaggttgccggtaaaggcagcgtcgcggacgccattctttcgcttgccggagcagaaaacgtcgctacccaccagcagtacaaaagctacagcgcggaatcgctgattgcggctaaccctgaagtgattgtcgtcacctcacaaatggtcgatggcgatattaatcggctacgttctattgccggaattacccacactgccgcatggaaaaaccagcgcattatcaccgttgatcaaaacctgattctgggaatgggtccgcgtattgctgatgtcgttgagtctttacaccagcagctttggccgcaataa

SEQ ID NO: 8172 - protein, 330 aa, Escherichia coli
MNRRLYFIYNSNDNHDHSQFDKSSHIMPRIITRPFLFSPLTLCISAVASAAKTMVKRKKLFTALLALSWTFSVTAAERIVVAGGSLTELIYAMGAGKRVVGVDETTSYPPETAKLPHIGYWKQLSSEGILSLRPDSVITWQDAGPQIVLDQLRAQKVNVVTLPRVPATLEQMYANIRQLAKTLQVPEQGEALVTQINQRLERVQQNVAAKKAPVKAMFILSAGGSAPQVAGKGSVADAILSLAGAENVATHQQYKSYSAESLIAANPEVIVVTSQMVDGDINRLRSIAGITHTAAWKNQRIITVDQNLILGMGPRIADVVESLHQQLWPQ

SEQ ID NO: 8173 - DNA, 1257 bp, Escherichia coli
atgccgtttcgtggggccattccggttgccaaagagcaactggcacagacctggcaagagatgatcaatcaaacggtatcaccacgtaagcgactggtttacctacacattcctttttgtgcgacacactgcacgttttgtggtttttatcagaaccgttttaatgaagatgcgtgtgctcattataccgatgccctgattcgtgaaatagaaatggaagcagacagcgtattgcatcagtcggcccccatccacgcggtctatttcggtggcggtacgccttccgcgctttcagcacacgatttggccagaatcatcaccacattacgagaaaagctgccactggcccctgattgtgaaatcactatcgaaggccgggtactgaattttgacgctgagcgaatcgatgcttgccttgatgcaggagcaaaccgcttctcaattggtattcagtcgtttaacagcaaaatccgcaagaaaatggcccgcacctcggatggcccaaccgctattgcgtttatggaaagcctggtcaaacgcgatcgtgccgcggtggtctgtgacctgctgtttggtctgccgggtcaggatgcgcaaacctggggagaagatctggctattgcccgcgatatcggtctcgacggcgtcgatctctatgcgctcaatgtcctgcccaatacaccgctgggcaaagccgtggaaaatgggcgtactaccgtgccctctccggcagaacgtcgcgatctttacctgcaaggatgtgattttatggacgatgccggttggcgctgcatcagtaacagccactggggccgtaccacacgcgaacgcaatctctataacctgctgattaaacaaggtgccgattgtctggcctttggttccggagccggcggttcgattaatgggtactcctggatgaacgaacgcaatcttcagacctggcatgaatccgtcgcggcaggcaaaaaaccgctgatgatgatcatgcgtaacgccgaacgtaatgcgcaatggcgtcataccttgcagtcgggcattgaaacggcgcgtgtaccgctggacgaacttacgccacatgccgaaaaactcgcgccgttactggcccagtggcaccaaaaaggcttaagccgcgatgcgtcaacgtgtctgcggttgaccaatgaaggtcgtttctgggcaagcaacattttgcagtctcttaatgaactgattcaggtacttaatgcgccagcaattgcgcttgaaaaaccataa

SEQ ID NO: 8174 - protein, 418 aa, Escherichia coli
MPFRGAIPVAKEQLAQTWQEMINQTVSPRKRLVYLHIPFCATHCTFCGFYQNRFNEDACAHYTDALIREIEMEADSVLHQSAPIHAVYFGGGTPSALSAHDLARIITTLREKLPLAPDCEITIEGRVLNFDAERIDACLDAGANRFSIGIQSFNSKIRKKMARTSDGPTAIAFMESLVKRDRAAVVCDLLFGLPGQDAQTWGEDLAIARDIGLDGVDLYALNVLPNTPLGKAVENGRTTVPSPAERRDLYLQGCDFMDDAGWRCISNSHWGRTTRERNLYNLLIKQGADCLAFGSGAGGSINGYSWMNERNLQTWHESVAAGKKPLMMIMRNAERNAQWRHTLQSGIETARVPLDELTPHAEKLAPLLAQWHQKGLSRDASTCLRLTNEGRFWASNILQSLNELIQVLNAPAIALEKP

SEQ ID NO: 8175 - DNA, 495 bp, Escherichia coli
atgagccatgtctcgttacaggaatttttgaaaacggagccagacggtacgctggaggcgatcgccgaacaatacaacaccacgctgctggaggtagtgaaaaatctgccctctccgactgttgtgtcaggtgataaattcgatactgtctgggataccgtctgcgaatggggcaacgtcaccacgttagtacatactaccgatgtaatactcgaatttagcggcgaactgccttcgggtttccatcgccacggctatttcaacctacgcggaaagcacggcatgtccgggcatatcaaagcagaaaactgcacgcatattgccttgatcgaacgtaaatttatgggcatggataccgcctctattctctttttcaataaggaaggcagcgcaatgctgaaaatcttcctcggtagggatgatcatcgtcagctcctgagcgaacaagtcagcgccttccatgctctggcagcatcgttaaaggaacacgcctga

SEQ ID NO: 8176 - protein, 164 aa, Escherichia coli
MSHVSLQEFLKTEPDGTLEAIAEQYNTTLLEVVKNLPSPTVVSGDKFDTVWDTVCEWGNVTTLVHTTDVILEFSGELPSGFHRHGYFNLRGKHGMSGHIKAENCTHIALIERKFMGMDTASILFFNKEGSAMLKIFLGRDDHRQLLSEQVSAFHALAASLKEHA

SEQ ID NO: 8177 - DNA, 624 bp, Escherichia coli
atgacaccgtggctactctttggcgcaggcggaaaaggtgtgggtgccagaacgcttgaactggcgctggcggaacaacgtccggtcgttgctgtcattcgtcatgccgatgccgccacgaaactggcgcaacaaggcgtacaggtttttacaggcgacgcctgtgatgccagcgtagtcgcggctgcttgccgcgcaactggcccggatgcgcttatcatctcaacaatgggcggagctcaggattatctggcgcacagaacagtgattgatgaggccgagaaggctggcatcagtcgcatgattctggtgacctctttgggatgcggcgatagctggccgtttttatcagagcgggcaaaggctgcgtttggtcaggcggtacgggaaaaaacgctggcggaaagctggttgcaaaccagccagcttgattatgccattctccgccctggcggtctgcttgatggtgcggcaacgggcaaagcacaacggatacaaaatcaggagtgtcatggttttgttaaccgtgctgatgtcgccgcacatatccatgaactggcaaatgcgccagcacttaaccagcaggtctacagtctgattgaaccggacctgaaaccggcgtga

SEQ ID NO: 8178 - protein, 207 aa, Escherichia coli
MTPWLLFGAGGKGVGARTLELALAEQRPVVAVIRHADAATKLAQQGVQVFTGDACDASVVAAACRATGPDALIISTMGGAQDYLAHRTVIDEAEKAGISRMILVTSLGCGDSWPFLSERAKAAFGQAVREKTLAESWLQTSQLDYAILRPGGLLDGAATGKAQRIQNQECHGFVNRADVAAHIHELANAPALNQQVYSLIEPDLKPA

SEQ ID NO: 8179 - DNA, 993 bp, Escherichia coli
gtgctcaaggattcactctcttccgccagggtctttatggggctatcactattattgctagctctggtgctgtttggtgccagtcagggagcgttaaagatcagttttgatgccctttttgatgaggaataccgcgatatctggctcaatattcgtctaccacgggttttgctggcggtgctggtaggtgcagcgttggcaaccgcaggggtaattatgcaggggctttttcgcaacccaatggctgaccctggattacttggcgtcagtagcggttctgcattaatggttggcgttgctattgtgctgcccttctccttcccagtggtgctggtgctctatgagcaaatggtgtttgccattgccggaagtttagtggtctgcaccatcatttttctcatcacgcagcgccatcgcgatggcagcatgatgcaattattactcgccggtatcgccatcaatgccctgtgcggcgcagcgatcggcatcctgagctatatcggcgatgagcagcagctacgacaactcacattgtggatgatgggcaatcttggacaggcgcaatggccgacgttattggttgccagttcattcatcctaccggccattatcgcaacaacttgtctcgccggaacgctgaatttactgcagctcggtgatgaagaagcccactacctcggcgtgaacgtgaagcgtaaacgccagcaattactgttagtgagctcactgctcgttggtgctgccgtatcggtaagcggcattatcggctttattggcctggtgatcccgcatctgattcgcatgactaccggggcaaatcaccgctggctaatcccttgttccgccctcgccggagcctgtttattgctgatggcagacacgcttgcccgcacgctggtacagccagcagaaatgcccgtgggattattaaccagcctgcttggtggcccttattttatgtggttgattctgcgcaaccggaggatcacatga

SEQ ID NO: 8180 - protein, 330 aa, Escherichia coli
MLKDSLSSARVFMGLSLLLLALVLFGASQGALKISFDALFDEEYRDIWLNIRLPRVLLAVLVGAALATAGVIMQGLFRNPMADPGLLGVSSGSALMVGVAIVLPFSFPVVLVLYEQMVFAIAGSLVVCTIIFLITQRHRDGSMMQLLLAGIAINALCGAAIGILSYIGDEQQLRQLTLWMMGNLGQAQWPTLLVASSFILPAIIATTCLAGTLNLLQLGDEEAHYLGVNVKRKRQQLLLVSSLLVGAAVSVSGIIGFIGLVIPHLIRMTTGANHRWLIPCSALAGACLLLMADTLARTLVQPAEMPVGLLTSLLGGPYFMWLILRNRRIT

SEQ ID NO: 8181 - DNA, 771 bp, Escherichia coli
atgatcagcgcccagaatctggtttatagccttcaggggcggcgtctgactgataatgtctcgctgacttttcccggtggggaaattgttgccatcctcgggcctaatggtgcgggaaaatctacgctgcttcgccagctaaccggctatcttcaacctgatagcggcgaatgtcggttgtttaataagccattaaatgaatggtcgattactgaactggcgaaacaccgggccgtgatgcgtcaaaatagccacatggcgtttccattcagcgtacaagaagttatccagatggggcggcatccgcatcgtactggtaatcaggataatgaaacagcacaaataatggcgttatgtgactgtcaggcgttagcaaaccgcaactatcggcaattatccggtggtgaacaacagcgcgtgcaattagcgcgcctgctggtgcaactctgggaacctactccctcaccgaaatggttatttcttgatgaaccaacttcggcgctggatattcaccatcagcagcacttgtttcgtttattacgccagttagttcacgaacggcagttcaatgtttgctgcgtattgcacgatctaaatcttgccgcgcgttatgcagaccgtgttgtattaatgcaaaaaggaaaggttatcgcaaatggtaagccgcaggacgtattgacacagcaggcgctgacaatgctctacggcgcggatattaccgtacttaaagatcctgccaaccattcaccactgatcgtcctcgatcattaa

SEQ ID NO: 8182 - protein, 256 aa, Escherichia coli
MISAQNLVYSLQGRRLTDNVSLTFPGGEIVAILGPNGAGKSTLLRQLTGYLQPDSGECRLFNKPLNEWSITELAKHRAVMRQNSHMAFPFSVQEVIQMGRHPHRTGNQDNETAQIMALCDCQALANRNYRQLSGGEQQRVQLARLLVQLWEPTPSPKWLFLDEPTSALDIHHQQHLFRLLRQLVHERQFNVCCVLHDLNLAARYADRVVLMQKGKVIANGKPQDVLTQQALTMLYGADITVLKDPANHSPLIVLDH

SEQ ID NO: 8183 - DNA, 648 bp, Escherichia coli
atgacagcagaatttattatacgacttatacttgcggtaattgcctgtggcgctattggcatggaaaggcaaatgcgcggcaaaggagcagggttacgcacacatgtattaattggcatgggaagcgccctgtttatgattgtttcgaaatatggttttgctgacgtgctgtctttaggtcacgtcggactggatcccagccgtattgctgctcaggttgtgacgggcgtcgggtttatcggtgcaggtaacattctcgttcgtaaccaaaatattgtaggtctgacgacggcagcggatatctgggtgaccgccgccattggtatggttattggcagcggtatgtacgaactgggtatttatggttcagtgatgaccttgctggtgctggaagtcttccatcaattaaccttccgcctgatgaacaaaaattaccatttacagctgacattagtgaacggtaatacggtatcaatgctcgactggtttaagcagcaaaaaataaaaacggatttagtttcgttgcaggaaaatgaagatcatgaagtggtcgccattgatatccagcttcatgccacgacgtcgatagaagatctgttgcgattattaaaaggtatggcaggggtgaaaggcgtttcaattagctaa

SEQ ID NO: 8184 - protein, 215 aa, Escherichia coli
MTAEFIIRLILAVIACGAIGMERQMRGKGAGLRTHVLIGMGSALFMIVSKYGFADVLSLGHVGLDPSRIAAQVVTGVGFIGAGNILVRNQNIVGLTTAADIWVTAAIGMVIGSGMYELGIYGSVMTLLVLEVFHQLTFRLMNKNYHLQLTLVNGNTVSMLDWFKQQKIKTDLVSLQENEDHEVVAIDIQLHATTSIEDLLRLLKGMAGVKGVSIS

SEQ ID NO: 8185 - DNA, 327 bp, Escherichia coli
atgaacatttcatctctccgtaaagcgtttatttttatgggcgctgtagcggctttgtcactggtgaacgcacaatctgcgctggcagccaatgaatccgctaaagatatgacctgccaggaatttattgatctgaatccaaaagcaatgacaccagttgcgtggtggatgctgcatgaagaaacagtatataaaggtggcgataccgttactttaaatgaaaccgatctcactcaaattcctaaagtgatcgaatactgcaagaaaaacccgcagaaaaatttgtataccttcaaaaatcaagcatctaatgacttgccgaattaa

SEQ ID NO: 8186 - protein, 108 aa, Escherichia coli
MNISSLRKAFIFMGAVAALSLVNAQSALAANESAKDMTCQEFIDLNPKAMTPVAWWMLHEETVYKGGDTVTLNETDLTQIPKVIEYCKKNPQKNLYTFKNQASNDLPN

SEQ ID NO: 8187 - DNA, 333 bp, Escherichia coli
atgaaaaaagtattaggcgttattcttggtggtctgcttcttctgccagtagtgagcaatgcagcggatgcacaaaaagcagctgataacaaaaaaccggtcaactcctggacctgtgaagatttcctggctgtggacgaatccttccagccaactgcagtcggttttgctgaagcactgaacaacaaagataaaccagaagatgcggttttagatgttcagggtattgcaaccgtaaccccagctatcgttcaggcttgtactcaggataaaaaagccagctttaaagataaagttaaaggcgaatgggacaaaattaagaaagatatgtaa

SEQ ID NO: 8188 - protein, 110 aa, Escherichia coli
MKKVLGVILGGLLLLPVVSNAADAQKAADNKKPVNSWTCEDFLAVDESFQPTAVGFAEALNNKDKPEDAVLDVQGIATVTPAIVQACTQDKKASFKDKVKGEWDKIKKDM

SEQ ID NO: 8189 - DNA, 573 bp, Escherichia coli
atgttatatatagataaggcaacaattttgaagtttgatctggagatgcttaaaaaacatcgcagagcaatccagtttattgccgtgctgctgtttatcgtcgggttgctgtgtatcagttttccgttcgtctctggcgacattttaagcacagtagtgggtgcattattaatctgctcgggcattgcgcttattgtcgggctattcagcaaccgcagtcataatttctggccggtattatccggtttcctcgtcgcagtcgcctatttattgatcggctatttcttcatccgcgcaccagagctgggcatttttgccattgcggcatttattgccggtttgttctgtgtggcaggggttattcgcctgatgagttggtatcgtcagcgttcaatgaaaggcagttggctacagctcgttattggtgtgctggatatcgtcattgcctggatattccttggtgctacgccgatggtgtcggtaacgctggtttccacactggtgggaattgaactgatatttagcgccgccagtctgttcagcttcgccagtttgttcgttaaaaagcaataa

SEQ ID NO: 8190 - protein, 190 aa, Escherichia coli
MLYIDKATILKFDLEMLKKHRRAIQFIAVLLFIVGLLCISFPFVSGDILSTVVGALLICSGIALIVGLFSNRSHNFWPVLSGFLVAVAYLLIGYFFIRAPELGIFAIAAFIAGLFCVAGVIRLMSWYRQRSMKGSWLQLVIGVLDIVIAWIFLGATPMVSVTLVSTLVGIELIFSAASLFSFASLFVKKQ

SEQ ID NO: 8191 - DNA, 528 bp, Escherichia coli
atgatttttctcatgacgaaagattcttttcttttacagggcttttggcagttgaaagataatcacgaaatgataaaaatcaattccctgtcagagatcaaaaaagtaggcaataaacccttcaaggtgatcattgacacctatcacaaccatatccttgatgaagaagcgattaaattcctggagaaattagatgccgagagaattattgttttggcaccttatcacatcagtaaactaaaagctaaagcgcctatttattttgtcagccgtaaagaaagtatcaaaaatcttcttgagattacttatggtaaacacttgccccataagaattcacaactatgtttttcacataatcagttcaaaattatgcaactgattctgaaaaacaaaaatgaaagcaatatcacgtcaacgctcaacatttcgcaacaaacattaaagattcagaaattcaacattatgtacaagctgaaattaagacgtatgagcgacatcgtcaccctgggtatcacatcttatttttag

SEQ ID NO: 8192 - protein, 175 aa, Escherichia coli
MIFLMTKDSFLLQGFWQLKDNHEMIKINSLSEIKKVGNKPFKVIIDTYHNHILDEEAIKFLEKLDAERIIVLAPYHISKLKAKAPIYFVSRKESIKNLLEITYGKHLPHKNSQLCFSHNQFKIMQLILKNKNESNITSTLNISQQTLKIQKFNIMYKLKLRRMSDIVTLGITSYF

SEQ ID NO: 8193 - DNA, 1158 bp, Escherichia coli
atgaacagaagaagaaaactgttaataccgttgttattctgcggcgcgatgctcaccgcctgcgatgacaaatcggcggaaaacgccgccgccatgacgcctgaggtcggtgtcgtcacactctcccccggttcggtcaatgtgttgagcgaattgcccggtagaaccgttccttatgaagttgccgagatacgtccccaggtgggcggtattatcattaaacgcaactttatcgaaggcgataaagtgaaccagggcgattcgctgtatcagattgatcctgcgcctttacaggcagagctgaactccgccaaaggctcgctggcgaaagcgctctctaccgccagcaatgcccgcatcacctttaaccgccaggcatcgttgctgaagaccaactatgttagccgtcaggattatgacaccgcgcgcacccagttgaatgaagcagaagccaatgtcaccgtcgccaaagcggctgttgaacaggcgacgatcaatctgcaatacgcgaatgtcacctcgccgattacgggcgtcagcgggaaatcgtcggtgaccgtcggcgcactcgttaccgctaatcaggcagattcgctggttaccgtacaacgtctggacccgatttatgtcgatctcacgcagtcggtgcaggatttcttgcgcatgaaagaagaggtcgccagtgggcaaatcaaacaggttcagggcagtacgccagtacagctcaatctggaaaatggtaaacgttacggccagaccggcacgctgaaattctccgacccgacggtggatgaaaccacgggctccgtgacgttacgggcgattttccccaacccaaatggtgacttgctgcctggcatgtatgtcacggcattagtggatgaaggtagccgccagaatgtattactggtgccgcaggaaggcgtcacccacaacgcccagggtaaagcaacggcactcattctggataaagacgatgtcgtgcagctacgcgaaatcgaagccagcaaagccatcggcgaccagtgggttgtcacctctggcttgcaggctggcgatcgggtgatcgtttccggtttgcaacgcattcgtccgggtatcaaagcacgtgcaatttcctccagccaggaaaacgccagcaccgaatcgaaacaataa

SEQ ID NO: 8194 - protein, 385 aa, Escherichia coli
MNRRRKLLIPLLFCGAMLTACDDKSAENAAAMTPEVGVVTLSPGSVNVLSELPGRTVPYEVAEIRPQVGGIIIKRNFIEGDKVNQGDSLYQIDPAPLQAELNSAKGSLAKALSTASNARITFNRQASLLKTNYVSRQDYDTARTQLNEAEANVTVAKAAVEQATINLQYANVTSPITGVSGKSSVTVGALVTANQADSLVTVQRLDPIYVDLTQSVQDFLRMKEEVASGQIKQVQGSTPVQLNLENGKRYGQTGTLKFSDPTVDETTGSVTLRAIFPNPNGDLLPGMYVTALVDEGSRQNVLLVPQEGVTHNAQGKATALILDKDDVVQLREIEASKAIGDQWVVTSGLQAGDRVIVSGLQRIRPGIKARAISSSQENASTESKQ

SEQ ID NO: 8195 - DNA, 3114 bp, Escherichia coli
atggctaactattttattgatcgcccggtttttgcctgggtacttgccattattatgatgcttgcaggcggtctggcgatcatgaacttaccggttgcgcagtatccgcagattgcgccaccgaccattaccatcagcgctacctatccgggtgccgatgcgcaaacggtagaagactcggtcactcaggtgattgagcaaaatatgaatgggcttgatggcctgatgtacatgtcttcaaccagcgatgcggcaggtaatgcctccatcactctgaccttcgagacggggacatcacctgatatcgcacaggttcaggtgcaaaataaactgcaactcgctatgccttcattacctgaagcggtgcagcagcagggaattagcgtcgataagtcgagcagtaatatcctgatggtagcggcatttatttctgataacggcagcctcaaccagtacgatatcgcggactatgtagcgtctaatatcaaagacccgctaagccgtaccgcgggcgttggtagcgtacagctctttggttccgagtacgccatgcgtatctggctggacccgcaaaaactcaataaatataacctggtaccttccgatgttatttcccagattaaggtgcaaaacaaccagatttccggtggtcaactgggtggcatgccacaggcggcagaccagcaactgaacgcctcgatcattgtgcagacgcgtctgcaaacgccggaagaatttggcaaaatcctgttgaaagttcagcaagatggttcgcaagtgctgctgcgtgatgtcgcccgcgtcgaacttggggcggaagattattccaccgtggcgcgctataacggcaaacctgctgccgggatcgccatcaaactggctaccggagcaaacgccctggatacctcgcgagcggtgaaagaggagctgaaccgtttatcggcttatttccctgcaagcctgaagacggtttatccttacgacaccacaccgtttatcaaaatttctattcaggaagttttcaaaacgctggttgaggctatcatcctcgtcttcctggtcatgtatctgtttttgcagaatttccgcgccacaatcatcccgacgattgccgtaccggtggttattctcgggacgtttgcgatcttgtcggcggtcggtttcaccatcaacacgttaactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcgggattgccgttgttctttccgcagtgtttatgccgatggcctttatgagcggtgcgaccggggagatctaccgccagttctccatcacgctgatctcctccatgctgctttcagtatttgtagcaatgagcctgacccctgccctgtgcgccaccattctgaaagccgcgccggagggcggtcacaaacctaacgccctgttcgcacgcttcaacacgctgtttgaaaaatcaactcagcactataccgacagcacccgctcgctgttgcgttgtaccggtcgctacatggtggtctacctgctgatttgcgccgggatggcggtgctgttcctgcgtacgccgacctctttcttaccagaagaggatcagggggtatttatgaccaccgcgcagttaccttccggtgcaaccatggttaacaccacgaaagtgctacaacaggtgacggattattatctgacaaaagagaaaaataatgttcagtcggtgtttaccgttggtggctttggcttcagtggtcaggggcaaaacaacggtctggcgtttatcagcctcaagccgtggtctgaacgtgtcggcgaggaaaactcggttaccgcgattattcagcgggcaatgattgcgctaagcagtatcaataaagccgtcgtcttcccgttcaacttacccgcggtggctgaactgggtaccgcgtcaggttttgatatggaactgctggacaacggcaatctggggcacgaaaagctgacccaggcgcgaaacgagctgttatcactggcagcgcaatcaccgaatcaggtcatcggggtacgcccgaacggcctggaagatacgccgatgttcaaagtgaacgtcaacgccgcgaaagccgaggctatgggtgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctattcgtctaccgaatggacctatggttcaccgcgactggaacgctacaacggcatcccgtcaatggagattttaggtgaagcggctgccgggaaaagtaccggtgacgccatgaaatttatggcagacctggtcgcaaaacttccggcaggcgtcggctactcatggaccggactgtcgtatcaggaagcgttatcctcaaaccaggctcccgcgctatatgccatttcactggtcgtggtgttcctcgccctcgccgcactttatgaaagctggtcaattccgttctcggtgatgttggttgttccgttaggcgtcgttggcgcattactggccaccgatctgcgcggcttaagtaatgacgtttacttccaggttggtttgctgaccaccatcgggctttccgccaagaacgccatcctgattgtcgaatttgccgttgagatgatgcagaaagaagggaaaacgccggtagaggcaatcatcgaagcagcgcgtatgcgtttacgcccaatcctgatgacttctctggcctttattctcggcgtgctgccgctggttatcagtcatggtgccggctctggcgcgcaaaacgcggtaggtaccggcgtaatgggcgggatgtttgccgcaacagtgctggcaatttacttcgttccggtctttttcgttgtagtggaacatctctttgcccgctttaaaaaagcgtaa

SEQ ID NO: 8196 - protein, 1037 aa, Escherichia coli
MANYFIDRPVFAWVLAIIMMLAGGLAIMNLPVAQYPQIAPPTITISATYPGADAQTVEDSVTQVIEQNMNGLDGLMYMSSTSDAAGNASITLTFETGTSPDIAQVQVQNKLQLAMPSLPEAVQQQGISVDKSSSNILMVAAFISDNGSLNQYDIADYVASNIKDPLSRTAGVGSVQLFGSEYAMRIWLDPQKLNKYNLVPSDVISQIKVQNNQISGGQLGGMPQAADQQLNASIIVQTRLQTPEEFGKILLKVQQDGSQVLLRDVARVELGAEDYSTVARYNGKPAAGIAIKLATGANALDTSRAVKEELNRLSAYFPASLKTVYPYDTTPFIKISIQEVFKTLVEAIILVFLVMYLFLQNFRATIIPTIAVPVVILGTFAILSAVGFTINTLTMFGMVLAIGLLVDDAIVVVENVERVIAEDKLPPKEATHKSMGQIQRALVGIAVVLSAVFMPMAFMSGATGEIYRQFSITLISSMLLSVFVAMSLTPALCATILKAAPEGGHKPNALFARFNTLFEKSTQHYTDSTRSLLRCTGRYMVVYLLICAGMAVLFLRTPTSFLPEEDQGVFMTTAQLPSGATMVNTTKVLQQVTDYYLTKEKNNVQSVFTVGGFGFSGQGQNNGLAFISLKPWSERVGEENSVTAIIQRAMIALSSINKAVVFPFNLPAVAELGTASGFDMELLDNGNLGHEKLTQARNELLSLAAQSPNQVIGVRPNGLEDTPMFKVNVNAAKAEAMGVALSDINQTISTAFGSSYVNDFLNQGRVKKVYVQAGTPFRMLPDNINQWYVRNASGTMAPLSAYSSTEWTYGSPRLERYNGIPSMEILGEAAAGKSTGDAMKFMADLVAKLPAGVGYSWTGLSYQEALSSNQAPALYAISLVVVFLALAALYESWSIPFSVMLVVPLGVVGALLATDLRGLSNDVYFQVGLLTTIGLSAKNAILIVEFAVEMMQKEGKTPVEAIIEAARMRLRPILMTSLAFILGVLPLVISHGAGSGAQNAVGTGVMGGMFAATVLAIYFVPVFFVVVEHLFARFKKA

SEQ ID NO: 8197 - DNA, 729 bp, Escherichia coli
atggctcatgtctgctcggtgatcctcgttcgtcgttcattcgatattcatcatgaacagcaaaaaatatcgttgcataacgagagtatcctgctgctggataaaaatttggcagacgattttgcgttttgttcacttgatacgcgacggctggatatcgaagagctgacagtttgccattacttacaaaatattcgtcagttgccacgcaatttaggattgcatagcaaagaccgtttgttaattaaccagtcaccccccatacagctggtgacggcgatttttgatagtttcaatgacccccgggtcaattcgccgatactgagcaaaatgctctatctttcctgtttatcaatgttttctcataagaaagaactgatccccttacttttcaatagtatcagtactgtttcaggaaaagttgaacgccttattagctttgatatcgctaaacgttggtatctacgcgatatcgcagaaagaatgtacaccagcgagagtctcatcaaaaaaaagttgcaggatgaaaatacctgtttcagtaaaatattactcgcctccaggatgtcgatggccagacgattactcgagttacgtcaaatacctctgcatactattgcggaaaaatgtggctatagcagtacgtcatactttataaatacatttagacaatattatggtgtaacgccacatcagttttcgcaacattcgccgggtaccttttcctga

SEQ ID NO: 8198 - protein, 242 aa, Escherichia coli
MAHVCSVILVRRSFDIHHEQQKISLHNESILLLDKNLADDFAFCSLDTRRLDIEELTVCHYLQNIRQLPRNLGLHSKDRLLINQSPPIQLVTAIFDSFNDPRVNSPILSKMLYLSCLSMFSHKKELIPLLFNSISTVSGKVERLISFDIAKRWYLRDIAERMYTSESLIKKKLQDENTCFSKILLASRMSMARRLLELRQIPLHTIAEKCGYSSTSYFINTFRQYYGVTPHQFSQHSPGTFS

SEQ ID NO: 8199 - DNA, 825 bp, Escherichia coli
atgcaaccactacatggtaattgtctaattgcgtacgcaagacataaatatattctcaccatggttaatggtgaatatcgctattttaatggcggtgatctggtttttgcggatgcaagccaaattcaagtggataagtgtgttgagaatttcgtattagtttcaagagacacgctttcattatttctcccgatgctcaaggaggaggcattaaaacttcatgtacataaaaaagttccttcattactcgttcatcactgtaccagagatattcctgtttttcaggaagttgcgcaactatcgcagaataagaatcttcgctatgcagaaatgctacgtaaaagggcattaatctttgcgttgttatctgtttttcttgaggatacgcagtttataccgttacttctgaacgtgttgcaaccgaatatgcgaacacgagtttgtacggtcatcaataataatatcgcccatgagtggacattagcccgaattgctagcgaattgttgatgagtccaagcctgttaaagaaaaaattgcgcgaagaaggtacgtcatattcacagttgcttactgagtgtaggatgcagcgtgctttacaacttattgttatatatggggtttcaattaagcgagttgcagtatcctgtggatatcacagcgtgtcgtatttcatttacgtttttcgaaattattatgggatgacgcccacagagtatcaggagcgatcggcgcaggaattaccgaactgtggctcggcggcaagtatggctgcgcaagggattttttacggcactgaccgttctgcggaaggaataagattatag

SEQ ID NO: 8200 - protein, 274 aa, Escherichia coli
MQPLHGNCLIAYARHKYILTMVNGEYRYFNGGDLVFADASQIQVDKCVENFVLVSRDTLSLFLPMLKEEALKLHVHKKVPSLLVHHCTRDIPVFQEVAQLSQNKNLRYAEMLRKRALIFALLSVFLEDTQFIPLLLNVLQPNMRTRVCTVINNNIAHEWTLARIASELLMSPSLLKKKLREEGTSYSQLLTECRMQRALQLIVIYGVSIKRVAVSCGYHSVSYFIYVFRNYYGMTPTEYQERSAQELPNCGSAASMAAQGIFYGTDRSAEGIRL

SEQ ID NO: 8201 - DNA, 1401 bp, Escherichia coli
atggaccagaagctgttaacggatttccgctcagaactactcgattcacgttttggcgcaaaggccatttctactatcgcagaatcaaaacgatttccgctgcacgaaatgcgcgatgatgttgcatttcagattatcaatgatgaattatatcttgatggcaacgctcgtcagaacctggccactttctgccagacctgggacgacgaaaacgtccataaattgatggatttgtcgatcaataaaaactggatcgacaaagaagaatatccgcaatccgctgcaatcgacctgcgttgcgtaaacatggttgccgatctgtggcatgcgcctgcaccgaaaaatggtcaggccgttggcaccaacaccattggttcttccgaggcctgtatgctcggcgggatggcgatgaaatggcgttggcgcaagcgtatggaagctgcaggtaagccgactaacaaaccgaacctggtgtgcggtccggtacaaatctgctggcataaattcgcccgctactgggatgtggagttgcgtgagatccctatgcgccccggtcagttgtttatggacccgaaacgcatgattgaagcctgcgacgaaaacaccatcggcgtggtgccgactttcggcgtgacctacaccggtaactatgagttcccgcagccgctgcacgatgcgctggataaattccaggccgacaccggtatcgacatcgacatgcacatcgacgccgccagcggtggcttcctggcaccgttcgtcgccccggatatcgtctgggacttccgcctgccgcgtgtgaaatcgatcagtgcttcaggccataaattcggtctggctccgctgggctgcggctgggttatctggcgtgatgaagaagcgctgccgcaggaactggtgttcaacgttgactacctcggcggtcagattggtactttcgccatcaacttctcccgcccggcgggtcaggtgattgcacagtactatgaattcctgcgcctcggtcgtgaaggctataccaaagtacagaacgcttcctaccaggttgctgcttatctggcggatgaaatcgccaaactggggccgtatgagttcatctgtacgggtcgcccggacgaaggcatcccggcggtttgcttcaaactgaaagatggtgaagatccgggatacactctgtatgacctctctgaacgtctgcgtctgcgcggctggcaggttccggccttcactctcggcggtgaagccaccgacatcgtggtgatgcgcattatgtgtcgtcgcggcttcgaaatggactttgctgaactgttgctggaagactacaaagcctccctgaaatatctcagcgaccacccgaaactgcagggtattgcccagcagaacagctttaaacacacctga

SEQ ID NO: 8202 - protein, 466 aa, Escherichia coli
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 8203 - DNA, 1398 bp, Escherichia coli
atgaaaatggtctcacgtattaccgcgatcggcctggctggcgtcgcgatttgctatttagggttatctggttatgtgtggtaccacgataataaacgcagtaaacaggccgatgttcaggcatctgctgtcagtgaaaataataaggttttaggctttctccgcgaaaaaggatgcgattattgccatacgccttcggcagaattacctgcctattattatattcccggcgcgaaacagttgatggattacgacataaagcttggatataaatcttttaacctcgaggccgtgcgtgcggctctgctggctaataaacccgtttcgcaaagcgatctgaataagattgaatgggtgatgcagtatgaaactatgccgccaacgcgttataccgcgcttcactgggcgggtaaggtgagtgatgaagagcgggcggaaatactggcctggattgcaaaacagcgcgcggaatattacgccagcaatgatactgctccggagcatcgcaatgaaccggtgcagcccatcccgcaaaaactgcctaccgatgcgcaaaaagtggcgttgggttttgcgctgtatcacgatccccgtttatcggctgatagcaccatttcatgcgctcattgccatgcgttgaatgcggggggcgtcgatagcagaaaaacatcgattggtgttggtggcgcagttgggccgattaacgcgccgacggtatttaactcagtatttaacgttgagcagttctgggatggtcgtgcggcaacattgcaggatcaggctggtggaccgccgttgaacccgattgaaatggcgtcgaaatcctgggacgaaattattgctaagctggaaaaagatccgcagcttaaagcgcagttcctcgaagtctatccgcaaggtttcagtggcgaaaatattactgatgccattgctgaatttgagaaaacattaattacgccggattccccatttgataaatggttgcgtggagatgagaatgctctgacggcgcaacagaaaaaaggctatcaattatttaaagataataaatgtgcaacttgtcatggtggtattattctcggcggacgttcctttgaaccgttggggctgaaaaaagactttaactttggtgaaattacggcggcggatattggtcgtatgaatgttactaaagaagagcgtgataaattgcgtcagaaagtacccggtttacgtaacgttgctttaacggcaccgtacttccatcgcggtgacgtgccgacgctggacggggcggtgaaactgatgctgcgctatcaggtaggcaaagagctgccgcaggaggatgtggatgatatcgtcgctttcctgcacagtctgaacggggtttacacgccgtatatgcaggataaacaataa

SEQ ID NO: 8204 - protein, 465 aa, Escherichia coli
MKMVSRITAIGLAGVAICYLGLSGYVWYHDNKRSKQADVQASAVSENNKVLGFLREKGCDYCHTPSAELPAYYYIPGAKQLMDYDIKLGYKSFNLEAVRAALLANKPVSQSDLNKIEWVMQYETMPPTRYTALHWAGKVSDEERAEILAWIAKQRAEYYASNDTAPEHRNEPVQPIPQKLPTDAQKVALGFALYHDPRLSADSTISCAHCHALNAGGVDSRKTSIGVGGAVGPINAPTVFNSVFNVEQFWDGRAATLQDQAGGPPLNPIEMASKSWDEIIAKLEKDPQLKAQFLEVYPQGFSGENITDAIAEFEKTLITPDSPFDKWLRGDENALTAQQKKGYQLFKDNKCATCHGGIILGGRSFEPLGLKKDFNFGEITAADIGRMNVTKEERDKLRQKVPGLRNVALTAPYFHRGDVPTLDGAVKLMLRYQVGKELPQEDVDDIVAFLHSLNGVYTPYMQDKQ

SEQ ID NO: 8205 - DNA, 1650 bp, Escherichia coli
atgctcaatcagaaaattcaaaaccctaatccagacgaactgatgatcgaggtcgatctctgctatgagctggacccgtatgaattaaaactggatgagatgatcgaggcagaaccggaacccgagatgattgaagggctgcccgcctctgatgcgctgacgcctgccgatcgctatctcgaactgttcgagcatgttcagtcggcgaaaattttccccgacagtaaaacctttcccgactgcgcacccaaaatggacccgctggatattttaatccgctaccgtaaagtgcgccgtcatcgtgattttgacttgcgcaagtttgttgaaaaccacttctggctgccggaggtctactccagcgagtatgtatcggacccgcaaaattccctgaaagagcatatcgaccagctgtggccggtgctaacccgtgaaccacaggatcacattccgtggtcttctctgctggcgctgccgcagtcatatattgtcccgggcggccgttttagcgaaacctactattgggattcctatttcaccatgctggggctggcggaaagtggtcgggaagatttgctgaaatgcatggctgataacttcgcctggatgatcgaaaactacggccacatccccaacggcaaccgcacctattatttgagccgctcgcaaccaccggtttttgcgctgatggtggagttgtttgaagaagatggtgtacgcggcgcgcgccgctatctcgaccacctgaaaatggaatatgccttctggatggacggtgcagaatcgttgatccctaatcaggcctatcgccatgttgtgcggatgccggacggctcgctgctcaaccgttactgggacgatcgcgacacaccgcgtgacgaatcctggcttgaggacgttgaaaccgcgaaacattctggtcgcccgcccaacgaggtgtaccgcgatttacgcgcgggggcggcctccggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcactgttccgccagaaggccagtgcccgtcgcgatgcggtaaaccgttacctctgggatgatgaaaacggtatctaccgcgattacgactggcgacgcgagcaactggcgctgttttccgctgccgccattgtgccgctctatgtcggtatggcgaaccatgaacaggccgatcgtctggcaaacgccgtgcgcagccggttactgacacctggcgggattctggcaagcgagtacgaaaccggtgaacagtgggataaacccaacggctgggcaccgttacagtggatggcaattcagggatttaaaatgtacggcgatgaccttctgggtgatgaaatcgcgcgcaactggctgaagacggtgaatcagttctatctggaacagcacaaactgatcgagaaataccatattgccgatggtgttcctcgcgaaggcggcggtggcgagtatccgttgcaggatgggtttggctggactaacggtgtggtacgccgtttaattggtttgtacggcgaaccataa

SEQ ID NO: 8206 - protein, 549 aa, Escherichia coli
MLNQKIQNPNPDELMIEVDLCYELDPYELKLDEMIEAEPEPEMIEGLPASDALTPADRYLELFEHVQSAKIFPDSKTFPDCAPKMDPLDILIRYRKVRRHRDFDLRKFVENHFWLPEVYSSEYVSDPQNSLKEHIDQLWPVLTREPQDHIPWSSLLALPQSYIVPGGRFSETYYWDSYFTMLGLAESGREDLLKCMADNFAWMIENYGHIPNGNRTYYLSRSQPPVFALMVELFEEDGVRGARRYLDHLKMEYAFWMDGAESLIPNQAYRHVVRMPDGSLLNRYWDDRDTPRDESWLEDVETAKHSGRPPNEVYRDLRAGAASGWDYSSRWLRDTGRLASIRTTQFIPIDLNAFLFKLESAIANISALKGEKETEALFRQKASARRDAVNRYLWDDENGIYRDYDWRREQLALFSAAAIVPLYVGMANHEQADRLANAVRSRLLTPGGILASEYETGEQWDKPNGWAPLQWMAIQGFKMYGDDLLGDEIARNWLKTVNQFYLEQHKLIEKYHIADGVPREGGGGEYPLQDGFGWTNGVVRRLIGLYGEP

SEQ ID NO: 8207 - DNA, 603 bp, Escherichia coli
atgcaaatagtcatgtttgacaggcagtcaatatttattcatggaatgaaaatcagtttacagcatcgtattccaggagtgagtattcagggggccagtcaggcagacgagttatggcaaaagctggaaagttaccctgaagccttagtgatgctcgatggcgatcaggatggtgagttttgctactggttgctgcaaaaaaccgcggtgcaatttcctgaggttaaggtgttaattacggcgacggattgcaacaaacggtggttacaggaagttattcattttaatgtgctggccattgtgcctcgtgattcaaccgtcgagacatttgcgttggcggtaaatagtgcggcgatggggatgatgtttctgcctggagactggcgaacgacgccggaaaaggacattaaagatctcaaatcgttaagcgcccgccagcgggagattttaaccatgttagcggcgggcgaatcaaataaagagataggcagggcgctgaatatcagtaccggaacggtaaaagcgcatctggaatcactgtatcgccgtctggaagtcaaaaatcgcacccaggcggcaatgatgttaaatatctcctcctga

SEQ ID NO: 8208 - protein, 200 aa, Escherichia coli
MQIVMFDRQSIFIHGMKISLQHRIPGVSIQGASQADELWQKLESYPEALVMLDGDQDGEFCYWLLQKTAVQFPEVKVLITATDCNKRWLQEVIHFNVLAIVPRDSTVETFALAVNSAAMGMMFLPGDWRTTPEKDIKDLKSLSARQREILTMLAAGESNKEIGRALNISTGTVKAHLESLYRRLEVKNRTQAAMMLNISS

SEQ ID NO: 8209 - DNA, 972 bp, Escherichia coli
atgttagaaaaaacaataaacaatgcgatatgcgcgctactgtttcgttgtgaacaacaatcggtcaaagaaatggataaaattcacgcaatgcagttgttcatcaaagtcgcggagctggaaagtttttcccgcgcggcggatttctttgctttgccaaagggaagtgtttcgcgccagatacaggcactggaacatcaacttggcacccagcttctccagcgcaccacgcgacgggtcaaactcacgccagaaggcataacctattatcaacgggcaaaagatgtgttgagtaatctcagcgaactggacggtctgtttcaacaggatgccaccagtatcagcggtaaattacgcatcgacatcccgtcaggaatcgcgaaaagcctgttactgccgcgcttgtcggaatttctctatctgcatccgggaattgagctggaactgagtagccatgaccgtccggtagatattcttcatgatggttttgattgcgtgatacgcactggcgcattaccggaagatggcgttatcgcccgttctctcggcaaactgaccatggtcaactgtgccagtccacactatctgacgcgctttggttatccgcaaagccccgatgatctgacttcacacgcaatagtgcgttatacaccgcacctgggtgtacatccgttaggttttgaggttgccagcgttaatggcgtccagtggtttaagtctggcggcatgttgacggtaaacagtagcgaaaactatctcgccgccggtattgccggtctggggattattcagatcccgcgcattgccgtgcgcgaagccctgcgtgccgggcggcttattgaagtgttgcctggctaccgtgccgagccgctgtccctttcactggtttatccgcagcgtcgggagctttcccggcgtgtaaacctgtttatgcagtggctggctggcgtaatgaaagagcacctggactga

SEQ ID NO: 8210 - protein, 323 aa, Escherichia coli
MLEKTINNAICALLFRCEQQSVKEMDKIHAMQLFIKVAELESFSRAADFFALPKGSVSRQIQALEHQLGTQLLQRTTRRVKLTPEGITYYQRAKDVLSNLSELDGLFQQDATSISGKLRIDIPSGIAKSLLLPRLSEFLYLHPGIELELSSHDRPVDILHDGFDCVIRTGALPEDGVIARSLGKLTMVNCASPHYLTRFGYPQSPDDLTSHAIVRYTPHLGVHPLGFEVASVNGVQWFKSGGMLTVNSSENYLAAGIAGLGIIQIPRIAVREALRAGRLIEVLPGYRAEPLSLSLVYPQRRELSRRVNLFMQWLAGVMKEHLD

SEQ ID NO: 8211 - DNA, 1014 bp, Escherichia coli
atgacgcaggaaaacgagatcaaacgtcccacccaggatctggagcacgagccgattaagcagttggataatagcgagaaaggcggcaaagttagccaggcgctggaaaccgtcaccaccactgccgagaaagtccaacgccaaccggttattgcgcacctgattcgcgcgacagaacgctttaacgatcggctgggtaaccagtttggggcggctatcacctatttctcatttttgtcgatgatccccattttgatggtgtcgtttgccgcagggggctttgtgctggcctcccatccgatgttgctacaggatatcttcgacaaaattctgcaaaacattagcgatccgacgctagccgccacgttgaaaaacaccatcaacaccgccgttcagcagcgtacgactgtagggcttgtcggtctggcagtggcgctttattccggcatcaactggatgggtaacctgcgtgaagcgattcgcgcccagtcacgcgatgtctgggaacgctcgccgcaagatcaggagaagttctgggtaaaatatctgcgtgattttatttcgctgattggtttgttgattgcgctgattgtgacgctttctatcacctcggttgccggttctgcgcagcaaatgattattagcgccctgcacctgaacagcattgagtggctgaaaccgacatggcggttgattggcctggcgatttccatcttcgccaactatctgcttttcttctggatcttctggcggttgccgcgccaccgtccgcgcaaaaaagccctgatccgcggaacatttctggctgctattggttttgaagtgattaaaatcgtgatgacctacaccctgccatcgttgatgaaatcaccctctggcgcagcatttggttccgtgctggggctgatggcatttttctacttcttcgcccgtttgacgctgttttgcgcggcgtggattgccaccgccgaatataaagacgacccgcgaatgccggggaaaacgcagccttaa

SEQ ID NO: 8212 - protein, 337 aa, Escherichia coli
MTQENEIKRPTQDLEHEPIKQLDNSEKGGKVSQALETVTTTAEKVQRQPVIAHLIRATERFNDRLGNQFGAAITYFSFLSMIPILMVSFAAGGFVLASHPMLLQDIFDKILQNISDPTLAATLKNTINTAVQQRTTVGLVGLAVALYSGINWMGNLREAIRAQSRDVWERSPQDQEKFWVKYLRDFISLIGLLIALIVTLSITSVAGSAQQMIISALHLNSIEWLKPTWRLIGLAISIFANYLLFFWIFWRLPRHRPRKKALIRGTFLAAIGFEVIKIVMTYTLPSLMKSPSGAAFGSVLGLMAFFYFFARLTLFCAAWIATAEYKDDPRMPGKTQP

SEQ ID NO: 8213 - DNA, 1323 bp, Escherichia coli
atgcaagcaacagccacaacactcgaccacgagcaagaatacacgccgatcaactcgcgtaataaagtccttgtcgcctctctcattggcacggccattgagttcttcgacttttacatttacgccactgcggccgttattgtgtttccgcatatcttcttcccgcagggcgatccaacggcagcaacgctacagtcgctcgccaccttcgccatcgccttcgtcgcgcgccccattggctctgccgtttttggtcattttggcgatcgcgttgggcgtaaagcgacgctggtcgcctcgttgctaacgatggggatttcgaccgtggtgattggtctgctgccaggctatgccacgattggtattttcgccccgctgctgctggcgctggctcgatttggtcagggtctgggcttaggtggtgaatggggcggcgcggcgctgctggcgactgaaaacgccccaccgcgcaaacgtgcattgtacggctccttcccgcagctgggcgcaccgattggcttcttctttgccaacggcactttcttgctgctttcctggctactgaccgacgagcagtttatgagctggggctggcgtgtgccatttatcttctcggcggtgctggtcattatcggcctgtatgttcgcgtgtcgctgcatgagtcgccggtgtttgagaaagtcgctaaagcgaaaaaacaggtgaagatcccgctgggtacgctgctgaccaaacatgttcgcgtaaccgtactgggtacgttcattatgctggcaacctatacgctgttttacatcatgacggtctactctatgacctttagtaccgccgccgcgccagttgggcttggtttaccgcgtaacgaagtactgtggatgttgatgatggcggttatcggttttgcagtgatggttccgttggcgggtctgctggcagatgcttttggtcgccgtaaaagtatggtggtgatcactacgcttatcattctgtttgccctgtttgcctttaacccactgttgggttctggtaatccagcattggtgtttgttttcctgctgctgggcttgagtttgatgggcctgacctttggtccgatgggggcgctgctgccggagctgtttccgacggaagtccgttataccggagcatcgttctcctataacgtatcgtcgattctcggggcgtctgttgcgccgtatatcgcggcctggttgcagactaactatgggttaggcgcggtggggttatatctggcggcgatggccggactgacgttaattgccctgctgttaacgcatgagacgcggcaccagtcgttgtag

SEQ ID NO: 8214 - protein, 440 aa, Escherichia coli
MQATATTLDHEQEYTPINSRNKVLVASLIGTAIEFFDFYIYATAAVIVFPHIFFPQGDPTAATLQSLATFAIAFVARPIGSAVFGHFGDRVGRKATLVASLLTMGISTVVIGLLPGYATIGIFAPLLLALARFGQGLGLGGEWGGAALLATENAPPRKRALYGSFPQLGAPIGFFFANGTFLLLSWLLTDEQFMSWGWRVPFIFSAVLVIIGLYVRVSLHESPVFEKVAKAKKQVKIPLGTLLTKHVRVTVLGTFIMLATYTLFYIMTVYSMTFSTAAAPVGLGLPRNEVLWMLMMAVIGFAVMVPLAGLLADAFGRRKSMVVITTLIILFALFAFNPLLGSGNPALVFVFLLLGLSLMGLTFGPMGALLPELFPTEVRYTGASFSYNVSSILGASVAPYIAAWLQTNYGLGAVGLYLAAMAGLTLIALLLTHETRHQSL

SEQ ID NO: 8215 - DNA, 2061 bp, Escherichia coli
atgagcaaggcaggcaaaataaccgctgcgatttcaggggctttcttgttgttgattgtcgtggcgatcattttgattgcaacttttgactggaatcgactcaaaccgaccatcaaccagaaagtctctgcggagttgaatcgtccgttcgctatccgtggcgatctgggcgtggtgtgggagcggcaaaaacaagaaactggctggcgcagctgggtgccgtggccccatgtacacgcggaagacatcattcttggcaatccaccggatattcccgaagtcacaatggtgcatttgccgcgagtagaagcgacgctggccccgctggcgctgctgaccaaaacggtctggttgccgtggatcaagctcgaaaagcccgacgcgcgcctgattcgcctctccgaaaagaacaataactggacgtttaatctcgccaacgatgacaacaaagacgcgaatgcaaagccgtcggcgtggtcgtttcagctggataatattcttttcgatcaagggcggatcgccattgatgacaaagtaagcaaagcggatctggaaatttttgtcgatccgttaggcaagccgctgccgttcagcgaagttaccggatcgaaaggtaaagcggataaagaaaaggtgggcgattacgtttttggcctgaaggcgcagggacgttataacggtgaaccgctcactggtacgggaaaaataggcggtatgctggcgctgcgtggcgaaggaacgccgtttccggtacaggctgatttccgctctggtaacacccgtgttgcttttgatggcgttgtgaatgacccaatgaagatggggggtgtcgatttacggcttaaattttctggcgattcgctgggtgatctctatgaactgacgggcgttctgctgcccgatacaccgccgtttgaaacggatggtcggctggtagcgaaaatcgacactgaaaaatcgtcggtctttgattatcgcggttttaatgggcgcattggcgatagcgatatccacggttctctgatctataccaccggcaagccacgaccaaaactggaaggtgatgtcgagtcgcggcaattgcggctggcggacctgggaccgttgattggcgttgattccgggaaaggggcagaaaagtcgaaacggtctgaacagaagaagggcgaaaaaagcgttcagcctgcgggcaaagtgctgccttatgaccgcttcgaaaccgataaatgggacgttatggatgccgatgttcgcttcaaagggcggcgcattgagcatggcagcagcctgccgattagcgatctttctactcatatcatcctcaaaaatgctgacctgcgcctgcaaccgctgaaatttggcatagcgggcggcagcattgcggcgaatattcatctggaaggcgataaaaagccgatgcaggggcgggcagatattcaggctcgtcgactgaaactgaaagaactgatgccggatgtggaactgatgcagaagacgctgggggaaatgaacggtgacgcggaactacgcggtagcggtaactcggtggcggcgcttttaggcaacagtaatggcaacctgaaactgttgatgaatgacgggctggtgagccgcaacctgatggagattgtcgggctgaatgttggtaactacattgtcggtgcgatatttggtgacgatgaggtgcgggtgaactgcgcggcagcgaatctggatattgccaacggtgtggcgcgtccgcaggttttcgcttttgataccgagaatgcgttgatcaatgttaccggcacggcaagttttgcttcggaacagctggatttaactatcgatccagaaagtaaagggattcgcattatcacgctgcgttcgccgctgtatgtgcgtgggacgtttaaaaatccgcaggctggggtgaaagccgggccgttgattgcccgtggtgctgttgcggcggcactggcaacgctggttacgccagcggcagcattgctggcactgatctcaccttccgaaggggaggctaatcagtgccggacaattttgtcgcagatgaagaagtga

SEQ ID NO: 8216 - protein, 686 aa, Escherichia coli
MSKAGKITAAISGAFLLLIVVAIILIATFDWNRLKPTINQKVSAELNRPFAIRGDLGVVWERQKQETGWRSWVPWPHVHAEDIILGNPPDIPEVTMVHLPRVEATLAPLALLTKTVWLPWIKLEKPDARLIRLSEKNNNWTFNLANDDNKDANAKPSAWSFQLDNILFDQGRIAIDDKVSKADLEIFVDPLGKPLPFSEVTGSKGKADKEKVGDYVFGLKAQGRYNGEPLTGTGKIGGMLALRGEGTPFPVQADFRSGNTRVAFDGVVNDPMKMGGVDLRLKFSGDSLGDLYELTGVLLPDTPPFETDGRLVAKIDTEKSSVFDYRGFNGRIGDSDIHGSLIYTTGKPRPKLEGDVESRQLRLADLGPLIGVDSGKGAEKSKRSEQKKGEKSVQPAGKVLPYDRFETDKWDVMDADVRFKGRRIEHGSSLPISDLSTHIILKNADLRLQPLKFGIAGGSIAANIHLEGDKKPMQGRADIQARRLKLKELMPDVELMQKTLGEMNGDAELRGSGNSVAALLGNSNGNLKLLMNDGLVSRNLMEIVGLNVGNYIVGAIFGDDEVRVNCAAANLDIANGVARPQVFAFDTENALINVTGTASFASEQLDLTIDPESKGIRIITLRSPLYVRGTFKNPQAGVKAGPLIARGAVAAALATLVTPAAALLALISPSEGEANQCRTILSQMKK

SEQ ID NO: 8217 - DNA, 714 bp, Escherichia coli
ttgcaggaacggcgtttttggttgcagtgtgagcgtgcttacacctggcagccgatctatcaaacatgcgggcggttaatggccgtggagctattaacggtggtcacgcatcccttgaacccttcgcaacgcctgccgccggatcgctattttactgaaatcaccgttagccatcggatggaggttgtgaaagagcagattgatttgctggcgcaaaaagccgacttctttgtagagcacggcctgctggcatcggtcaatattgatggccctacgctcatcgccctgcgtcagcaaccaaaaatcctgcgccagattgaggatcttccctggctgcgtttcgaactggtggaacacatccgcctgccgaaagattcaacctttgcctcgatgtgtgaatttggcccgctgtggctggatgattttggtaccgggatggcaaatttctctgcactaagtgaagtgcgttatgactacatcaaaatcgcgcgagaactgtttgtgatgctgcgtcagtcgccggaaggacgcacactcttttctcagcttttacatctaatgaatcgctattgtcgcggggtgattgtcgagggcgtagaaacaccggaagagtggcgtgatgttcagaactcgcccgcattcgccgcacaaggctggtttctttcacgcccggcaccgatagaaacgctgaatacggcggttctggcgctataa

SEQ ID NO: 8218 - protein, 237 aa, Escherichia coli
MQERRFWLQCERAYTWQPIYQTCGRLMAVELLTVVTHPLNPSQRLPPDRYFTEITVSHRMEVVKEQIDLLAQKADFFVEHGLLASVNIDGPTLIALRQQPKILRQIEDLPWLRFELVEHIRLPKDSTFASMCEFGPLWLDDFGTGMANFSALSEVRYDYIKIARELFVMLRQSPEGRTLFSQLLHLMNRYCRGVIVEGVETPEEWRDVQNSPAFAAQGWFLSRPAPIETLNTAVLAL

SEQ ID NO: 8219 - DNA, 1278 bp, Escherichia coli
ttgatagatcggctgccaggtgtaagcacgctcacactgcaaccaaaaacgccgttcctgcaagctctcgatgcttgcttcagggttgcttattcgctggataacctgccttatcatcaaagatgtcctgtgtttaaaagtgatgctgcccggactcgacaaagattatcggcgcgcaagggcagaactttaccgcctggccggggtaaatttccccactccacaacggaatctttcaggaatacgttctggctcaaaaaaataatggaacactgttttaatatggttgaccagcaaaccaccacagcgcaaactaacgctaattttttacagatcaggttcacgactatgtccaaaaagattgccgtgattggcgaatgcatgattgagctttccgagaaaggcgcggacgttaagcgcggtttcggcggcgataccctgaacacttccgtctatatcgcccgtcaggtcgatcctgcggcattaaccgttcattacgtaacggcgctgggaacggacagttttagccagcagatgctggacgcctggcgcggcgagaacgttgatacttccctgacccaacggatggaaaaccgtctgccgggcctttactacattgaaaccgacagcaccggcgaacgtacgttctactactggcgtaacgaagccgccgccaaattctggctggagagtgagcaatccgcggcgatttgcgaagagctggcgaatttcgattatctctacctgagcgggattagcctggcgatcttaagcccgaccagccgcgaaaagctgctttccctgctgcgcgaatgccgcgccaacggcggaaaagtgattttcgacaataactatcgtccgcgcctgtgggccagcaaagaagagacacagcaggtgtaccaacaaatgctggaatgcacggatatcgccttcctgacgctggacgatgaagacgcgctgtggggtcaacagccggtggaagacgtcattgcgcgcacccataacgcgggcgtgaaagaagtggtggtgaaacgcggggcggattcttgcctggtgtccattgctggcgaagggttagtggatgttccggcggtaaaactgccgaaagaaaaagtgatcgataccaccgcagctggcgactctttcagtgccggttatctggcggtacgtttgacgggcggaattgcggaagacgcagcgaaacgcgggcacctgaccgcaagtaccgttattcagtatcgcggcgcgattatcccgcgtgaagcgatgccagcgtaa

SEQ ID NO: 8220 - protein, 425 aa, Escherichia coli
MIDRLPGVSTLTLQPKTPFLQALDACFRVAYSLDNLPYHQRCPVFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWRGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGIAEDAAKRGHLTASTVIQYRGAIIPREAMPA

SEQ ID NO: 8221 - DNA, 1497 bp, Escherichia coli
atgcagggcacaaaaattcgacttttagcgggcggtttgctgatgatggccactgctggctatgtgcaggcagatgcgctccagcctgatccagcatggcaacaggggacgctttccaacggtttacagtggcaagtgctgactacgccccaacgtcccagcgatcgtgttgaaattcgcctgctggttaataccggttcgctcgccgaaagtacacaacagagcggttacagtcacgccatccctcgtattgcgctaacgcaaagcggtggccttgacgcagcgcaggcgcgttcattgtggcagcaggggatcgaccctaaacgcccgatgccgccggtaattgtctcttatgacaccacgctgtttaatctgagtttgcccaataaccgtaacgacttgctgaaagaggcgctctcttatctggcaaatgccactggcaaactgactatcacgccagaaaccatcaaccatgcgttgcaaagtcaggacatggtggcaacctggcctgccgatactaaagagggctggtggcgttatcgtctgaaaggatcaaccttgttaggtcacgatcctgccgatccgctgaaacaacccgttgaagcggaaaagattaaagatttctatcagaaatggtacaccccggatgcaatgacgctgctggtggtgggaaacgtggatgcgcgctcggtcgtcgaccaaatcaataaaacgtttggcgaactgaaaggcaaacgtgaaacaccggctccggtgccgacgctttctccgctgcgtgcggaagcggtgagtattatgaccgacgcggtgcgtcaggaccggctatctatcatgtgggatacgccgtggcagccgattcgtgaatcagccgcactgctgcgctactggcgtgcggacctggcccgtgaggcgctgttctggcatgttcagcaagcgttaagcgccagtaacagtaaagacatcggtcttggatttgactgtcgtgtgctgtatctgcgtgcgcagtgtgccatcaacatcgaatcaccaaacgacaagctgaacagcaaccttaatctggtggcgcgtgaactggcgaaggttcgcgataaaggtctgccggaagaagagttcaatgcgttagtggcgcaaaagaaactggagctgcagaaactgtttgccgcctatgcgcgagctgataccgatattctgatggggcagcggatgcgttcgttgcaaaatcaggtcgtcgatatcgcgccggagcaatatcagaaactgcgtcaggatttccttaacagcctgacggtggagatgttaaatcaggatctgcgtcagcagttgtcgaatgatatggcgttaatactgctgcagccgaaaggcgagccggaatttaacatgaaagcgttgcaggcggcctgggatcaaatcatggccccatcgactgcggctgccgccacatctgtcgccacggatgacgtacatcctgaagtgacggatattccacctgtacagtaa

SEQ ID NO: 8222 - protein, 498 aa, Escherichia coli
MQGTKIRLLAGGLLMMATAGYVQADALQPDPAWQQGTLSNGLQWQVLTTPQRPSDRVEIRLLVNTGSLAESTQQSGYSHAIPRIALTQSGGLDAAQARSLWQQGIDPKRPMPPVIVSYDTTLFNLSLPNNRNDLLKEALSYLANATGKLTITPETINHALQSQDMVATWPADTKEGWWRYRLKGSTLLGHDPADPLKQPVEAEKIKDFYQKWYTPDAMTLLVVGNVDARSVVDQINKTFGELKGKRETPAPVPTLSPLRAEAVSIMTDAVRQDRLSIMWDTPWQPIRESAALLRYWRADLAREALFWHVQQALSASNSKDIGLGFDCRVLYLRAQCAINIESPNDKLNSNLNLVARELAKVRDKGLPEEEFNALVAQKKLELQKLFAAYARADTDILMGQRMRSLQNQVVDIAPEQYQKLRQDFLNSLTVEMLNQDLRQQLSNDMALILLQPKGEPEFNMKALQAAWDQIMAPSTAAAATSVATDDVHPEVTDIPPVQ

SEQ ID NO: 8223 - DNA, 1188 bp, Escherichia coli
atgaaaccgcttggcgacggcttcgttaagctcattaagatgatcatcgctcctgtcatcttttgtaccgtcgtaacgggcattgcgggcatggaaagcatgaaggcggtcggtcgtaccggcgcagtcgcactgctttactttgaaattgtcagtaccatcgcgctgattattggtcttatcatcgttaacgtcgtgcagcctggtgccggaatgaacgtcgatccggcaacgcttgatgcgaaagcggtagcggtttacgccgatcaggcgaaagaccagggcattgtcgccttcattatggatgtcatcccggcgagcgtcattggcgcatttgccagcggtaacattctgcaggtactgctgtttgccgtactgtttggttttgcgctccaccgtctgggcagcaaaggccaactgatttttaacgtgatcgaaagtttctcgcaggtcattttcggcatcatcaatatgatcatgcgtctggcacctattggtgcgttcggggcaatggcgtttaccatcggtaaatacggcgtcggcacactggtgcaactggggcagctgattatctgcttctacatcacctgtatcctgtttgtggtgctggtactgggttcaatcgctaaagcgactggtttcagtatcttcaaatttatccgttacatccgtgaagaactgctgattgtactggggacttcatcttccgagtcggcgctgccgcgtatgctcgacaagatggagaaactcggctgccgcaaatcggtggtggggctggtcatcccgacaggctactcgtttaatcttgatggcacatcgatatacctgacaatggcggcggtgtttatcgcccaggccactaacagtcagatggatatcgtccatcaaatcacgctgttaatcgtgttgctgctttcttctaaaggggcggcaggggtaacgggtagtggttttatcgtgctggcggcgacgctctctgcggtgggccatttgccggtagcgggtctggcgctgatcctcggtatcgaccgctttatgtcagaagctcgtgcgctgactaacctggtcggtaacggcgtagcgaccattgtcgttgctaagtgggtgaaagaactggaccacaaaaaactggacgatgtgctgaataatcgtgcgccggatggcaaaacgcacgaattatcctcttaa

SEQ ID NO: 8224 - protein, 395 aa, Escherichia coli
MKPLGDGFVKLIKMIIAPVIFCTVVTGIAGMESMKAVGRTGAVALLYFEIVSTIALIIGLIIVNVVQPGAGMNVDPATLDAKAVAVYADQAKDQGIVAFIMDVIPASVIGAFASGNILQVLLFAVLFGFALHRLGSKGQLIFNVIESFSQVIFGIINMIMRLAPIGAFGAMAFTIGKYGVGTLVQLGQLIICFYITCILFVVLVLGSIAKATGFSIFKFIRYIREELLIVLGTSSSESALPRMLDKMEKLGCRKSVVGLVIPTGYSFNLDGTSIYLTMAAVFIAQATNSQMDIVHQITLLIVLLLSSKGAAGVTGSGFIVLAATLSAVGHLPVAGLALILGIDRFMSEARALTNLVGNGVATIVVAKWVKELDHKKLDDVLNNRAPDGKTHELSS

SEQ ID NO: 8225 - DNA, 1950 bp, Escherichia coli
atggtggcagccgttgtcctggtgttcgtttttattttttgcaccgttttgctgttccatctggtccagcagaatcgctataacacggctacgcaactggaaagcattgctcgctctgtccgcgaacccttatcttctgccattttgaaaggcgatattcccgaagcggaagctattcttgccagcattaaaccggcaggcgtggtcagccgtgccgatgtagtgctgcctaaccagttccaggcgctgcgtaaaagttttattccagagcgtccggtgccggtaatggttactcgcctgtttgagctaccggtgcaaatctcgctgggcgtttactcgctggaacgtccggcaaacccgcagccaattgcctatctggtgttacaggcggattccttccgcatgtataagttcgtgatgagcaccctctcaacgttagtgaccatttacttacttttgtcgttaatattgacggtggcgattagctggtgcattaaccgcctgattttgcatccgttacgcaatattgctcgcgaacttaacgccatcccaccccaggagcttgttggtcaccaactggcattaccgcgtctgcatcaggacgatgaaatcggtatgttggtgcgcagttacaacctcaaccagcaattgctgcagcgccattatgaagaacagaacgaaaatgcgatgcgcttcccggtgtcggatttgccgaacaaagccttgctgatggagatgctggagcaggtggtggcgcgtaaacaaactaccgcgctgatgatcatcacctgtgaaaccctgcgtgatactgcgggtgtgctgaaagaggcgcaacgagaaattctgctgctgacgctggtggaaaaactcaaatcggtactgtcgccacgcatgatcctcgcgcagattagcggttatgactttgctgtcattgccaacggtgtacaggaaccgtggcacgctatcacattaggtcagcaagtgctcactatcatgagcgagcgcctgccgattgaacgtattcaactccgtccgcactgtagcattggcgtggcgatgttctacggcgatctcaccgccgaacagctttacagtcgcgctatttctgcggcatttaccgctcgccataaaggcaaaaatcagattcagttctttgatccgcagcagatggaagccgcccagcagcggttgacggaagagagcgatatccttaatgcactggaaaatcatcagtttgcgatttggttacagccacaggtcgagatgaccagcggtaaactggtcagtgcggaagtgttactgcgtatccagcaaccggatggcagttgggacctgcccgatggcttaatcgatcgcattgagtgctgtgggctgatggttaccgtcggtcactgggtgctggaagagtcctgtcgattgcttgctgcctggcaagagcgcggcattatgctgcccttgtcggtaaacctctcagcgctgcaactgatgcatccaaatatggtggcggatatgctggaattgttaacccgctatcgtattcagccgggaacactgattctggaagtgacagaaagccgacgtattgacgatcctcatgctgcggtggcaatcctccgtccgctgcgcaatgccggagttcgggtggcgctggatgatttcggcatgggctacgcagggctgcgtcagctgcagcatatgaaatcgttgccaatcgacgtactgaaaatcgacaaaatgtttgttgaaggtttgccggaagatagcagcatgattgctgcaattatcatgctggcgcagagcctgaacctacaaatgattgccgaaggcgtggagactgaagcacaacgcgactggctggcaaaagctggcgttggtattgcccagggcttcctttttgctcgcccactccctattgaaatcttcgaagagagttacctggaagaaaagtag

SEQ ID NO: 8226 - protein, 649 aa, Escherichia coli
MVAAVVLVFVFIFCTVLLFHLVQQNRYNTATQLESIARSVREPLSSAILKGDIPEAEAILASIKPAGVVSRADVVLPNQFQALRKSFIPERPVPVMVTRLFELPVQISLGVYSLERPANPQPIAYLVLQADSFRMYKFVMSTLSTLVTIYLLLSLILTVAISWCINRLILHPLRNIARELNAIPPQELVGHQLALPRLHQDDEIGMLVRSYNLNQQLLQRHYEEQNENAMRFPVSDLPNKALLMEMLEQVVARKQTTALMIITCETLRDTAGVLKEAQREILLLTLVEKLKSVLSPRMILAQISGYDFAVIANGVQEPWHAITLGQQVLTIMSERLPIERIQLRPHCSIGVAMFYGDLTAEQLYSRAISAAFTARHKGKNQIQFFDPQQMEAAQQRLTEESDILNALENHQFAIWLQPQVEMTSGKLVSAEVLLRIQQPDGSWDLPDGLIDRIECCGLMVTVGHWVLEESCRLLAAWQERGIMLPLSVNLSALQLMHPNMVADMLELLTRYRIQPGTLILEVTESRRIDDPHAAVAILRPLRNAGVRVALDDFGMGYAGLRQLQHMKSLPIDVLKIDKMFVEGLPEDSSMIAAIIMLAQSLNLQMIAEGVETEAQRDWLAKAGVGIAQGFLFARPLPIEIFEESYLEEK

SEQ ID NO: 8227 - DNA, 3474 bp, Escherichia coli
atgcgcaaattcacactaaacatattcacgctttccctcggtctggccgtcatgccgatggtcgaggcagcaccaaccgctcagcaacagttgctggagcaagttcggttaggcgaagcgacccatcgtgaagacctggtgcaacagtcgttgtatcggctggaacttattgatccgaataacccggatgtgattgctgcccgttttcgttctctgttacgtcagggcgatattgatggcgcacaaaaacagctcgatcggctgtcgcagttagcgccgagttcaaatgcgtataaatcgtcgcggaccacaatgttactgtctacgccggatggtcgtcaggcactgcaacaggctcgattgcaggcgactaccggtcatgcggaagaggccgtggcgagttacaacaagctgttcaacggtgcgccgccggaaggtgacattgctgtcgagtactggagtacggtggcgaaaattccggctcgccgtggtgaagcgattaatcagctaaaacgcattaatgcggatacgccgggcaatacgggcctgcaaaacaatctggcgctattactgtttagtagcgatcgccgtgacgaaggttttgccgtcctggaacagatggcgaaatcgaacgccgggcgcgaaggggcctctaaaatctggtacgggcagattaaagacatgcccgtcagcgatgccagcgttcaggcactgaaaaaatatctctcgatctttagcgatggcgatagcgtggctgctgcacaatcgcaactggcagaacagcaaaaacagctggccgaccctgctttccgcgctcgtgcgcaaggtttagcggcggtggactctggcatggcgggtaaagccattcccgaactacaacaggcggtgcgggcgaacccgaaagacagtgaggctctgggggcgctgggccaggcgtattcccagaaaggcgatcgcgccaatgcagtggtgaatctggaaaaagccctcgcgctggatccgcacaacagcaataacgacaaatggaacagcctgctgaaagtaaaccgctactggctggcgatccagcagggcgatgccgcgctgaaagccaataatcctgaccgggcagaacggctgttccagcaggcacgtaatgtcgataacaccgacagctatgcagtgcttgggctgggcgatgtggcgatggcgcgcaaagattatcccgccgccgaacgctattaccagcagaccttgcgtatggacagcggcaacactaacgccgtgcgcgggctggcgaatatttaccgccagcagtcgccagaaaaagccgaagcgtatatcgcctcgctctctgccagccagcggcgcagcattgatgatatcgaacgcagcctgcaaaacgaccgtctggcacagcaggcagaggcactggaaaaccaggggaaatgggcgcaggcggcagcacttcagcggcaacgactggcgctggaccccggcagtgtatggattacttaccgactttcgcaggatctctggcaagccggacaacgcagccaggccgatacgttaatgcgcaatctggcgcagcagaagccgaacgacccggagcaggtttacgcttacgggctgtacctctccggtcacgaccaggacagagcggcgctggcgcatatcaacagcctgccgcgcgggcagtggaacagcaatattcaggagctggttaatcgactgcaaaacgatcaggtgctggaaaccgctaatcgcctgcgagaaaacggtaaagaggcagaagcggaagcgatgctgcgccagcaaccgccttcctcgcgtattgacctcacgctggctgactgggcgcagcagcgacgtgattacaccgccgcccgcgctgcatatcagaatgtcctgacgcgggagccaactaacgccgatgccattcttggtctgacggaagtggatattgctgccggtgacaaagcggcggcacgtagccagctggcgaaactgcctgccattgataacgcctcgctgaacacacagcggcgcgtggcgctggcacaggcgcagcttggcgataccgcagcggcgcagcagacatttaataagttgatcccgcaggcaaaatctcagccaccgtcgatggaaagcgcgatggtactgcgtgatggtgcgaagtttgaagcgctggcgggcgatccaacgcaggcgctggaaacctacaaagacgctatggttgcatccggtgtgaccacgacgcgtccgcaggataacgacacctttacccggctgacccgtaacgacgagaaagatgactggctgaaacgcggcgtgcgcagcgatacggcggacctctatcgccagcaggatcttaacgtcactctcgagcacgattactggggttcgagcggtaccggtggttactccgatctgaaagcgcacaccactatgttgcaggtggacgcgccctattctgacgggcggatgttctttcgcagtgatttcgtcaatatgaacgtcggcagtttctccactaatgccgatggcaaatgggatgacaactggggcacctgtacattacaggactgtagcggcaaccgcagccagtcggattccggtgccagcgtggcggtcggctggcgaaatgacgtctggagctgggatatcggtaccacgccgatgggcttcaacgtggtggatgtggtcggcggcatcagttacagcgatgatatcgggccgctgggttacaccgttaacgcccaccgtcggcctatctccagttctttgctggcctttggtgggcaaaaagactctccgagcaataccgggaaaaaatggggcggcgtgcgtgccgacggcgtggggctaagtctgagctacgataaaggtgaagcaaacggcgtctgggcatcgcttagcggtgatcagttaaccggtaaaaatgtcgaagataactggcgcgtgcgctggatgacgggctattactataaggtcatcaaccagaacaatcgccgcgtcacaatcggcctgaacaacatgatctggcattatgacaaagacctgagtggctactcactcggtcagggcggttactacagtccgcaggaatacctgtcgtttgccataccggtgatgtggcgggagcgcacggaaaactggtcgtgggagctgggggcgtctggctcgtggtcgcattcacgcaccaaaaccatgccgcgttatccgctgatgaatctgatcccgaccgactggcaggaagaagctgcgcggcaatccaacgatggcggcagcagtcagggctttggctacacggcgcgggcattacttgaacgacgtgttacttccaactggtttgtcggcacggcaattgatatccagcaggcaaaagattacgcccccagccatttcctgctctacgtacgttattccgccgccggatggcagggtgacatggatttaccgccgcagccgctgataccttacgccgactggtaa

SEQ ID NO: 8228 - protein, 1157 aa, Escherichia coli
MRKFTLNIFTLSLGLAVMPMVEAAPTAQQQLLEQVRLGEATHREDLVQQSLYRLELIDPNNPDVIAARFRSLLRQGDIDGAQKQLDRLSQLAPSSNAYKSSRTTMLLSTPDGRQALQQARLQATTGHAEEAVASYNKLFNGAPPEGDIAVEYWSTVAKIPARRGEAINQLKRINADTPGNTGLQNNLALLLFSSDRRDEGFAVLEQMAKSNAGREGASKIWYGQIKDMPVSDASVQALKKYLSIFSDGDSVAAAQSQLAEQQKQLADPAFRARAQGLAAVDSGMAGKAIPELQQAVRANPKDSEALGALGQAYSQKGDRANAVVNLEKALALDPHNSNNDKWNSLLKVNRYWLAIQQGDAALKANNPDRAERLFQQARNVDNTDSYAVLGLGDVAMARKDYPAAERYYQQTLRMDSGNTNAVRGLANIYRQQSPEKAEAYIASLSASQRRSIDDIERSLQNDRLAQQAEALENQGKWAQAAALQRQRLALDPGSVWITYRLSQDLWQAGQRSQADTLMRNLAQQKPNDPEQVYAYGLYLSGHDQDRAALAHINSLPRGQWNSNIQELVNRLQNDQVLETANRLRENGKEAEAEAMLRQQPPSSRIDLTLADWAQQRRDYTAARAAYQNVLTREPTNADAILGLTEVDIAAGDKAAARSQLAKLPAIDNASLNTQRRVALAQAQLGDTAAAQQTFNKLIPQAKSQPPSMESAMVLRDGAKFEALAGDPTQALETYKDAMVASGVTTTRPQDNDTFTRLTRNDEKDDWLKRGVRSDTADLYRQQDLNVTLEHDYWGSSGTGGYSDLKAHTTMLQVDAPYSDGRMFFRSDFVNMNVGSFSTNADGKWDDNWGTCTLQDCSGNRSQSDSGASVAVGWRNDVWSWDIGTTPMGFNVVDVVGGISYSDDIGPLGYTVNAHRRPISSSLLAFGGQKDSPSNTGKKWGGVRADGVGLSLSYDKGEANGVWASLSGDQLTGKNVEDNWRVRWMTGYYYKVINQNNRRVTIGLNNMIWHYDKDLSGYSLGQGGYYSPQEYLSFAIPVMWRERTENWSWELGASGSWSHSRTKTMPRYPLMNLIPTDWQEEAARQSNDGGSSQGFGYTARALLERRVTSNWFVGTAIDIQQAKDYAPSHFLLYVRYSAAGWQGDMDLPPQPLIPYADW

SEQ ID NO: 8229 - DNA, 1107 bp, Escherichia coli
atgaatgtgttgcgtagtggactcgtgacgatgctgctgctggctgcctttagtgttcaggcagcctgtacctggcctgcctgggagcagtttaaaaaggattacatcagtcaggaagggcgcgtcatcgaccccagcgacgcgcgcaaaatcaccacctccgaagggcaaagttacggcatgttctttgccctggcggctaacgaccgtgcagctttcgataatcttctcgactggacgcagaacaatctcgctcagggttctttaaaagaacatttgcccgcctggctgtggggcaagaaagagaacagtaagtgggaagtgctggacagcaattcggcctccgatggtgatgtctggatggcctggtcgttgctggaggcggggcgtttgtggaaagagcagcgttataccgacatcggcagcgcattgctaaaacgtatcgcgcgggaggaagtggtgacggtgcctgggctgggctccatgttgttaccgggcaaagtgggttttgctgaggataacagctggcgttttaaccccagctacctgccgccgacgctggcgcagtatttcacccgctttggcgcgccgtggaccacgctgcgcgaaaccaatcaacgtttattgctggaaaccgccccgaaaggcttttcgccagactgggtgcgctatgagaaagacaaaggctggcagctaaaagccgaaaaaacattgatcagcagctacgacgctatccgcgtttacatgtgggtaggcatgatgcctgacagcgatccgcaaaaagcgcggatgctcaaccggtttaaaccgatggcgacattcactgagaaaaacggttatccgccggaaaaagtggatgtggctacggggaaagcgcagggtaaaggaccggtcggtttttctgccgccatgctgccctttttacaaaaccgcgatgcgcaggccgttcagcgccagcgcgtggccgataactttcccggcagcgatgcctattacaactatgtgctgaccctgtttggacaaggctgggatcaacaccgtttccgcttctcgacaaaaggtgagttattacctgactggggccaggaatgcgcaaattcacactaa

SEQ ID NO: 8230 - protein, 368 aa, Escherichia coli
MNVLRSGLVTMLLLAAFSVQAACTWPAWEQFKKDYISQEGRVIDPSDARKITTSEGQSYGMFFALAANDRAAFDNLLDWTQNNLAQGSLKEHLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 8231 - DNA, 2427 bp, Escherichia coli
ttgtatcgtttattccgcgccgcccggagcggagcgaaacggcacaaccatcggatcaggctttggctcaacaatgatgataacgcgatgaaaagaaaaatattctggatttgtgcagtggctctggggatgagtgcgttcccctctttcatgacgcaggcgacgccagcaacgcaaccactgatcaatgctgagccagctgtaaccgcccaggcggagcaaaatccgcaggtggggcaagtgatgccgggcgtgcagggcgcagatgcgccagtcgtggcgcagaacggtccttcccgtgatgtgaagctgacctttgcgcaaattgcgccgccgccgggcagcatggtgctacgtggcattaacccgaacggcagcattgagtttggtatgcgcagcgatgaagtggtgacgaaggcgatgctcaacctcgaatacacgccatcgccatcattactgcctgtccagtcgcagttaaaggtttatctcaatgatgaactgatgggcgtgctgccagtgaccaaagaacagttgggtaaaaaaacgctggcacaaatgcccattaacccgctgtttattactgatttcaaccgtgtgcggctggagtttgtcggccattatcaggacgtgtgcgaaaacccggccagcaccacgctttggctggatgttgggcggagcagtggactggatctgacctatcagaccctgaatgtgaagaatgacctgtcacacttcccggtgccattctttgacccgcgtgataaccgcaccaacaccttgccgatggtctttgcgggtgcgccggatgttgagctgcaacaagcatctgccattgtcgcctcgtggtttggttcgcgttcaggctggcgtgggcagaacttcccggtgctctataaccaactgccggatcgcaatgccattgtctttgccaccaatgacaaacgcccggacttcctgcgcgatcatccggcggtaaaagccccggtgattgagatgattaaccatccgcagaatccttacgtcaaactgctggtggtgtttggtcgtgacgacaaagacttgttgcaggcagcgaaaggtatcgctcagggtaacattctgttccgtggtgaaagtgtggtagtgaatgaagtgaaaccgctgctaccacgtaagccgtacgatgcgccgaactgggtgcgtaccgatcgtccggtcacctttggtgaactgaaaacctatgaagaacaattacaatccagcggtcttgagccagcagcgattaacgtttcgctaaacctgccgccggatctctacctgatgcgcagtaccggcattgatatggatattaattaccgctacaccatgccgccggtgaaagacagttcgcggatggatatcagcctgaataaccagttcctgcaatccttcaacctgagcagcaaacaggaggcgaaccgcctgctgctgcggattccggtattacaaggtttgctggatggcaaaacggatgtctctattccggcgctgaaactgggcgcgaccaaccagctgcggttcgactttgagtatatgaacccgatgccgggcggttcggtggataactgcattaccttccagccggtgcagaatcatgtggtgattggtgacgactccaccatcgacttctcgaagtattaccacttcatcccgatgccggatctacgcgcctttgctaacgcgggcttcccgttcagccggatggcggatttgtcgcaaaccatcaccgtgatgccgaaaacgccaaacgaagcacagatggaaaccttgctgaataccgttggctttatcggtgcgcagacgggcttcccggcgattaacctgacggtgaccgatgatggcagcaccattcagggcaaagatgccgacatcatgatcgtcggtggtatcccggacaaactgaaagacgataagcagatcgacctgttggtgcaggctaccgaaagctgggtgaaaacgccgatgcgccagaccccgttccccggtattgtgccggacgagagcgatcgcgcggcagaaacccagtcaacgctgacctcttccggtgcgatggcggcggtgattggtttccagtcgccgtataacgaccagcgcagcgtgattgcgctgctggcagatagcccacgcggttatgaaatgcttaacgatgcggtgaacgatagcggcaaacgcgccaccatgttcggttcggtcgcggtgatccgcgagtccggtatcaacagcctacgtgttggcgatgtttattacgtaggtcatctgccgtggttcgagcgcttgtggtatgcgctggcaaaccatccgattctgctggcggtgctggcggctatcagtgtgatattgctggcgtgggtactgtggcgtctgctgcgtattattagtcgtcgtcgtcttaacccggataacgagtaa

SEQ ID NO: 8232 - protein, 808 aa, Escherichia coli
MYRLFRAARSGAKRHNHRIRLWLNNDDNAMKRKIFWICAVALGMSAFPSFMTQATPATQPLINAEPAVTAQAEQNPQVGQVMPGVQGADAPVVAQNGPSRDVKLTFAQIAPPPGSMVLRGINPNGSIEFGMRSDEVVTKAMLNLEYTPSPSLLPVQSQLKVYLNDELMGVLPVTKEQLGKKTLAQMPINPLFITDFNRVRLEFVGHYQDVCENPASTTLWLDVGRSSGLDLTYQTLNVKNDLSHFPVPFFDPRDNRTNTLPMVFAGAPDVELQQASAIVASWFGSRSGWRGQNFPVLYNQLPDRNAIVFATNDKRPDFLRDHPAVKAPVIEMINHPQNPYVKLLVVFGRDDKDLLQAAKGIAQGNILFRGESVVVNEVKPLLPRKPYDAPNWVRTDRPVTFGELKTYEEQLQSSGLEPAAINVSLNLPPDLYLMRSTGIDMDINYRYTMPPVKDSSRMDISLNNQFLQSFNLSSKQEANRLLLRIPVLQGLLDGKTDVSIPALKLGATNQLRFDFEYMNPMPGGSVDNCITFQPVQNHVVIGDDSTIDFSKYYHFIPMPDLRAFANAGFPFSRMADLSQTITVMPKTPNEAQMETLLNTVGFIGAQTGFPAINLTVTDDGSTIQGKDADIMIVGGIPDKLKDDKQIDLLVQATESWVKTPMRQTPFPGIVPDESDRAAETQSTLTSSGAMAAVIGFQSPYNDQRSVIALLADSPRGYEMLNDAVNDSGKRATMFGSVAVIRESGINSLRVGDVYYVGHLPWFERLWYALANHPILLAVLAAISVILLAWVLWRLLRIISRRRLNPDNE

SEQ ID NO: 8233 - DNA, 2619 bp, Escherichia coli
atgagtatcctgacccggtggttgcttatcccgccggtcaacgcacggcttatcgggcgttatcgcgattatcgtcgtcacggcgcgtcggctttcagcgcgacgctcggctgtttctggatgatcctggcctggatttttattccgctggagcacccgcgctggcagcgtattcgcgcagaacataaaaacctgtatccgcatatcaacgcctcgcgtccgcgtccgctggacccggtccgttatcttattcaaacatgctggttactgatcggtgcatcgcgcaaagaaacgccgaaaccgcgcaggcgggcattttcaggtctacaaaatattcgtggacgttaccatcaatggatgaacgagctgcctgagcgcgttagccataaaacacagcatcttgatgagaaaaaagagctcggtcatttgagtgccggggcgcggcggttgatccttggtatcatcgtcaccttctcgctgattctggcgttaatctgcgttactcagccgtttaacccgctagcgcagtttatcttcctgatgctgctgtggggggtagcgctgatcgtacggcggatgccggggcgcttctcggcgctgatgctgattgtgctgtcgctgaccgtttcttgccgttatatctggtggcgttacacctcgacgttaaactgggacgatccggtcagcctggtgtgcgggcttattctgctgttcgctgaaacgtacgcgtggatagtgctggtgctcggctacttccaggtcgtatggccgctgaatcgtcagccggtgccattgccgaaagatatgtcgctgtggccgtcggtggatatctttgtcccgacttacaacgaagatctcaacgtggtgaaaaataccatttacgcttcgctgggtatcgactggccgaaagacaagctgaacatctggatcctcgatgacggcggcagggaagagtttcgccagtttgcgcaaaacgtgggggtgaaatatatcgcccgtaccactcatgaacatgcgaaagcgggcaacatcaacaatgcgctgaaatatgccaaaggcgagttcgtgtcgatattcgactgcgaccacgtaccaacgcgatcgttcctgcaaatgaccatgggctggttcctgaaagagaaacagctggcgatgatgcagacaccgcaccacttcttctcgccggatccgtttgaacgcaacctggggcgtttccgtaaaacaccgaacgaaggcacgctgttctatggtctggtgcaggacggcaatgatatgtgggatgccactttcttctgcggctcatgtgcggtgattcgccgtaagccgctggatgagattggcggtattgctgtcgaaacggtaaccgaagatgcgcacacttctctgcgtctgcaccgtcgtggctacacctcagcgtatatgcgtattccgcaggcagcggggctggcgaccgaaagtctctcggcgcatatcggtcagcgtattcgctgggcgcgcgggatggtgcaaatcttccgtctcgataacccgctcaccggtaaagggctgaagtttgctcagcggctgtgctatgtcaacgccatgttccatttcttgtcgggcattccacgactgatcttcctgactgcgccgctggcgttcctgctgtttcatgcctacatcatctacgcgccagcgttgatgatcgccctgttcgtgctaccgcatatgatccatgccagcctgactaactcgaagatccagggcaaatatcgccactctttctggagtgaaatctacgaaacagtgctggcgtggtatatcgcaccaccgacgctggtggcgctgattaacccgcacaaaggcaaatttaacgtcaccgccaaaggtggactggtggaagaagagtacgtcgactgggtgatctcgcggccctacatcttccttgttctgctcaacctggtgggcgtagcggttgggatctggcgctacttctatggtccgccaaccgagatgctcaccgtggtcgtcagtatggtgtgggtattctacaacctgattattctcggcggcgcagtcgcagtatcggtagaaagcaaacaggtacgccgatcgcaccgcgtggagatgacgatgcccgcagcaattgcccgcgaagatggtcacctcttctcgtgtaccgttcaggatttctccgacggtggtttggggatcaagatcaacggtcaggcgcagattctggaagggcagaaagtgaatctgttgcttaaacgcggtcagcaggaatacgtcttcccggctcaggtggcgcgcgtgatgggtaatgaagttgggctgaaattaatgccgctcactacccagcaacatatcgattttgtgcagtgtacgtttgcccgtgcggatacatgggcgctctggcaggacagctacccggaagataagccgctggaaagtctgctggatattctgaagctcggcttccgtggctaccgccatctggcggaatttgcgccttcttcggtgaagggcatattccgtgtgctgacttctctggtttcctgggttgtatcgtttattccgcgccgcccggagcggagcgaaacggcacaaccatcggatcaggctttggctcaacaatga

SEQ ID NO: 8234 - protein, 872 aa, Escherichia coli
MSILTRWLLIPPVNARLIGRYRDYRRHGASAFSATLGCFWMILAWIFIPLEHPRWQRIRAEHKNLYPHINASRPRPLDPVRYLIQTCWLLIGASRKETPKPRRRAFSGLQNIRGRYHQWMNELPERVSHKTQHLDEKKELGHLSAGARRLILGIIVTFSLILALICVTQPFNPLAQFIFLMLLWGVALIVRRMPGRFSALMLIVLSLTVSCRYIWWRYTSTLNWDDPVSLVCGLILLFAETYAWIVLVLGYFQVVWPLNRQPVPLPKDMSLWPSVDIFVPTYNEDLNVVKNTIYASLGIDWPKDKLNIWILDDGGREEFRQFAQNVGVKYIARTTHEHAKAGNINNALKYAKGEFVSIFDCDHVPTRSFLQMTMGWFLKEKQLAMMQTPHHFFSPDPFERNLGRFRKTPNEGTLFYGLVQDGNDMWDATFFCGSCAVIRRKPLDEIGGIAVETVTEDAHTSLRLHRRGYTSAYMRIPQAAGLATESLSAHIGQRIRWARGMVQIFRLDNPLTGKGLKFAQRLCYVNAMFHFLSGIPRLIFLTAPLAFLLFHAYIIYAPALMIALFVLPHMIHASLTNSKIQGKYRHSFWSEIYETVLAWYIAPPTLVALINPHKGKFNVTAKGGLVEEEYVDWVISRPYIFLVLLNLVGVAVGIWRYFYGPPTEMLTVVVSMVWVFYNLIILGGAVAVSVESKQVRRSHRVEMTMPAAIAREDGHLFSCTVQDFSDGGLGIKINGQAQILEGQKVNLLLKRGQQEYVFPAQVARVMGNEVGLKLMPLTTQQHIDFVQCTFARADTWALWQDSYPEDKPLESLLDILKLGFRGYRHLAEFAPSSVKGIFRVLTSLVSWVVSFIPRRPERSETAQPSDQALAQQ

SEQ ID NO: 8235 - DNA, 753 bp, Escherichia coli
atggccgtactgggattgcagggggttcggggaggcgtggggacaacaaccatcaccgccgcattagcctggtcattacaaatgttgggagaaaatgtcctggtggtcgatgcctgcccggacaacttgttgcgcctgtcatttaacgttgattttacccaccgtcagggttgggccagagctatgctggatggccaggactggcgtgacgccgggttgcgctatacctcgcagctcgatttgctgccttttggtcagttatccattgaagaacaagaaaatccacagcactggcaaacccggctgagcgatatttgcaccggcttacagcaactaaaagccagcgggcgttaccagtggattttaattgacttaccgcgtgatgcctcgcagataacccaccagctgctgagtttgtgcgatcactcgctggcaatcgtcaatgtggatgccaactgccatatccgactgcatcagcaagcgctgccggatggtgcacatattttgattaatgacttccgtattggcagccaggttcaggacgatatttaccagctttggttgcaaagccagcgccgattgctgccgatgctcattcatcgtgatgaagcgatggctgaatgtctggcagctaagcaaccagtcggtgaatatcgcagtgatgcgctggcggctgaagagatactgacgctggctaactggtgcctgttaaactattccgggctgaaaatgccagtcgggagtgcatcatga

SEQ ID NO: 8236 - protein, 250 aa, Escherichia coli
MAVLGLQGVRGGVGTTTITAALAWSLQMLGENVLVVDACPDNLLRLSFNVDFTHRQGWARAMLDGQDWRDAGLRYTSQLDLLPFGQLSIEEQENPQHWQTRLSDICTGLQQLKASGRYQWILIDLPRDASQITHQLLSLCDHSLAIVNVDANCHIRLHQQALPDGAHILINDFRIGSQVQDDIYQLWLQSQRRLLPMLIHRDEAMAECLAAKQPVGEYRSDALAAEEILTLANWCLLNYSGLKMPVGSAS

SEQ ID NO: 8237 - DNA, 189 bp, Escherichia coli
atgaataacaatgaaccagatactctgcctgatcccgcgataggctatatcttccagaatgatattttggcgttaaagcaggcattttcactgcctgatattgattatgccgatatttcccaacgcgaacagttggccgcggcattaaaacgctggccgttgctggcagagtttgcgcaacaaaagtag

SEQ ID NO: 8238 - protein, 62 aa, Escherichia coli
MNNNEPDTLPDPAIGYIFQNDILALKQAFSLPDIDYADISQREQLAAALKRWPLLAEFAQQK

SEQ ID NO: 8239 - DNA, 1560 bp, Escherichia coli
gtggaccctgtattctctatcggtatctcatcattatggaatgagctgcgacatatgccagcaggcggcgtctggtggtttaacgtcgatcgccatgaagatgctatcagtctggcgaatcaaacaattgcatcccaggctgaaaccgcacacgtcgcggtcattagcatggacagcgatccagcgaaaatctttcaattagatgattctcaagggccggaaaaaataacattattttcaatgctaaatcatgaaaaaggtctatactatttggcccgtgatttgcagtgttctattgatccccataattacctttttattcttgtttgcgcaaataacgcatggcaaaacattcctgccgagcggcttcgctcatggttggataaaatgaataaatggagccggctaaaccattgttcgcttttggtaattaattccggaaataataacgataaacaattttcattgttacttgaggaataccgttcactttttggtcttgccagtttgcgttttcagggcgaccaacatttgctggatattgctttctggtgcaacgaaaaaggggtcagcgcccgtcagcagcttagcgttcagcaacaaaatggttgctggacattagttcaacaccaggaggcggaaatccaaccacgcagcgacgaaaaacgcattctgagtaatgttgctgtactggagggtgctccgccgctatcggaacactggcaactgttcaacaataacgaagtcctgttcaatgaagcccgtaccgctcaggcggcgacggtggtcttttctttacagcaaaatgcacaaatcgagccactggcccgcagcattcatactctgcgtcgccagcgcggtagtgcgatgaaaatcctcgtacgggaaaataccgccagcctgcgcgccaccgatgaacgtttattattggcctgcggtgcaaatatggttatcccgtggaatgcgccactctcccgctgtctgacgatgatcgaaagcgtgcaagggcagaagtttagtcgctatgtgccggaagatatcactaccttgctgtcaatgacccagccgctcaaactgcgtggtttccagaagtgggatgtgttctgtaatgccgtcaacaacatgatgaataaccctctattacctgcccacggtaaaggcgttctggttgccctacgtccggtaccgggtatccgcgttgagcaagccctgacgctatgtcgccctaaccgtaccggcgatatcatgaccattggcggtaatcggctggtgctgtttctctcattctgtcggattaacgatctggataccgcgttgaatcatattttcccattgcctactggcgacattttctcaaaccgaatggtctggtttgaagatgatcaaatcagtgccgagctggtgcagatgcgcctgcttgccccagaacaatggggcatgccgctgcctttagcgcaaagttctaaaccggtcatcaatgccgagcacgatggtcgccactggcgacgaataccagaaccaatgcgactgttagatgatgctgtggagcgctcatcatga

SEQ ID NO: 8240 - protein, 519 aa, Escherichia coli
MDPVFSIGISSLWNELRHMPAGGVWWFNVDRHEDAISLANQTIASQAETAHVAVISMDSDPAKIFQLDDSQGPEKITLFSMLNHEKGLYYLARDLQCSIDPHNYLFILVCANNAWQNIPAERLRSWLDKMNKWSRLNHCSLLVINSGNNNDKQFSLLLEEYRSLFGLASLRFQGDQHLLDIAFWCNEKGVSARQQLSVQQQNGCWTLVQHQEAEIQPRSDEKRILSNVAVLEGAPPLSEHWQLFNNNEVLFNEARTAQAATVVFSLQQNAQIEPLARSIHTLRRQRGSAMKILVRENTASLRATDERLLLACGANMVIPWNAPLSRCLTMIESVQGQKFSRYVPEDITTLLSMTQPLKLRGFQKWDVFCNAVNNMMNNPLLPAHGKGVLVALRPVPGIRVEQALTLCRPNRTGDIMTIGGNRLVLFLSFCRINDLDTALNHIFPLPTGDIFSNRMVWFEDDQISAELVQMRLLAPEQWGMPLPLAQSSKPVINAEHDGRHWRRIPEPMRLLDDAVERSS

SEQ ID NO: 8241 - DNA, 192 bp, Escherichia coli
atgatgaccatcagcgatatcattgaaattattgtcgtttgcgcactgatatttttcccgctgggctatctggcgcggcactctttgcgacgcattcgcgacaccttacgtttgttctttgctaaacctcgttatgttaaaccggccgggacgttacgccgcacggaaaaagccagggcaaccaaaaaatga

SEQ ID NO: 8242 - protein, 63 aa, Escherichia coli
MMTISDIIEIIVVCALIFFPLGYLARHSLRRIRDTLRLFFAKPRYVKPAGTLRRTEKARATKK

SEQ ID NO: 8243 - DNA, 1680 bp, Escherichia coli
atgactcaatttacgcaaaataccgccatgccttcttccctctggcaatactggcgcggcctttccggctggaacttctattttctggttaagttcggcctgttgtgggcgggatatcttaacttccatccgctcctcaatctggtgtttgccgcgtttctgctgatgcccattccgcgctacagcctgcatcgcttgcgccactggattgccctgccgatcggctttgctttgttctggcatgacacctggttgcctggcccggaaagcataatgagccagggttcgcaggtggcggggttcagtaccgattatttaatcgatcttgtcacacgctttattaactggcagatgattggggccatttttgttttattcgtggcctggttattcctgtcacaatggattcgcattaccgtttttgtggttgccattctgctatggctgaacgtacttaccctggcgggaccaagtttctccttgtggccagccggtcaaccgacgaccactgtaacaacgacgggtggtaacgcagcggcaaccgttgcggcgacgggtggcgcaccggtagtgggtgatatacccgcacaaactgcaccgccaacaacagcaaaccttaacgcctggctgaataatttctataacgcggaggcgaaacgtaaatcgatcttcccgtcttcgctgcccgctgatgctcagccatttgaactactggtgattaatatctgttcgctttcctggtcggatattgaagccgccggattgatgtcgcatccactgtggtcgcatttcgatattgagttcaagaactttaactccgccacctcctacagtggcccggcggcgatccgtttactgcgcgccagctgcgggcagacttcgcacactaatctgtatcaaccggcaaataacgactgctatctgtttgataacctgtcgaaactgggctttacccagcacctgatgatgggacataacggccagttcggtggttttttgaaggaagttcgcgaaaatggcggcatgcagagcgaattgatggatcaaacaaatctgccggttattttgctgggctttgatggttcgccggtttatgacgataccgccgtgcttaaccgttggctggacgttaccgaaaaagataaaaacagccgtagtgccacgttctacaacacgcttccactgcatgacggcaaccattatccgggcgtcagcaaaacagcggattacaaagcgcgggcgcaaaaattctttgatgaactggacgccttctttactgaactggagaaatcgggtcgtaaagtgatggtggtagtggtgccggaacacggcggcgcgctgaagggcgacagaatgcaggtatctggtctacgtgatatccctagcccgtctatcacagacgtccccgttggggtgaaattcttcggcatgaaggcaccacatcagggggctccgattgtcatcgaccaaccgagcagcttcctggctatctccgatctggtagttcgcgttcttgatggcaagattttctccgaagacaatgttgactggaaaaaactcaccagtgggttaccacaaacagcaccggtctctgagaactcaaatgcagtagttattcaataccaggataaaccgtacgttcgcctgaacggcggcgactgggtgccttacccgcagtaa

SEQ ID NO: 8244 - protein, 559 aa, Escherichia coli
MTQFTQNTAMPSSLWQYWRGLSGWNFYFLVKFGLLWAGYLNFHPLLNLVFAAFLLMPIPRYSLHRLRHWIALPIGFALFWHDTWLPGPESIMSQGSQVAGFSTDYLIDLVTRFINWQMIGAIFVLFVAWLFLSQWIRITVFVVAILLWLNVLTLAGPSFSLWPAGQPTTTVTTTGGNAAATVAATGGAPVVGDIPAQTAPPTTANLNAWLNNFYNAEAKRKSIFPSSLPADAQPFELLVINICSLSWSDIEAAGLMSHPLWSHFDIEFKNFNSATSYSGPAAIRLLRASCGQTSHTNLYQPANNDCYLFDNLSKLGFTQHLMMGHNGQFGGFLKEVRENGGMQSELMDQTNLPVILLGFDGSPVYDDTAVLNRWLDVTEKDKNSRSATFYNTLPLHDGNHYPGVSKTADYKARAQKFFDELDAFFTELEKSGRKVMVVVVPEHGGALKGDRMQVSGLRDIPSPSITDVPVGVKFFGMKAPHQGAPIVIDQPSSFLAISDLVVRVLDGKIFSEDNVDWKKLTSGLPQTAPVSENSNAVVIQYQDKPYVRLNGGDWVPYPQ

SEQ ID NO: 8245 - DNA, 162 bp, Escherichia coli
ttgcgcatttcactactagtctggagtcagcccggatatgagctgcaactattgcaaataaagaaattaagctggaaggcatcacgcaatgaggaagattgccggatgctgacggtaaaaagcaatcgtaaaatcagcggcaagccggaaaggttccggtga

SEQ ID NO: 8246 - protein, 53 aa, Escherichia coli
MRISLLVWSQPGYELQLLQIKKLSWKASRNEEDCRMLTVKSNRKISGKPERFR

SEQ ID NO: 8247 - DNA, 1335 bp, Escherichia coli
ttgcgcaagagaaactgggtttattcatttttgcgaggccgacttctttctggacaggactttatgcagcacaacacactaccgaaacacgatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtacaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttctcaatctctattttataaagtcgccattttcgccgtactggtggcgattgcgtctggtggtgaacgattactgtttaagatttccggaccaatggtggtggtcaaagtggggattattgtcgtgttcggttttgcgatgatcccgcactggaatttcgccaatataaccgccttcccgcaagcctccgactttttccgcgatgtcctgcttactattccattttgcttcttttccgcggtatttattcaggtacttaacccaatgaatattgcctatcgtaaacgggaagctgataaagtactggcaacccggctcgcgctgcgtacccaccggattagctatatcacgctcattgcggtgatcttgttttttgccttttcgtttaccttctcaattagccacgaagaagccgtttctgcctttgaacaaaatatctcggcactggcactggccgcgcaggtgatccctgggcatatcattcatatcacctctacggtactgaatatctttgccgtactgactgcattctttggcatttatctcggtttccacgaggccattaaaggcattattctcaatctgttaagccgaattattgataccaggaaaattaactcacgcatgctgactctggcgatctgcacttttatcgtcattacgttgacgatttgggtttcgtttcgtgtatcggtgctggtgttctttcagttgggaagcccgttatatggcattgtgtcgtgcctcattccgtttttcctgatctataaagtctcacaactggaaaaacttcgcgggtttaaagcctggatgattctgctgtacggcattttgttatgcttgtcgccactgttgaagttgattgagtaa

SEQ ID NO: 8248 - protein, 444 aa, Escherichia coli
MRKRNWVYSFLRGRLLSGQDFMQHNTLPKHDQKLPFTRYDFGWVLLCIGMAIGAGTVLMPVQIGLKGIWVFITAAIIAYPATWVVQDIYLKTLSESDSCNDYTDIISHYLGKNWGIFLGVIYFLMIIHGIFIYSLSVVFDSASYLKTFGLTDADLSQSLFYKVAIFAVLVAIASGGERLLFKISGPMVVVKVGIIVVFGFAMIPHWNFANITAFPQASDFFRDVLLTIPFCFFSAVFIQVLNPMNIAYRKREADKVLATRLALRTHRISYITLIAVILFFAFSFTFSISHEEAVSAFEQNISALALAAQVIPGHIIHITSTVLNIFAVLTAFFGIYLGFHEAIKGIILNLLSRIIDTRKINSRMLTLAICTFIVITLTIWVSFRVSVLVFFQLGSPLYGIVSCLIPFFLIYKVSQLEKLRGFKAWMILLYGILLCLSPLLKLIE

SEQ ID NO: 8249 - DNA, 1005 bp, Escherichia coli
atgagtacgcatgaggccacctcgcaacaaccgctgttgcaggctatcgacctgaaaaaacattatccggtgaagaaaggcatgttcgcgccggaacgtctggtgaaggcgctggatggcgtttcgtttaaccttgaacgtggcaaaacgctggcagtagtaggtgaatctggctgcggtaaatcgaccctcggtcggttgctgacgatgattgaaacgcccaccggcggcgaactgtattaccaggggcaggatctgctcaagcacgatccgcaggcgcagaagctacgtcggcagaaaatccagattgtcttccagaacccttacggttcgctgaatccgcgtaaaaaagttgggcagattctcgaagagccgctgctgatcaacaccagcttaagcaaagaacagcgtcgggaaaaagccctgtcgatgatggcgaaagtcggcctgaaaaccgagcattacgaccgctatccgcatatgttctccggcggtcagcgtcagcgtatcgccattgcccgaggtctgatgctcgacccggatgtggtgattgccgatgagccggtttctgcgctggacgtctcagtgcgtgcgcaggtgctgaatctgatgatggatttgcagcaggaactggggctatcttatgtctttatctcgcacgatctgtcggtggtggagcacattgctgatgaagtgatggtgatgtacctgggccgctgcgtggagaaggggacgaaggaccaaatcttcaataacccgcgccacccgtacactcaggcattgctctccgcgacaccacgcctgaacccggacgatcgtcgcgaacgcatcaaacttaccggtgaactgccaagcccgctgaatccaccgccaggctgcgccttcaacgcccgctgtcgtcggcgcttcggcccctgcatccagttgcagccgcagctaaaagactacggcggtcaactggtagcctgttttgccgttgatcaggatgaaaatccgcagcgttaa

SEQ ID NO: 8250 - protein, 334 aa, Escherichia coli
MSTHEATSQQPLLQAIDLKKHYPVKKGMFAPERLVKALDGVSFNLERGKTLAVVGESGCGKSTLGRLLTMIETPTGGELYYQGQDLLKHDPQAQKLRRQKIQIVFQNPYGSLNPRKKVGQILEEPLLINTSLSKEQRREKALSMMAKVGLKTEHYDRYPHMFSGGQRQRIAIARGLMLDPDVVIADEPVSALDVSVRAQVLNLMMDLQQELGLSYVFISHDLSVVEHIADEVMVMYLGRCVEKGTKDQIFNNPRHPYTQALLSATPRLNPDDRRERIKLTGELPSPLNPPPGCAFNARCRRRFGPCIQLQPQLKDYGGQLVACFAVDQDENPQR

SEQ ID NO: 8251 - DNA, 984 bp, Escherichia coli
atggcgttattaaatgtagataaattatcggtgcatttcggcgacgaaagcgcaccgttccgcgccgtagaccgcatcagctacagcgtaaaacagggtgaagtggtcgggattgtgggtgagtccggctctggtaaatcggtcagttcgctggcgattatggggctgattgattatccgggccgcgtaatggcggaaaagctggagtttaacggtcaggatttgcagcgtatctcagaaaaagagcgccgcaacctggtgggtgccgaagtggcaatgatcttccaggacccgatgaccagccttaacccgtgctacaccgtgggtttccagattatggaagcgattaaggtgcatcagggcggcaacaaaagtacccgccgtcagcgagcgattgacctgctaaatctggtcggtattcccgatccggcatcgcgtctggatgtttacccgcatcagctttccggcggcatgagccagcgcgtgatgatcgccatggcgattgcctgtcggccaaaactgctgattgccgatgaaccaaccactgcgctggacgtgaccattcaggcgcaaattatcgaactgctgctggagctacagcagaaagagaacatggcgctggtgttaattacccatgacctggcgctggtggcggaagcggcacataaaattatcgtgatgtatgcaggccaggtagtagaaacgggcgatgcgcacgctatcttccatgcgccgcgtcacccgtatactcaggcattgctgcgtgcgctgccggaatttgctcaggacaaagaacgtctggcgtcgttgccaggtgtcgttcccggcaagtacgaccgcccgaacggctgcctgcttaacccgcgctgcccctacgccactgacaaatgccgtgctgaagaaccggcgctgaatatgctcgctgacgggcgtcagtccaaatgccattacccacttgatgatgccgggaggccgacactatga

SEQ ID NO: 8252 - protein, 327 aa, Escherichia coli
MALLNVDKLSVHFGDESAPFRAVDRISYSVKQGEVVGIVGESGSGKSVSSLAIMGLIDYPGRVMAEKLEFNGQDLQRISEKERRNLVGAEVAMIFQDPMTSLNPCYTVGFQIMEAIKVHQGGNKSTRRQRAIDLLNLVGIPDPASRLDVYPHQLSGGMSQRVMIAMAIACRPKLLIADEPTTALDVTIQAQIIELLLELQQKENMALVLITHDLALVAEAAHKIIVMYAGQVVETGDAHAIFHAPRHPYTQALLRALPEFAQDKERLASLPGVVPGKYDRPNGCLLNPRCPYATDKCRAEEPALNMLADGRQSKCHYPLDDAGRPTL

SEQ ID NO: 8253 - DNA, 903 bp, Escherichia coli
atgtcacaggttactgaaaataaagtgattagcgcaccggtgccgatgaccccgttacaggagttctggcactattttaaacgcaacaaaggcgcggtcgtcgggctggtttacgtcgtcatcgtgctgtttatcgcgatctttgccaactggattgcaccctataacccggcggaacagttccgcgatgcactgctcgccccgccagcctggcaggaaggcggcagcatggcgcacttgctgggcaccgatgacgtaggccgtgatgtgctgtcgcgtctgatgtacggtgcgcgattgtcactgctggttggctgtctggtagttgtgttatcgctgattatgggcgttattctcggcctgatcgccggttacttcggcggcctggtcgataacatcatcatgcgcgtggtcgatatcatgctggcgctgccaagtctgctgttggcactggtgctggtggcgattttcggcccgtcgattggtaacgcagcgctggcgctgacctttgttgccttgccgcactatgtgcgcttaacccgcgccgccgtgctggtggaagtgaaccgcgattacgttaccgcgtctcgcgtggcaggtgccggggcgatgcgccagatgtttattaacatcttcccgaactgccttgcgccgctgattgttcaggcgtcgctcggtttctctaacgccattctcgatatggctgctcttggtttcctcggcatgggcgcgcagccgccaacgccggagtggggcaccatgctctctgatgtgttgcagttcgcgcaaagcgcctggtgggtcgtgaccttcccgggtctggcgatcctgctgacggtgctggcatttaacctgatgggtgacggtctgcgtgacgcgctcgatcccaaactgaagcagtaa

SEQ ID NO: 8254 - protein, 300 aa, Escherichia coli
MSQVTENKVISAPVPMTPLQEFWHYFKRNKGAVVGLVYVVIVLFIAIFANWIAPYNPAEQFRDALLAPPAWQEGGSMAHLLGTDDVGRDVLSRLMYGARLSLLVGCLVVVLSLIMGVILGLIAGYFGGLVDNIIMRVVDIMLALPSLLLALVLVAIFGPSIGNAALALTFVALPHYVRLTRAAVLVEVNRDYVTASRVAGAGAMRQMFINIFPNCLAPLIVQASLGFSNAILDMAALGFLGMGAQPPTPEWGTMLSDVLQFAQSAWWVVTFPGLAILLTVLAFNLMGDGLRDALDPKLKQ

SEQ ID NO: 8255 - DNA, 1020 bp, Escherichia coli
atgttgcagtttattctccgacgtttgggactcgtcatccccacgtttatcggtattacccttctcacatttgcctttgtccacatgatcccgggcgatccggtgatgatcatggcgggcgaacgtgggatctccccagagcgtcacgcgcaattgctggctgaactcggcttagataaaccgatgtggcagcagtatctccattacatttggggcgtaatgcacggtgatttaggcatttcgatgaaaagccgaattccggtatgggaagagttcgtgccgcgctttcaggccacgctggaacttggcgtctgcgcgatgatttttgcgaccgcagtcgggattccggttggtgtgctggctgcggttaaacgtggttccattttcgatcacacagcggttggcctggcgctgaccggctactcgatgccaattttctggtggggcatgatgctgatcatgctggtttcggtgcactggaacctgacgcctgtctccggtcgtgtgagcgacatggtgttcctcgatgattccaatccgttaaccggttttatgctgatcgacaccgccatctggggtgaagacggtaactttatcgatgccgtcgcccatatgatcctgcccgccattgtgctgggtaccatcccgctggcggtcattgtgcgtatgacgcgctcctcgatgctggaagtgctgggcgaagattatatccgcaccgcgcgtgccaaaggtcttacccggatgcgggtgattatcgtccatgcgctgcgtaacgcgatgctgccggtggtgaccgttatcggcctgcaggtgggaacattgctggcgggggcgattctgactgaaaccatcttctcgtggcccggtctggggcgctggttgattgacgcactgcaacgccgcgactatccggtagtgcagggcggcgtattgctggtggcgacgatgattatcctcgtcaacttgctggtcgatctgctgtacggcgtggtgaacccgcgtattcgtcataagaagtaa

SEQ ID NO: 8256 - protein, 339 aa, Escherichia coli
MLQFILRRLGLVIPTFIGITLLTFAFVHMIPGDPVMIMAGERGISPERHAQLLAELGLDKPMWQQYLHYIWGVMHGDLGISMKSRIPVWEEFVPRFQATLELGVCAMIFATAVGIPVGVLAAVKRGSIFDHTAVGLALTGYSMPIFWWGMMLIMLVSVHWNLTPVSGRVSDMVFLDDSNPLTGFMLIDTAIWGEDGNFIDAVAHMILPAIVLGTIPLAVIVRMTRSSMLEVLGEDYIRTARAKGLTRMRVIIVHALRNAMLPVVTVIGLQVGTLLAGAILTETIFSWPGLGRWLIDALQRRDYPVVQGGVLLVATMIILVNLLVDLLYGVVNPRIRHKK

SEQ ID NO: 8257 - DNA, 1608 bp, Escherichia coli
atgcgtatttccttgaaaaagtcagggatgctgaagcttggtctcagcctggtggctatgaccgtcgcagcaagtgttcaggctaaaactctggtttattgctcagaaggatctccggaagggtttaacccgcagctgtttacctccggcaccacctatgacgcctcttccgtaccgctttataaccgtctggttgaatttaaaatcggcaccactgaagtgatcccgggcctcgctgaaaagtgggaagtcagcgaagacggtaaaacctataccttccatctgcgtaaaggtgtgaagtggcacgacaataaagaattcaaaccgacgcgcgaactgaatgccgatgacgtagtgttctcgttcgatcgtcagaaaaacgcgcaaaacccgtaccataaagtctctggcggcagctacgaatacttcgaaggcatgggcttaccagagctgatcagcgaagtgaaaaaggtggacgataacaccgttcagtttgtgctgactcgcccggaagcgccgttcctcgctgacctggcaatggacttcgcctctattctgtcaaaagaatatgctgacgcgatgatgaaagccggtacaccggaaaaactggacctcaacccaatcggtaccggcccgttccagttacagcagtaccagaaagattcccgtattcgctataaagcgtttgatggctactggggcaccaaaccgaagatcgatacgctggtcttctctattactcctgacgcttccgtgcgttacgcgaaattgcagaagaacgaatgccaggtgatgccgtacccgaacccggcagatatcgcccgcatgaagcaggataaatccatcaacctgatggaaatgccggggctgaacgtcggttatctctcgtataacgtgcagaaaaaaccactggatgacgtgaaagttcgccaggctctgacctacgcggtgaacaaagacgctatcatcaaagcggtttatcagggcgcgggcgtatcagcgaaaaacctgatcccgccaaccatgtggggctataacgacgacgttcaggactacacttacgatcctgaaaaagcgaaagccttgctgaaagaagcgggtctggaaaaaggtttctccatcgacctgtgggcaatgccggtacaacgtccgtataacccgaatgctcgccgcatggcggagatgattcaggcagactgggcgaaagtgggcgtgcaggccaaaatcgtcacctacgaatggggtgagtacctcaagcgtgcgaaagatggcgagcatcagacggtaatgatgggctggactggcgataacggggatccggataacttcttcgccaccctgttcagctgcgccgcctctgaacaaggctccaactactcaaaatggtgctacaaaccgtttgaagatctgattcaaccggcgcgtgctaccgacgaccacaataaacgtgttgaactgtacaaacaagcacaggtcgtgatgcacgatcaggctccggcactgatcatcgctcactccaccgtgtttgaaccggtacgcaaagaagttaaaggctatgtggttgatccattaggcaaacatcacttcgaaaatgtctctatcgaataa

SEQ ID NO: 8258 - protein, 535 aa, Escherichia coli
MRISLKKSGMLKLGLSLVAMTVAASVQAKTLVYCSEGSPEGFNPQLFTSGTTYDASSVPLYNRLVEFKIGTTEVIPGLAEKWEVSEDGKTYTFHLRKGVKWHDNKEFKPTRELNADDVVFSFDRQKNAQNPYHKVSGGSYEYFEGMGLPELISEVKKVDDNTVQFVLTRPEAPFLADLAMDFASILSKEYADAMMKAGTPEKLDLNPIGTGPFQLQQYQKDSRIRYKAFDGYWGTKPKIDTLVFSITPDASVRYAKLQKNECQVMPYPNPADIARMKQDKSINLMEMPGLNVGYLSYNVQKKPLDDVKVRQALTYAVNKDAIIKAVYQGAGVSAKNLIPPTMWGYNDDVQDYTYDPEKAKALLKEAGLEKGFSIDLWAMPVQRPYNPNARRMAEMIQADWAKVGVQAKIVTYEWGEYLKRAKDGEHQTVMMGWTGDNGDPDNFFATLFSCAASEQGSNYSKWCYKPFEDLIQPARATDDHNKRVELYKQAQVVMHDQAPALIIAHSTVFEPVRKEVKGYVVDPLGKHHFENVSIE

SEQ ID NO: 8259 - DNA, 144 bp, Escherichia coli
atgacccgcagcctggaactgcgtgtctgtattgctcacaaatcaattcccgcccttgtggaacagggaatgaagtattgctgccggatggcgctgcacgcagaggcacagcgccaccgggtatggcttttaattattcgatag

SEQ ID NO: 8260 - protein, 47 aa, Escherichia coli
MTRSLELRVCIAHKSIPALVEQGMKYCCRMALHAEAQRHRVWLLIIR

SEQ ID NO: 8261 - DNA, 1725 bp, Escherichia coli
gtgttatcacctgtttgtccagggtttgtttgcatgagatacatcaaatcgattacacagcagaagctgagctttttgcttgcaatctatattggcctttttatgaatggcgcggttttttaccgccgtttcggcagctatgcgcacgattttaccgtctggaaaggcatttctgctgttgttgaactggccgccaccgtactggtgaccttctttttactgcgtcttctttcgctgtttggccgccgcagctggcgtattctggcatcgctggtggtgctcttttccgcaggtgccagctattacatgaccttccttaatgtagtcattggttatggcatcatcgcatccgtcatgaccaccgatatcgacctgtcaaaagaagttgttggtctgaactttattctctggttaatcgccgtaagcgcgttgcctcttatccttatctggaataaccgctgtcgttacaccttgctccgacaactgcgaaccccagggcaacgtattcgcagcctggcggtcgtcgtactggcaggtattatggtttgggcaccgattcgtttgctggatatccagcagaagaaagtggagagggcgacaggtgttgatttgccgagttatggcggcgtcgtcgcgaactcttatctgccatcaaactggctttcggcattaggtctttatgcctgggcgcgggtcgatgaatcttccgataacaattctctccttaaccctgcgaagaagtttacgtaccaggctccacaaaacgttgatgatacatatgtcgttttcattattggtgaaaccacgcgctgggatcatatgggcattttcggctatgaacgcaataccacaccgaagctggctcaggagaaaaatctggcggcgttccgtggttactcctgtgatactgcaaccaaactctcactgcgttgcatgtttgtacgtcagggtggagcagaagataatccgcagcgcacattaaaagaacagaacattttcgcggtattgaagcagttaggattcagttctgatctctacgctatgcaaagcgaaatgtggttctacagcaatacgatggcggacaacattgcttatcgtgagcagattggtgcggagccacgtaaccgtggcaaaccggtagatgatatgttactggtagacgaaatgcagcaatcgctggggcgcaacccggatggtaaacatctgatcattctgcataccaaaggctcacactttaactacacccagcgttacccgcgcagctttgcgcagtggaagccggaatgtattggtgttgatagcggctgtaccaaagcgcagatgatcaactcatacgacaactcggtgacctatgtggatcactttatttccagcgtgattgatcaggttcgcgataagaaagcgattgtgttctatgcagctgaccacggtgagtcaattaatgaacgcgagcacctgcacggcacgccgcgtgaactggcaccgccggaacagttccgtgtgccgatgatggtctggatgtcggataaatatctggaaaatccggtcaatgcgcaggcatttgcgcagctgaaaaaagaagccgacatgaaagtgccacgccgtcatgtagagctgtacgacaccatcatgggttgtcttggctatacttcaccggatggtggaattaacgaaaacaacaactggtgtcacatcccgcaggcaaaagaggcgtcggctaactag

SEQ ID NO: 8262 - protein, 574 aa, Escherichia coli
MLSPVCPGFVCMRYIKSITQQKLSFLLAIYIGLFMNGAVFYRRFGSYAHDFTVWKGISAVVELAATVLVTFFLLRLLSLFGRRSWRILASLVVLFSAGASYYMTFLNVVIGYGIIASVMTTDIDLSKEVVGLNFILWLIAVSALPLILIWNNRCRYTLLRQLRTPGQRIRSLAVVVLAGIMVWAPIRLLDIQQKKVERATGVDLPSYGGVVANSYLPSNWLSALGLYAWARVDESSDNNSLLNPAKKFTYQAPQNVDDTYVVFIIGETTRWDHMGIFGYERNTTPKLAQEKNLAAFRGYSCDTATKLSLRCMFVRQGGAEDNPQRTLKEQNIFAVLKQLGFSSDLYAMQSEMWFYSNTMADNIAYREQIGAEPRNRGKPVDDMLLVDEMQQSLGRNPDGKHLIILHTKGSHFNYTQRYPRSFAQWKPECIGVDSGCTKAQMINSYDNSVTYVDHFISSVIDQVRDKKAIVFYAADHGESINEREHLHGTPRELAPPEQFRVPMMVWMSDKYLENPVNAQAFAQLKKEADMKVPRRHVELYDTIMGCLGYTSPDGGINENNNWCHIPQAKEASAN

SEQ ID NO: 8263 - DNA, 1209 bp, Escherichia coli
atgacaccttcaaattatcagcgtactcgctggctgacactcatcggtactatcattacccagtttgctctggggtcggtttatacctggagtctgtttaacggtgcgctttctgccaagctgggggctcctgtaagccaggttgctttctctttcggcttgttaagtctggggctggcaatttcgtcttctgttgcgggcaaattgcaggaacgttttggtgttaaacgcgtcactatggcttccggcattttgctgggattaggtttcttcctgacagcacattccaacaacctgatgatgctgtggttaagcgccggtgtgctggtcggtctggcggatggcgcgggttacctgttgacgctctctaactgcgtgaagtggtttccggagcgtaagggacttatctctgcttttgctatcggttcttatggtctgggcagcctgggttttaaatttatcgacacgcacctgctcgaaacggtgggtctggaaaaaacctttgttatttggggcgcgattgtactggtgatgattgtctttggcgcaacgttaatgaaagatgcgccgaagcaggaagtgaaaaccagcaatggtgtggtggagaaggactacaccctggcagagtcgatgcgtaaaccgcagtactggatgttagcggttatgttcctgactgcgtgcatgagtggtctgtatgtgattggtgtagcgaaagatatcgctcaaagtctggcgcatcttgatgcaatttccgcagccaatgctgtgacggttatttccatcgccaacctttctggtcgtctggtgctgggcattctgtctgacaaaatcgcccgtatccgtgttatcaccattggtcaggtgattgcgctggtggggatggcggccctgctgtttgcaccattgaatgcagtgacgttctttgcagcgattgcctgtgtggcatttaactttggtggcacgattactgtgttcccgtcgctggttagtgagttcttcggcctcaataacctggcgaaaaactacggcgtcatttacctcggtttcggtatcggcagcatttgtggttcgattatcgcttcactgtttggcggattctatgtgactttctacgtgattttcgccctgctgattctgtcactggcgctttctacgaccattcgccagccagagcagaaaatgttgcgtgaggcgcatggctccctttaa

SEQ ID NO: 8264 - protein, 402 aa, Escherichia coli
MTPSNYQRTRWLTLIGTIITQFALGSVYTWSLFNGALSAKLGAPVSQVAFSFGLLSLGLAISSSVAGKLQERFGVKRVTMASGILLGLGFFLTAHSNNLMMLWLSAGVLVGLADGAGYLLTLSNCVKWFPERKGLISAFAIGSYGLGSLGFKFIDTHLLETVGLEKTFVIWGAIVLVMIVFGATLMKDAPKQEVKTSNGVVEKDYTLAESMRKPQYWMLAVMFLTACMSGLYVIGVAKDIAQSLAHLDAISAANAVTVISIANLSGRLVLGILSDKIARIRVITIGQVIALVGMAALLFAPLNAVTFFAAIACVAFNFGGTITVFPSLVSEFFGLNNLAKNYGVIYLGFGIGSICGSIIASLFGGFYVTFYVIFALLILSLALSTTIRQPEQKMLREAHGSL

SEQ ID NO: 8265 - DNA, 699 bp, Escherichia coli
atgatcataaaaaaaagcggtggtcgctggcagctaagcctgcttgcgagcgtggtaatcagtgccttttttctcaacacagcttacgcctggcaacaagaatatatcgttgatacgcaacccggacattccacagagcgttacacctgggatagcgatcatcaacctgattacaacgatattttgtcgcaacgtattcaaagtagccaaagggcgctgggactggaagtcaatctggcggaagaaacccctgtggatgtgaccagcagtatgagtatgggctggaattttcctttatatgagcaggttacaaccggcccggtcgcggcatttcattacgatggcacaaccacctcgatgtataacgagtttggcgacagtactaccacgctggccgatccgttatggcatgccagcgtgagtaccttaggctggcgtgttgactcccggcttggcgatctccgaccctgggcgcaaatcagctataaccagcaatttggcgagaatatctggaaggcgcaatcaggcctgagccggatgacggcgacaaaccagaacggcaactggctggatgtcaccgtaggcgctgatatgttgctcaatcaaaatattgctgcctatgctgcgctatctcaggcagaaaataccactaacaatagcgactatctgtatacgatgggggttagcgccagattttaa

SEQ ID NO: 8266 - protein, 232 aa, Escherichia coli
MIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAAFHYDGTTTSMYNEFGDSTTTLADPLWHASVSTLGWRVDSRLGDLRPWAQISYNQQFGENIWKAQSGLSRMTATNQNGNWLDVTVGADMLLNQNIAAYAALSQAENTTNNSDYLYTMGVSARF

SEQ ID NO: 8267 - DNA, 729 bp, Escherichia coli
atgatcattaacacgactccagggaagagccgaattcggcaatattattgtcattgtatgaaggatatcgggcatagtagccctgtattaaatattgactttttcaccgatgcgtcaagaaaagcggctgaaatttttacgatcgggtacatagcgagggaaagtatggaacgttgcggctgggtgagtcaggacccgctttatattgcctaccatgataatgaatggggcgtgcctgaaactgacagtaaaaaactgttcgaaatgatctgccttgaagggcagcaggctgggttatcgtggatcaccgtcctcaaaaaacgcgaaaactatcgcgcatgctttcatcagttcgatccggtgaaagttgccgcaatgcaggaagaggatatcgaaagactggtacaggacgccgggattatccgccatcgtgggaaaattcaggcaattattggtaatgcgcgggcgtacctgcaaatggaacagaacggcgaaccgtttgccgactttgtctggtcgtttgtcaatcatcaaccacaggtgacacaagccacaacgttgagcgaaatccccacatctacacccgcctccgacgccctatctaaggcactaaaaaaacgtggttttaagtttgtcggtaccacaatctgttactcctttatgcaggcatgtgggctggtgaatgatcatgtggttggctgctgttgccatccgggaaataaaccatga

SEQ ID NO: 8268 - protein, 242 aa, Escherichia coli
MIINTTPGKSRIRQYYCHCMKDIGHSSPVLNIDFFTDASRKAAEIFTIGYIARESMERCGWVSQDPLYIAYHDNEWGVPETDSKKLFEMICLEGQQAGLSWITVLKKRENYRACFHQFDPVKVAAMQEEDIERLVQDAGIIRHRGKIQAIIGNARAYLQMEQNGEPFADFVWSFVNHQPQVTQATTLSEIPTSTPASDALSKALKKRGFKFVGTTICYSFMQACGLVNDHVVGCCCHPGNKP

SEQ ID NO: 8269 - DNA, 2334 bp, Escherichia coli
ttggccaactcatcctcacgatattccgttctgactgccgcccactgggggcctatgctggttgaaaccgacggcgaaaccgtgtttagctcgcgtggcgcgttagccacaggaatggaaaactccttgcagagcgcggttcgcgaccaggttcacagcaatacgcgggtgcgatttccaatggtgcgcaaaggctttcttgcgtcaccggaaaatccgcaaggcattcgtgggcaggatgaatttgttcgcgtgagttgggatgaggcgctggagcttattcaccatcaacataaacgcattcgtgaggcttatggtccggcatcgatttttgctggttcctacggctggcgttcaaacggcgtgctgcataaggcctcgacattattacaacgctatatggcgttggcaggcggttataccgggcatctgggggattattcgaccggcgcggcacaggcgatcatgccgtatgtcgtgggtggcagcgaagtttatcaacagcaaaccagttggccgctggtgctggaacatagcgatgtcgtggtgctgtggagtgctaacccactcaatacgctgaaaattgcgtggaatgcatccgatgagcaggggctttcttacttttccgcactgcgtgacagcgggaaaaagctgatctgcattgatccaatgcgatcggaaaccatcgatttctttggcgataaaatggagtgggtggcaccacacatgggcaccgatgttgcgttgatgctggggatcgcccatacgctggtggaaaatggttggcacgacgaagcgtttctggcgcgttgcaccacaggttatgccgtcttcgcctcttatttgctgggcgagagtgacggtatagcgaaaaacgccgaatgggcggcagagatttgtggtgttggcgcagcgaaaatccgcgagctggcggctattttccaccaaaatacaaccatgctgatggcaggctggggaatgcagcgccaacagtttggtgagcaaaaacactggatgctcgtcacgctggcggcaatgttggggcaaatcggcacacccggcggcggttttggtctttcttaccattttgccaatggtggtaaccccacgcgccgcgctgcggtgctctcttccatgcagggcagcttgccgggtggcaccgatgcggtagataaaatccctgtcgcccgcattgttgaagcactggaaaaccctggtggcgcatatcaacataacggtatggaccgacatttcccggatattcgttttatctggtgggcgggtggtgccaactttactcatcatcaggataccaatcgcctgatccgtgcctggcaaaaaccggagctggtggtgatctccgaatgcttctggacggctgcggcgaaacacgcggatatcgttctgcctgcgacaacctcttttgagcgtaatgatctcaccatgaccggtgattacagtaatcagcatctggtgccgatgaagcaagtggtgccgccacgctatgaagcgcgtaatgattttgatgtttttgccgacttgagtgaacgttggcagaagggcggttatgcacgttttacggaaggaaaaagtgagctgcaatggctggaaacgttttataacgttgcccggcagcgcggggcaagccagcaggttgaattgccgccatttgctgagttctggcaagccaaccagttaattgagatgccggaaaacccggacagtgagcggtttattcgcttcgccgattttcgccgcgatccgcaggcgcatccattaaaaaccgccagcggtaagattgaaatcttctcgcagcgtattgccgattacgcttatccggattgcccggggcatccaatgtggctggcgccggacgaatggcagggcagtgccgaaccggaacagttgcaggtactttctgctcatccggcgcatcgtctgcacagccagctgaattacagttctctgcgcgaattgtacgcggtggcaaatcgtgagcctgtcaccattcatcctgacgatgcccagacgcgcggcatacaagatggcgatactgttcggctgtggaactcacgcgggcaaattcttgccggcgcggtcattagcgagggaattaaacctggcgtgatttgtattcacgaaggcgcatggccggatttggatttaaccgctggcggcatttgtaaaaacggcgcagtgaacgtgctgaccaaagatctccccagctcgcggctggggaatggctgtgcgggtaatacggcgctggcatggctggaaaaatacaccggttcggaactgacacttacagcgtttgaaccaccggccagctcataa

SEQ ID NO: 8270 - protein, 777 aa, Escherichia coli
MANSSSRYSVLTAAHWGPMLVETDGETVFSSRGALATGMENSLQSAVRDQVHSNTRVRFPMVRKGFLASPENPQGIRGQDEFVRVSWDEALELIHHQHKRIREAYGPASIFAGSYGWRSNGVLHKASTLLQRYMALAGGYTGHLGDYSTGAAQAIMPYVVGGSEVYQQQTSWPLVLEHSDVVVLWSANPLNTLKIAWNASDEQGLSYFSALRDSGKKLICIDPMRSETIDFFGDKMEWVAPHMGTDVALMLGIAHTLVENGWHDEAFLARCTTGYAVFASYLLGESDGIAKNAEWAAEICGVGAAKIRELAAIFHQNTTMLMAGWGMQRQQFGEQKHWMLVTLAAMLGQIGTPGGGFGLSYHFANGGNPTRRAAVLSSMQGSLPGGTDAVDKIPVARIVEALENPGGAYQHNGMDRHFPDIRFIWWAGGANFTHHQDTNRLIRAWQKPELVVISECFWTAAAKHADIVLPATTSFERNDLTMTGDYSNQHLVPMKQVVPPRYEARNDFDVFADLSERWQKGGYARFTEGKSELQWLETFYNVARQRGASQQVELPPFAEFWQANQLIEMPENPDSERFIRFADFRRDPQAHPLKTASGKIEIFSQRIADYAYPDCPGHPMWLAPDEWQGSAEPEQLQVLSAHPAHRLHSQLNYSSLRELYAVANREPVTIHPDDAQTRGIQDGDTVRLWNSRGQILAGAVISEGIKPGVICIHEGAWPDLDLTAGGICKNGAVNVLTKDLPSSRLGNGCAGNTALAWLEKYTGSELTLTAFEPPASS

SEQ ID NO: 8271 - DNA, 441 bp, Escherichia coli
atgattcgggaagtgcaacgttcagaactccccgcgatcctccaactgtggctggaaagtacaacctgggggcatccctttataaaatcgagttactggcgtgactgcattccgctggtgcgggatgcgtatcttgccaacgcgcaaaactgggtctgggaagaagacggtaagcttctcggttttgtcagcattatggaaggccgattcctcgcagcaatgtttgtcgcaccgaaggccgtcagacgcggtattggtaaggcgctaatgcagtatgtgcagcagcgccatccccatctgatgctggaggtttatcaaaaaaatcaaccggcgatagatttctaccatgcgcagggttttcacattgtcgattgcgcatggcaggatgaaacccaactacccacctggattatgagctggccggtggttcaaacgctgtaa

SEQ ID NO: 8272 - protein, 146 aa, Escherichia coli
MIREVQRSELPAILQLWLESTTWGHPFIKSSYWRDCIPLVRDAYLANAQNWVWEEDGKLLGFVSIMEGRFLAAMFVAPKAVRRGIGKALMQYVQQRHPHLMLEVYQKNQPAIDFYHAQGFHIVDCAWQDETQLPTWIMSWPVVQTL

SEQ ID NO: 8273 - DNA, 660 bp, Escherichia coli
atgaagaaacgtgtttatcttattgccgccgtagtgagtggcgctctggcggtatctggctgtacaactaacccttacaccggcgaacgcgaagcaggtaaatctgctatcggcgcaggtctgggctctctcgttggcgcgggtattggtgcgctctcttcttcgaagaaagatcgcggtaaaggcgcgctcattggcgcagcagcaggcgcagctctgggcggcggcgttggttattacatggatgtgcaggaagcgaagctgcgtgacaaaatgcgcggcactggtgttagcgtaacccgcagcggggataacattatcctcaatatgccgaacaatgtgaccttcgacagcagcagcgcaaccctgaaaccggcgggcgctaacaccctgaccggcgtggcaatggtactgaaagagtatccgaaaacggcggttaacgtgattggttataccgacagcacggggagtcacgacctgaacatgcgtctctcccagcagcgtgcggattccgttgccagcgcgttgatcacccagggcgtggacgccagccgcatccgtactcaaggccttggcccggctaacccaatcgccagcaacagcaccgcagaaggtaaagcgcaaaaccgccgtgtagaaattaccttaagcccactgtaa

SEQ ID NO: 8274 - protein, 219 aa, Escherichia coli
MKKRVYLIAAVVSGALAVSGCTTNPYTGEREAGKSAIGAGLGSLVGAGIGALSSSKKDRGKGALIGAAAGAALGGGVGYYMDVQEAKLRDKMRGTGVSVTRSGDNIILNMPNNVTFDSSSATLKPAGANTLTGVAMVLKEYPKTAVNVIGYTDSTGSHDLNMRLSQQRADSVASALITQGVDASRIRTQGLGPANPIASNSTAEGKAQNRRVEITLSPL

SEQ ID NO: 8275 - DNA, 975 bp, Escherichia coli
atgaagccgtccgttatcctctacaaagccttacctgatgatttactgcaacgcctgcaagaacatttcaccgttcaccaggtggcaaacctcagcccacaaaccgtcgaacaaaatgcagcaatttttgccgaagctgaaggcttgctgggttcaaatgagaatgttgatgccgcattgctggaaaaaatgccgaaactgcgtgccacatcaacgatctccgtcggctatgacaattttgatgtcgatgcgcttaccgcccgaaaaattctgctgatgcacacaccaaccgtattaacagaaaccgtcgccgatacgctgatggcgctggtgttgtctaccgctcgtcgggttgtggaggtagcagaacgggtaaaagcaggcgaatggaccgcgagcataggcccggactggtacggcactgacgttcaccataaaacactgggcattgtcgggatgggacggatcggtatggcgctggcacaacgtgcgcactttggtttcaacatgcccatcctctataacgcgcgccgccaccataaagaagcagaagaacgcttcaacgcccgctactgcgatttggatactctgttacaagagtcagatttcgtttgcctgatcctgccgttaacggatgagacgcatcatctgtttggcgcagaacaattcgccaaaatgaaatcctccgccattttcattaatgccggacgtggcccggtggttgatgaaaatgcactgattgctgcattgcagaaaggggaaattcacgccgccgggctggatgtcttcgaacaagagccactgtccgtagattcgccgttgctctcaatggccaacgtcgtcgcagtaccgcatattggatctgccacccatgagacgcgttatggcatggccgcctgtgccgtggataatttgattgatgcgttacaaggaaaggttgaaaagaactgtgtgaatccgcacgtcgcggactaa

SEQ ID NO: 8276 - protein, 324 aa, Escherichia coli
MKPSVILYKALPDDLLQRLQEHFTVHQVANLSPQTVEQNAAIFAEAEGLLGSNENVDAALLEKMPKLRATSTISVGYDNFDVDALTARKILLMHTPTVLTETVADTLMALVLSTARRVVEVAERVKAGEWTASIGPDWYGTDVHHKTLGIVGMGRIGMALAQRAHFGFNMPILYNARRHHKEAEERFNARYCDLDTLLQESDFVCLILPLTDETHHLFGAEQFAKMKSSAIFINAGRGPVVDENALIAALQKGEIHAAGLDVFEQEPLSVDSPLLSMANVVAVPHIGSATHETRYGMAACAVDNLIDALQGKVEKNCVNPHVAD

SEQ ID NO: 8277 - DNA, 711 bp, Escherichia coli
atggcgacaggaaagtcctgctctcgctggtttgcgcctcttgcggcgttattaatggtagttagcctgagtgggtgttttgataaagaaggcgatcagcgtaaagcgtttatcgacttcctgcagaatacagtgatgcgtagcggtgaacgtctaccaaccctgactgccgatcagaaaaaacagtttggtccttttgtctctgattacgcgattctgtatggttattctcagcaggtgaatcaggcgatggattccggtctgcgcccggttgtagacagcgttaacgcaattcgcgtaccgcaggattacgttacgcaaagcggtccgctgcgtgaaatgaacggttcgctgggtgtgctggcgcaacagctgcaaaatgcgaagttgcaggccgatgctgcgcactctgcgttaaaacagagtgatgacctgaaaccggtctttgatcaggcattcaccaaagtggtaacgacgccagctgatgcattgcaaccgttgattccggcggcacaaactttcacgcaacaactggtgatggttggagactacattgctcagcaaggtactcaggtgagctttgtcgcaaatggcatccagttcccgacttcacagcaggcaagtgaatataacaaactgattgcgccattaccggcacaacatcaggcgtttaatcaggcctggactacagctgttactgcaacccaataa

SEQ ID NO: 8278 - protein, 236 aa, Escherichia coli
MATGKSCSRWFAPLAALLMVVSLSGCFDKEGDQRKAFIDFLQNTVMRSGERLPTLTADQKKQFGPFVSDYAILYGYSQQVNQAMDSGLRPVVDSVNAIRVPQDYVTQSGPLREMNGSLGVLAQQLQNAKLQADAAHSALKQSDDLKPVFDQAFTKVVTTPADALQPLIPAAQTFTQQLVMVGDYIAQQGTQVSFVANGIQFPTSQQASEYNKLIAPLPAQHQAFNQAWTTAVTATQ

SEQ ID NO: 8279 - DNA, 291 bp, Escherichia coli
atggaatataaagatccaatgcatgagctgttgagcagcctggaacagattgtttttaaagatgaaacgcagaaaattaccctgacgcacagaacaacgtcctgtaccgaaattgagcagttacgaaaagggacaggattaaaaatcgatgattttgcccgggttttgggcgtatcagtcgccatggtaaaggaatgggaatccagacgcgtgaagccttcaagtgccgaactaaaattgatgcgtttgattcaagccaacccggcattaagtaagcagttgatggaatag

SEQ ID NO: 8280 - protein, 96 aa, Escherichia coli
MEYKDPMHELLSSLEQIVFKDETQKITLTHRTTSCTEIEQLRKGTGLKIDDFARVLGVSVAMVKEWESRRVKPSSAELKLMRLIQANPALSKQLME

SEQ ID NO: 8281 - DNA, 213 bp, Escherichia coli
atgtccggtaaaatgactggtatcgtaaaatggttcaacgctgacaaaggcttcggcttcatcactcctgacgatggctctaaagacgtgttcgtacacttctctgctatccagaacgatggttacaaatctctggacgaaggtcagaaagtgtccttcaccatcgaaagcggcgctaaaggcccggcagctggtaacgtaaccagcctgtaa

SEQ ID NO: 8282 - protein, 70 aa, Escherichia coli
MSGKMTGIVKWFNADKGFGFITPDDGSKDVFVHFSAIQNDGYKSLDEGQKVSFTIESGAKGPAAGNVTSL

SEQ ID NO: 8283 - DNA, 153 bp, Escherichia coli
atgccgcagaaatatagattactttctttaatagtgatttgtttcacgcttttatttttcacctggatgataagagattcactgtgtgaattgcatattaaacaggagagttatgagctggcggcgtttttagcctgcaaattgaaagagtaa

SEQ ID NO: 8284 - protein, 50 aa, Escherichia coli
MPQKYRLLSLIVICFTLLFFTWMIRDSLCELHIKQESYELAAFLACKLKE

SEQ ID NO: 8285 - DNA, 2070 bp, Escherichia coli
atgtctgagaaaacttttctggtggaaatcggcactgaagagctgccaccaaaagcactacgcagcctggctgagtcctttgctgcgaactttactgcggagctggataacgctggcctcgcacacggcaccgttcaatggtttgcggctccacgtcgtctggcgctgaaagtggctaacctggcggaagcgcaaccggatcgtgaaatcgaaaaacgcggcccggcaattgcccaggcgttcgacgctgaaggcaaaccgagcaaagcggcagaaggctgggcgcgtggctgcggtattaccgttgaccaggccgagcgtctgaccactgacaaaggcgaatggctgctgtatcgcgcccatgtgaagggcgaaagcaccgaagcactgctgccgaatatggttgcgacttcgctggcgaaactgccgatcccgaaactgatgcgttggggcgcaagcgacgtgcacttcgtgcgtccggtgcacaccgtgaccctgctgctgggcgacaaagttattccggcaaccattctgggcattcagtccgatcgcgtgattcgcggccaccgctttatgggcgagccggaattcaccatcgataatgccgatcagtatccggaaattctgcgtgagcgcggtaaagtcatcgccgattacgaagaacgtaaagcgaagattaaagccgatgccgaagaagcggcgcgtaagattggcggtaacgctgacttaagcgaaagcctgttggaagaagtcgcttcgctggtggaatggccggttgtgctgaccgcaaaattcgaagagaaattcctcgcggtgccgtctgaagcgctggtttacaccatgaaaggtgaccagaagtacttcccggtgtatgcgaacgacggcaaactgctgccgaactttatcttcgttgccaacatcgaatcgaaagatccgcagcaaattatctctggtaacgagaaagtcgttcgtccacgtctggcggatgctgagttcttcttcaataccgaccgtaaaaaacgtctggaagataacctgccgcgcctgcaaaccgtgctgttccagcaacagctggggacgctgcgcgacaaaactgaccgcatccaggcgctggctggctggatcgccgaacagattggcgctgacgttaaccacgctacccgtgcgggcctgctgtctaagtgtgacctgatgaccaacatggtcttcgagttcaccgacacccagggcgttatggggatgcactacgcgcgtcacgatggcgaagcggaagatgtcgcggtggcgctgaatgagcagtatcagccgcgctttgccggtgatgacctgccgtccaacccggtagcctgtgcgctggcgattgctgacaagatggataccctggcgggtatattcggtatcggtcagcatccgaaaggcgacaaagacccgtttgcgttgcgtcgtgccgcacttggcgtgctgcgtattatcgttgagaagaacctcaaccttgatctgcaaacgctgaccgaagaagcggtgcgtctgtatggcgataagctgactaatgccaacgtggttgatgatgttatcgactttatgctcggtcgcttccgcgcctggtatcaggacgaaggttacaccgttgacaccatccaggcggtactggcgcgtcgtccgactcgtccggctgatttcgatgcccgtatgaaagcggtatcgcacttccgtaccctggaagcagctgcagcactggcggcggcgaacaaacgtgtatctaacattctggcgaaatctgacgaagtgctgagcgatcgcgtgaatgcctctactctgaaagagccggaagaaattaagctggctatgcaggttgtggtgctacgtgacaagctggagccgtactttgcggaaggtcgttaccaggatgcgctggtcgaactggctgagctgcgtgaaccggtcgatgctttcttcgataaagtgatggtcatggttgatgataaagaattgcgtatcaaccgtctgaccatgctggaaaaactgcgcgaactgttcctgcgcgttgcggatatttcgctgttgcagtaa

SEQ ID NO: 8286 - protein, 689 aa, Escherichia coli
MSEKTFLVEIGTEELPPKALRSLAESFAANFTAELDNAGLAHGTVQWFAAPRRLALKVANLAEAQPDREIEKRGPAIAQAFDAEGKPSKAAEGWARGCGITVDQAERLTTDKGEWLLYRAHVKGESTEALLPNMVATSLAKLPIPKLMRWGASDVHFVRPVHTVTLLLGDKVIPATILGIQSDRVIRGHRFMGEPEFTIDNADQYPEILRERGKVIADYEERKAKIKADAEEAARKIGGNADLSESLLEEVASLVEWPVVLTAKFEEKFLAVPSEALVYTMKGDQKYFPVYANDGKLLPNFIFVANIESKDPQQIISGNEKVVRPRLADAEFFFNTDRKKRLEDNLPRLQTVLFQQQLGTLRDKTDRIQALAGWIAEQIGADVNHATRAGLLSKCDLMTNMVFEFTDTQGVMGMHYARHDGEAEDVAVALNEQYQPRFAGDDLPSNPVACALAIADKMDTLAGIFGIGQHPKGDKDPFALRRAALGVLRIIVEKNLNLDLQTLTEEAVRLYGDKLTNANVVDDVIDFMLGRFRAWYQDEGYTVDTIQAVLARRPTRPADFDARMKAVSHFRTLEAAAALAAANKRVSNILAKSDEVLSDRVNASTLKEPEEIKLAMQVVVLRDKLEPYFAEGRYQDALVELAELREPVDAFFDKVMVMVDDKELRINRLTMLEKLRELFLRVADISLLQ

SEQ ID NO: 8287 - DNA, 912 bp, Escherichia coli
atgcaaaagtttgataccaggaccttccagggcttgatcctgaccttacaggattactgggctcgccagggctgcaccattgttcaaccattggacatggaagtcggcgcgggaacctctcacccaatgacctgtctgcgcgcgctggggccagaaccgatggcggctgcttatgttcagccttctcgtcgcccgaccgatggtcgctacggcgaaaaccccaaccgtttacagcactactatcagttccaggtggtcattaagccatcgccggacaatattcaggagctgtacctcggttctctgaaagagctgggcatggacccgaccatccacgacatccgtttcgtggaagataactgggaaaacccgacgctgggtgcctgggggctgggctgggaagtgtggctaaacggcatggaagtgacgcagttcacttacttccagcaggttggtggtctggaatgtaaaccggttaccggtgagatcacctacggtctggaacgtctggccatgtacattcagggcgtagacagcgtttacgacctggtctggagcgacggcccgctgggtaaaaccacctacggcgacgtgttccatcagaacgaagtggagcagtccacttacaacttcgaatacgcggatgtggacttcttgttcacctgcttcgagcagtacgagaaagaagcgcagcagttgctggcgctggaaaatccgctgccgctgccagcctacgagcgtattctgaaagccgcccacagcttcaacctgctggatgcgcgtaaagccatctccgtcaccgagcgtcagcgctacattctgcgcattcgcaccctgaccaaagcagtggcagaagcatactacgcttcccgtgaagccctcggcttcccgatgtgcaacaaagataagtaa

SEQ ID NO: 8288 - protein, 303 aa, Escherichia coli
MQKFDTRTFQGLILTLQDYWARQGCTIVQPLDMEVGAGTSHPMTCLRALGPEPMAAAYVQPSRRPTDGRYGENPNRLQHYYQFQVVIKPSPDNIQELYLGSLKELGMDPTIHDIRFVEDNWENPTLGAWGLGWEVWLNGMEVTQFTYFQQVGGLECKPVTGEITYGLERLAMYIQGVDSVYDLVWSDGPLGKTTYGDVFHQNEVEQSTYNFEYADVDFLFTCFEQYEKEAQQLLALENPLPLPAYERILKAAHSFNLLDARKAISVTERQRYILRIRTLTKAVAEAYYASREALGFPMCNKDK

SEQ ID NO: 8289 - DNA, 300 bp, Escherichia coli
atgatgatgaacgctttctttccagcaatggcgcttattgtgctagtgggttgttctacaccgccacccgtgcagaaagcacaacgggtaaaggttgatcctctgcgttcgttgaatatggaagcgttatgcaaggatcaggcggcaaaacgttataacaccggcgagcaaaaaatcgacgtcaccgccttcgaacagttccagggaagctatgaaatgcgcggttataccttccggaaagagcagtttgtctgttcttttgacgcggatggccattttttgcatctttccatgcgttaa

SEQ ID NO: 8290 - protein, 99 aa, Escherichia coli
MMMNAFFPAMALIVLVGCSTPPPVQKAQRVKVDPLRSLNMEALCKDQAAKRYNTGEQKIDVTAFEQFQGSYEMRGYTFRKEQFVCSFDADGHFLHLSMR

SEQ ID NO: 8291 - DNA, 996 bp, Escherichia coli
atgcagcccaaaatttactggattgataacctgcgagggatagcgtgtttaatggtggtgatgattcacaccactacctggtatgtgaccaatgctcatagtgttagccccatcacctgggatatcgccaatgttctgaattctgcctctcgtgtcagtgtgccgctatttttcatgatttccggctatctcttttttggcgaacgcagcgcccagtcgcgtcatttcttgcgtatcggcttatgcctgtttttttatagcgcaatcgcgctgctctacattgcgctgtttacctccatcaatgtggagttagcgctgaaaaacctgctgcaaaagccagtgttttaccatttatggtttttcttcgcgattgcagtgatttatctggtttcaccgctgattcaggtgaagaacgtcggcggaaaaatgttgctggtgctaatggtggtgattggtatcatcgctaacccaaacaccgtgccgcagaaaatcgacggttttgaatggctgccaattaacttatatatcaatggcgatactttttactacatcctttatggcatgttgggccgcgctatagggatgatggacacacagcataaagcactgtcgtgggtgagcgccgcactgtttgcgacgggggtttttattatctctcgcgggacattatatgaattacagtggcgcggaaattttgccgatacctggtatctttactgtgggccgatggtttttatctgcgcaatcgcgttattgactctggttaaaaacacgctgtatacgcgtaccatttgcggacttggcttaatctcccgccattcgttaggtatatacgggttccatgcattgattatccatgcactgcgcacccgggggattgagcttaaaaactggccaatactggatattatttggatcttttgtgcgactctggcagtgagtttattactttctatgctggtacaacgaatcgacagaaacagattagtgagttaa

SEQ ID NO: 8292 - protein, 331 aa, Escherichia coli
MQPKIYWIDNLRGIACLMVVMIHTTTWYVTNAHSVSPITWDIANVLNSASRVSVPLFFMISGYLFFGERSAQSRHFLRIGLCLFFYSAIALLYIALFTSINVELALKNLLQKPVFYHLWFFFAIAVIYLVSPLIQVKNVGGKMLLVLMVVIGIIANPNTVPQKIDGFEWLPINLYINGDTFYYILYGMLGRAIGMMDTQHKALSWVSAALFATGVFIISRGTLYELQWRGNFADTWYLYCGPMVFICAIALLTLVKNTLYTRTICGLGLISRHSLGIYGFHALIIHALRTRGIELKNWPILDIIWIFCATLAVSLLLSMLVQRIDRNRLVS

SEQ ID NO: 8293 - DNA, 438 bp, Escherichia coli
atggacaacaaaatatcaacctattctccggcatttagtattgtttcatgggtagcccttattggcggtattgttacctatctgttaggactatggaatgcagagatgcagttaaatgaaaaagggtattattttgccgtactggtattaggtttgttttccgcggcgtcttatcaaaagaccgttcgggacaagtatgaaggcatacctaccacccccatttattatatgacttgccttacggtctttattatctctgttgcgttgttgctggtaggtctatggaatgcaacgttattactcagcgaaaaaggcttttatgggctggctttcttcttaagcttgtttggtgcagtagcggtgcagaagaatattcatgatgccggaataaacccaccaaaagaaacacaggttacccaggaagaatacagcgaataa

SEQ ID NO: 8294 - protein, 145 aa, Escherichia coli
MDNKISTYSPAFSIVSWVALIGGIVTYLLGLWNAEMQLNEKGYYFAVLVLGLFSAASYQKTVRDKYEGIPTTPIYYMTCLTVFIISVALLLVGLWNATLLLSEKGFYGLAFFLSLFGAVAVQKNIHDAGINPPKETQVTQEEYSE

SEQ ID NO: 8295 - DNA, 342 bp, Escherichia coli
atgaaaacctcaaagactgttgcaaaactattatttgttgttggggcgctggtttatctggttgggctatggatctcatgcccattgttaagtggaaaaggctattttcttggcgtgttaatgacggcaacttttggcaactatgcatatcttcgcgcagaaaaacttgggcaactggatgatttttttatccacgtctgtcagttggtagcgttaatcactatcggtctcttgtttatcggtgttttaaacgcacctatcaatgcttatgaaatggtgatctatcccatcgccttttttgtctgcttgtttggtcaaatgcgtttgtttcgctcggcatga

SEQ ID NO: 8296 - protein, 113 aa, Escherichia coli
MKTSKTVAKLLFVVGALVYLVGLWISCPLLSGKGYFLGVLMTATFGNYAYLRAEKLGQLDDFFIHVCQLVALITIGLLFIGVLNAPINAYEMVIYPIAFFVCLFGQMRLFRSA

SEQ ID NO: 8297 - DNA, 1455 bp, Escherichia coli
atgtatatcgggatagatcttggcacctcgggcgtaaaagttattttgctcaacgagcagggtgaggtggttgctgcgcaaacggaaaagctgaccgtttcgcgcccgcatccactctggtcggaacaagacccggaacagtggtggcaggcaactgatcgcgcaatgaaagctctgggcgttcagcattctctgcaagacgttaaagcattaggtattgccggacagatgcacggtgcaaccttactggatgctcagcaacgggtgttacgccctgccattttgtggaacgacgggcgctgtgcgcaagagtgcactttgctggaagcgcgagttccgcaatcgcgggtgattaccggcaacctgatgatgcccggatttactgcgcctaaattgctatgggttcagcggcatgagccggagatattccgtcaaatcgataaagtattattaccgaaagattacttgcgtctgcgtatgacgggggagtttgccagcgatatgtctgacgcagctggcactatgtggctggatgtcgcaaagcgtgactggagcgatctcatgctgcaggcttgccacttatctcgtgaccagatgcccgcattatacgaaggcagcgaaattactggtgctttgttacctgaagttgcgaaagcgtggggtatggcggcggtgccagttatcgcaggcggtggcgacaatgcagctggtgcggttggtgtgggaatggttgatgctaatcaggcaatgttatcgctggggacgtcgggggtctattttgctgtcagcgaagggttcttaagcaagccagaaagcgccgtacatagcttttgccatgcgttaccgcaacgttggcatttaatgtctgtaatgctgagtgcggcttcgtgtctggattgggccgcgaaattaaccggcctgagcaatgtccctgctttaatcactgcagctcaacaggctgatgaaagtgccgagccagtttggtttctgccttatctttccggcgagcgtacaccacacaataatccccaggcgaaaggggggttctttggtttgactcatcaacatggccccaatgaactggcgcgagcagtgctggaaggcgtgggttatgcgctggcagatggcatggatgtcgtgcatgcctgcggcattaaaccgcaaagtgttacgttgattggtggcggggcgcgtagtgagtactggcgtcaaatgctggcggacatcagcggtcagcaactggattaccgcacgggtggcgatgtggggccagcactgggcgcagcaaggctggcgcagattgcggcgaatccagagaaatcgctcattgagttgttgccgcaactaccattagaacagtcgcatctaccagatgcgcagcgttatgccgcttatcagccacgacgagaaacgttccgtcgcctctatcagcaacttctgccattaatggcgtaa

SEQ ID NO: 8298 - protein, 484 aa, Escherichia coli
MYIGIDLGTSGVKVILLNEQGEVVAAQTEKLTVSRPHPLWSEQDPEQWWQATDRAMKALGVQHSLQDVKALGIAGQMHGATLLDAQQRVLRPAILWNDGRCAQECTLLEARVPQSRVITGNLMMPGFTAPKLLWVQRHEPEIFRQIDKVLLPKDYLRLRMTGEFASDMSDAAGTMWLDVAKRDWSDLMLQACHLSRDQMPALYEGSEITGALLPEVAKAWGMAAVPVIAGGGDNAAGAVGVGMVDANQAMLSLGTSGVYFAVSEGFLSKPESAVHSFCHALPQRWHLMSVMLSAASCLDWAAKLTGLSNVPALITAAQQADESAEPVWFLPYLSGERTPHNNPQAKGGFFGLTHQHGPNELARAVLEGVGYALADGMDVVHACGIKPQSVTLIGGGARSEYWRQMLADISGQQLDYRTGGDVGPALGAARLAQIAANPEKSLIELLPQLPLEQSHLPDAQRYAAYQPRRETFRRLYQQLLPLMA

SEQ ID NO: 8299 - DNA, 1323 bp, Escherichia coli
atgcaagcctattttgaccagctcgatcgcgttcgttatgaaggctcaaaatcctcaaacccgttagcattccgtcactacaatcccgacgaactggtgttgggcaagcgtatggaagagcacttgcgttttgccgcctgctactggcacaccttctgctggaacggggcggatatgtttggtgtgggggcgtttaatcgtccgtggcagcagcctggtgaggcactggcgttggcgaagcgtaaagcagatgtcgcatttgagtttttccacaagttacatgtgccattttattgcttccacgatgtggatgtttcccctgagggcgcgtcgttaaaagagtacatcaataattttgcgcaaatggttgatgtcctggcaggcaagcaagaagagagcggcgtgaagctgctgtggggaactgctaactgctttacaaaccctcgctatggcgcgggtgcggcgacgaacccagatcctgaagtcttcagttgggcggcaacgcaagttgttacagcgatggaagcaacccataaattgggcggtgaaaactatgtcctgtggggcggtcgtgaaggttacgaaacgctgttaaataccgacttgcgccaggagcgtgaacagctgggccgctttatgcagatggtggttgagcataaacataaaatcggtttccagggcacgttgcttatcgaaccgaaaccgcaagaaccgacaaaacatcaatatgattacgatgctgcgacggtctatggcttcctgaaacagtttggtctggaaaaagagattaaactgaacattgaagctaaccacgcgacgctggcaggtcactctttccatcatgaaatagccaccgccattgcgcttggcctgttcggttctgtcgacgccaaccgtggcgatgcgcaactgggctgggacaccgaccagttcccgaacagtgtggaagagaatgcgctggtgatgtatgaaattctcaaagcaggcggtttcaccaccggtggtctgaacttcgatgccaaagtacgtcgtcaaagtactgataaatatgatctgttttacggtcatatcggcgcgatggatacgatggcgttggcgctgaaaattgcagcgcgcatgattgaagatggcgagctggataaacgcatcgcgcagcgttattccggctggaatagtgaattaggccagcaaatcctgaaaggccaaatgtcactggcagatttagccaaatatgctcaggaacataatttgtctccggtgcatcagagtggtcgccaggagcaactggaaaatctggtaaatcattatctgttcgacaaataa

SEQ ID NO: 8300 - protein, 440 aa, Escherichia coli
MQAYFDQLDRVRYEGSKSSNPLAFRHYNPDELVLGKRMEEHLRFAACYWHTFCWNGADMFGVGAFNRPWQQPGEALALAKRKADVAFEFFHKLHVPFYCFHDVDVSPEGASLKEYINNFAQMVDVLAGKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAARMIEDGELDKRIAQRYSGWNSELGQQILKGQMSLADLAKYAQEHNLSPVHQSGRQEQLENLVNHYLFDK

SEQ ID NO: 8301 - DNA, 1071 bp, Escherichia coli
ttgctaaaaattggttacgtttatcgcggtgattgttacttattaaagctgtcctctaactacagaaggccctacaccatgaaaataaagaacattctactcaccctttgcacctcacttctgcttaccaacgttgcggcacacgccaaagaagtcaaaataggtatggcgattgatgatctccgtcttgaacgctggcaaaaagatcgagatatttttgtgaaaaaagcagaatctctcggcgcgaaagtatttgtacagtctgcaaatggcaatgaagaaacacaaatgtcgcagattgaaaacatgattaaccggggtgtcgatgttcttgtcattattccttataacggtcaggtattaagtaacgttgtaaaagaagccaaacaagaaggtattaaagtattagcttacgaccgtatgattaacgatgcggatatcgatttttatatttctttcgataatgaaaaagtcggtgaactgcaggcaaaagccctggtcgatattgttccgcaaggtaattacttcctgatgggcggctcgccggtagataacaacgccaagctgttccgcgccgggcaaatgaaagtattaaaaccttatgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggaggggcaattcaggcattaagcgcgcaaggtttatcagggaaagtagcaatttccggccaggatgcggatcttgcaggtattaaacgtattgctgccggtacgcaaactatgacggtgtataaacctattacattgttggcaaatactgccgcagaaattgccgttgagttgggcaatggtcaggagccaaaagcggataccacactgaataatggcctgaaagatgttccctcccgcctgctgacaccgatcgatgtgaataaaaacaacatcaaagatacggtagttaaagacggattccacaaagagagcgagctgtaa

SEQ ID NO: 8302 - protein, 356 aa, Escherichia coli
MLKIGYVYRGDCYLLKLSSNYRRPYTMKIKNILLTLCTSLLLTNVAAHAKEVKIGMAIDDLRLERWQKDRDIFVKKAESLGAKVFVQSANGNEETQMSQIENMINRGVDVLVIIPYNGQVLSNVVKEAKQEGIKVLAYDRMINDADIDFYISFDNEKVGELQAKALVDIVPQGNYFLMGGSPVDNNAKLFRAGQMKVLKPYVDSGKIKVVGDQWVDGWLPENALKIMENALTANNNKIDAVVASNDATAGGAIQALSAQGLSGKVAISGQDADLAGIKRIAAGTQTMTVYKPITLLANTAAEIAVELGNGQEPKADTTLNNGLKDVPSRLLTPIDVNKNNIKDTVVKDGFHKESEL

SEQ ID NO: 8303 - DNA, 1542 bp, Escherichia coli
atgccttatctacttgaaatgaaaaatattaccaaaaccttcggcagtgtgaaggcgattgataacgtcagcttgcggttgaatgctggcgaaatcgtctcactctgtggggaaaatgggtcaggtaaatcaacgctgatgaaagtgctgtgtggtatttatccccatggttcctacgaaggcgaaattatttttgcgggagaagagattcaggcgagtcacatccgcgataccgaacgcaaaggtatcgccattattcaccaggaattggcgctggtgaaagaactgaccgtgctggaaaatatcttcctgggtaacgaaataacccataatggcattatggattatgacctgatgacgctacgctgtcagaagctgctcgcacaggtcagtttatccatttcacctgatacccgcgttggcgatttaggacttgggcaacaacaactggttgaaattgccaaggcacttaataaacaggtgcgtttgttaattctcgatgagccgacagcctcattaactgagcaggaaacgtcggttttactggatattattcgcgatctacaacagcacggtatcgcctgtatttatatttcgcacaaactcaacgaagtcaaagcgatttccgatacgatttgcgttattcgcgacggtcagcacattggcacgcgtgatgctgctggaatgagtgaagacgatattatcaccatgatggtcgggcgggagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatactgggtattgccggactcgttggtgccggacgtaccgagaccattcagtgcctgtttggcgtgtggcccggacaatgggaaggaaaaatttatattgatggcaaacaggtagatattcgtaattgtcagcaagccatcgcccaggggattgcgatggtacccgaagacagaaagcgcgacggcatcgttccggtaatggcggttggtaaaaatattaccctcgccgcactcaataaatttaccggcggtattagccagcttgatgacgcggcagagcaaaaatgtattctggaatcaatccagcaactcaaagttaaaacgtcgtcctccgaccttgctattggacgtttgagcggcggcaatcaacaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctga

SEQ ID NO: 8304 - protein, 513 aa, Escherichia coli
MPYLLEMKNITKTFGSVKAIDNVSLRLNAGEIVSLCGENGSGKSTLMKVLCGIYPHGSYEGEIIFAGEEIQASHIRDTERKGIAIIHQELALVKELTVLENIFLGNEITHNGIMDYDLMTLRCQKLLAQVSLSISPDTRVGDLGLGQQQLVEIAKALNKQVRLLILDEPTASLTEQETSVLLDIIRDLQQHGIACIYISHKLNEVKAISDTICVIRDGQHIGTRDAAGMSEDDIITMMVGRELTALYPNEPHTTGDEILRIEHLTAWHPVNRHIKRVNDVSFSLKRGEILGIAGLVGAGRTETIQCLFGVWPGQWEGKIYIDGKQVDIRNCQQAIAQGIAMVPEDRKRDGIVPVMAVGKNITLAALNKFTGGISQLDDAAEQKCILESIQQLKVKTSSSDLAIGRLSGGNQQKAILARCLLLNPRILILDEPTRGIDIGAKYEIYKLINQLVQQGIAVIVISSELPEVLGLSDRVLVMHEGKLKANLINHNLTQEQVMEAALRSEHHVEKQSV

SEQ ID NO: 8305 - DNA, 1182 bp, Escherichia coli
atgtcgaaaagcaatccgtctgaagtgaaattagccgtaccgacatccggtggcttttccgggctgaaatcactgaatttgcaggtcttcgtgatgattgcagcgatcatcgcgatcatgctgttctttacctggaccaccgatggtgcctacttaagcgcccgtaacgtctccaacctgttacgccaaaccgcgattaccggtatcctcgcggtaggaatggtgttcgtcataatttctgctgaaatcgacctttccgtcggctcaatgatggggctgttaggtggcgtcgcggcgatttgtgacgtctggttaggctggcctttgccactgaccatcattgtgacgttggttctgggactgcttctcggtgcctggaacggatggtgggtcgcgtaccgtaaagtcccttcatttattgtcaccctcgcgggcatgttggcatttcgtggcatactcattggcatcaccaacggcacgactgtatcccccaccagcgccgcgatgtcacaaattgggcaaagctatctacctgccagcaccggcttcatcattggcgcgcttggcttaatggcttttgttggctggcaatggcgcggaagaatgcgccgtcaggctttgggtttgcagtctccggcctctaccgcagtagtcggtcgccaggctttaaccgctatcatcgtattaggcgcaatctggctgttgaatgattaccgtggtgttcccactcctgttctgctgctgacgttgctgttactcggcggaatgtttatggcaacgcggacggcatttggacgacgcatttatgccatcggcggcaatctggaagcggcacgtctctccgggattaacgttgaacgcaccaaacttgccgtgttcgctattaacggattaatggtagccatcgccggattaatcctcagttctcgactcggcgctggttcaccttctgcgggaaatatcgccgaactggacgcaattgcagcatgtgtgattggcggcaccagtctggcaggcggcgtcgggagcgtggctggagcggtaatgggggcattcatcatggcttcactggataacggcatgagtatgatggatgtaccgaccttctggcagtatatcgttaaaggtgcgattctgttgctggctgtatggatggattccgcaaccaaacgccgttcttga

SEQ ID NO: 8306 - protein, 393 aa, Escherichia coli
MSKSNPSEVKLAVPTSGGFSGLKSLNLQVFVMIAAIIAIMLFFTWTTDGAYLSARNVSNLLRQTAITGILAVGMVFVIISAEIDLSVGSMMGLLGGVAAICDVWLGWPLPLTIIVTLVLGLLLGAWNGWWVAYRKVPSFIVTLAGMLAFRGILIGITNGTTVSPTSAAMSQIGQSYLPASTGFIIGALGLMAFVGWQWRGRMRRQALGLQSPASTAVVGRQALTAIIVLGAIWLLNDYRGVPTPVLLLTLLLLGGMFMATRTAFGRRIYAIGGNLEAARLSGINVERTKLAVFAINGLMVAIAGLILSSRLGAGSPSAGNIAELDAIAACVIGGTSLAGGVGSVAGAVMGAFIMASLDNGMSMMDVPTFWQYIVKGAILLLAVWMDSATKRRS

SEQ ID NO: 8307 - DNA, 1179 bp, Escherichia coli
atgtttactaaacgtcaccgcatcacattactgttcaatgccaataaagcctatgaccggcaggtagtagaaggcgtaggggaatatttacaggcgtcacaatcggaatgggatattttcattgaagaagatttccgcgcccgcattgataaaatcaaggactggttaggagatggcgtcattgccgacttcgacgacaaacaaatcgagcaagcgctggctgatgtcgacgtccccattgttggggttggtggctcgtatcaccttgccgaaagttacccacccgttcattacattgccaccgataactatgcgctggttgaaagcgcatttttgcatttaaaagagaaaggcgttaaccgctttgctttttatggtcttccggaatcaagcggtaaacgttgggccactgaacgcgaatatgcatttcgtcagcttgtcgccgaagaaaagtatcgcggagtggtttatcaggggttagaaaccgcgccagagaactggcaacacgcgcaaaatcggctggcagactggctacaaacgctgccaccgcaaaccgggattattgccgttactgacgcccgggcgcggcatattctgcaagtatgtgaacatctacatattcccgtaccggaaaaattatgcgtgattggcatcgataacgaagaactgacccgctatctgtcgcgtgtcgccctttcttcggtcgctcagggcgcgcggcaaatgggctatcaggcggcaaaactgttgcatcgtttattggataaagaagagatgccgttgcaacggattttggtcccgccagtccgcgtgattgaacgacgctcaacagattaccgctcgctgaccgatcccgccgttattcaggccatgcattacattcgtaatcacgcctgtaaagggattaaagtggatcaggtactggatgcggtgggcatatcacgctccaatcttgagaagcgttttaaagaagaggtgggcgaaaccattcacgccatgattcatgccgaaaagctggagaaagcgcgcagcctgctgatttctactaccttgtcaattaacgagatatcgcaaatgtgcggttatccatcgctgcaatatttctactctgtttttaaaaaagcatatgacacaacgccaaaagagtatcgcgatgtaaatagcgaggtcatgttgtag

SEQ ID NO: 8308 - protein, 392 aa, Escherichia coli
MFTKRHRITLLFNANKAYDRQVVEGVGEYLQASQSEWDIFIEEDFRARIDKIKDWLGDGVIADFDDKQIEQALADVDVPIVGVGGSYHLAESYPPVHYIATDNYALVESAFLHLKEKGVNRFAFYGLPESSGKRWATEREYAFRQLVAEEKYRGVVYQGLETAPENWQHAQNRLADWLQTLPPQTGIIAVTDARARHILQVCEHLHIPVPEKLCVIGIDNEELTRYLSRVALSSVAQGARQMGYQAAKLLHRLLDKEEMPLQRILVPPVRVIERRSTDYRSLTDPAVIQAMHYIRNHACKGIKVDQVLDAVGISRSNLEKRFKEEVGETIHAMIHAEKLEKARSLLISTTLSINEISQMCGYPSLQYFYSVFKKAYDTTPKEYRDVNSEVML

SEQ ID NO: 8309 - DNA, 825 bp, Escherichia coli
atgattttgactcccatacgacgatatggggcgatgattcttatgttactcactctggtgttttcgagtgaggtgttagcgaagacgcacacaacaacagcgagtcaaaagtcccacttaactaaagctagtaataaacaggtaagcagtaaacaagagtattctcgcaatagtgcaaagagtagttcacttcctgatttgcgaaaatacccttccggaacaccaaggaaaaaggcgtttctccggactgtaatgccttacattaccagccaaaatgcggccattactgcggaacgtaactggctgatttcaaaacagtatcagggccaatggtcacctgctgagcgtgcgcgtctgaaagacatcgccaaacgctacaaggtgaagtggtctggtaatacgcgaaaaatcccgtggaataccttgcttgaacgcgtagacattatccctaccagtatggtggcgacgatggctgcagcagaaagcggttggggaacgtcaaagctggcgcgcaacaacaacaatctgttcggcatgaaatgcatgaaaggacgttgtaccaatgcgccgggtaaagtgaaagggtactcacagtttagttctgttaaagaatcggtgagcgcctatgtcactaacctcaatacgcacccggcttactcttcgttccgtaaatcgcgtgcacagctgcgtaaagcggatcaggaagtgactgccacagcgatgattcacaagctgaagggctactcgaccaaagggaagagttataacaactacctgttcgcaatgtaccaggataaccaacggttaatcgcggcgcatatgtaa

SEQ ID NO: 8310 - protein, 274 aa, Escherichia coli
MILTPIRRYGAMILMLLTLVFSSEVLAKTHTTTASQKSHLTKASNKQVSSKQEYSRNSAKSSSLPDLRKYPSGTPRKKAFLRTVMPYITSQNAAITAERNWLISKQYQGQWSPAERARLKDIAKRYKVKWSGNTRKIPWNTLLERVDIIPTSMVATMAAAESGWGTSKLARNNNNLFGMKCMKGRCTNAPGKVKGYSQFSSVKESVSAYVTNLNTHPAYSSFRKSRAQLRKADQEVTATAMIHKLKGYSTKGKSYNNYLFAMYQDNQRLIAAHM

SEQ ID NO: 8311 - DNA, 2031 bp, Escherichia coli
atgaaactcgccgcctgttttctgacactccttcctggcttcgccgttgccgccagctggacttctccggggtttcccgcctttagcgaacaggggacgggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccacctcaatggcgattgttcagggacggcgaatatacgctgcaactagacacccgctccggtacgccaacattgatgatttccctccagaacaccgtcgaaccggtagcaagcctggtccgtgaatgcccgaaatgggatggattaccgctcacactggatgtcagcgccacttttgcggagggagccgccgtccgggattattacagccagcaaattgcgatagtgaagaacggtcaaataacgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattatctccagcagttgggcgttaatgctttatggataagcgccccatttgagcaaattcacggctgggtcggcggcggtacaaaaggtgatttcccgcattatgcctatcatggttattacactcaggactggacgaatcttgatgccaatatgggcagtgaagccgatctacggacgctggttgatagcgcgcatcagcgcggtattcgtattctctttgatatcgtgatgaaccacactggctatgccacgctggcggatatgcaggagtatcagtttggcgcgttatatctttctggtgacgagctgaaaaaaacgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctggcctttttgccggatatcaaaaccgaatcaactaccgcttctggtctgccagtgttctataaaaacaaaacggatacccacgctaaagtcatcgacggctttacccctcgcgattacttaacccactggttaagtcagtgggtccgcgactatgggattgatggttttcgggtcgataccgccaaacatgttgagttgcccgcctggcagcaactgaaaaccgaagccagcgctgcacttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgattgtctggcgcagatggatacgacctggcagcaaatggcggagaaattgcaggatttcaacgtgttgagctacctctcgtcgcatgatacccgcctgttccgtgaagggggcgacaaagcagcagagttattattattagcgccaggcgcggtacaaatcttttatggcgatgaatcctcgcgtccgttcggtcctaccggttctgatccgctgcaaggtacgcgttcggatatgaactggcaggatgttagcggtaaatctgccgccagcgtcgcgcactggcagaaaatcagccagttccgcgcccgccatcccgcaattggcgcgggcaaacaaacgacactttcgctgaagcagggctacggctttgttcgtgagcatggcgacgataaagtgctggtcatctgggctgggcaacagtga

SEQ ID NO: 8312 - protein, 676 aa, Escherichia coli
MKLAACFLTLLPGFAVAASWTSPGFPAFSEQGTGTFVSHAQLPKGTRPLTLNFDQQCWQPADAIKLNQMLSLQPCSNTPPQWRLFRDGEYTLQLDTRSGTPTLMISLQNTVEPVASLVRECPKWDGLPLTLDVSATFAEGAAVRDYYSQQIAIVKNGQITLQPAATSNGLLLLERAETDTSAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGSEADLRTLVDSAHQRGIRILFDIVMNHTGYATLADMQEYQFGALYLSGDELKKTLGERWSDWKPAAGQTWHSFNDYINFSDKTGWDKWWGKNWIRTDIGDYDNPGFDDLTMSLAFLPDIKTESTTASGLPVFYKNKTDTHAKVIDGFTPRDYLTHWLSQWVRDYGIDGFRVDTAKHVELPAWQQLKTEASAALREWKKANPDKALDDKPFWMTGEAWGHGVMQSDYYRHGFDAMINFDYQEQAAKAVDCLAQMDTTWQQMAEKLQDFNVLSYLSSHDTRLFREGGDKAAELLLLAPGAVQIFYGDESSRPFGPTGSDPLQGTRSDMNWQDVSGKSAASVAHWQKISQFRARHPAIGAGKQTTLSLKQGYGFVREHGDDKVLVIWAGQQ

SEQ ID NO: 8313 - DNA, 1359 bp, Escherichia coli
ttgcaggataaagcaccgctcactcttcaacagaccgatttgcaccccagcaaatgtagcgttattgttaccttccttgctacagagttcgacagatatcccgctatgacattctccctttttggtgacaaatttacccgccactccggcattacgctgctgatggaagatctgaacgacggtttacgcacgcctggcgcgattatgctcggcggcggtaatccggcgcagatccctgaaatgcaggactacttccagacgctactgaccgacatgctggaaagtggcaaagcgactgatgcactgtgcaattatgacggtccacaggggaaaacggagctactcacactgcttgccggaatgctgcgcgagaagttgggttgggatatcgaaccacagaatattgcactaacaaacggcagccagagcgcgtttttctacttatttaatctgtttgccggacgccgtgccgatggtcgggtcaaaaaagtgctgttcccgctggcaccggaatacattggctacgctgacgccggactggaagaagatctgtttgtctctgcgcgtccgaatattgaactgctgccggaaggccagtttaaataccacgtcgattttgagcatctacatattggcgaagaaaccgggatgatttgcgtctcccggccgacgaatccaacaggcaatgtgattactgacgaagagttgctgaagcttgacgcgctggcgaatcaacacggtattccgctggtgattgataacgcttatggcgtcccgttcccgggtatcatcttcagcgaagcgcgcccgctatggaatccgaatatcgtgctgtgcatgagtctttccaagctggggctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgctatcattcgccgctatttaccggaagatcgctgcctgattcataaaccggaaggagccattttcctctggctatggtttaaggatttgcccattacgaccgagcagctctaccagcgcctgaaagcacgcggcgtgctgatggtgccggggcacaacttcttcccgggactggataaaccgtggccgcatacgcatcaatgtatgcgcatgaactacgtaccagagccggagaaaattgaggcgggtgtgaagattctggcggaagagatagaaagagcctgggctgaaagccactaa

SEQ ID NO: 8314 - protein, 452 aa, Escherichia coli
MQDKAPLTLQQTDLHPSKCSVIVTFLATEFDRYPAMTFSLFGDKFTRHSGITLLMEDLNDGLRTPGAIMLGGGNPAQIPEMQDYFQTLLTDMLESGKATDALCNYDGPQGKTELLTLLAGMLREKLGWDIEPQNIALTNGSQSAFFYLFNLFAGRRADGRVKKVLFPLAPEYIGYADAGLEEDLFVSARPNIELLPEGQFKYHVDFEHLHIGEETGMICVSRPTNPTGNVITDEELLKLDALANQHGIPLVIDNAYGVPFPGIIFSEARPLWNPNIVLCMSLSKLGLPGSRCGIIIANEKIITAITNMNGIISLAPGGIGPAMMCEMIKRNDLLRLSETVIKPFYYQRVQETIAIIRRYLPEDRCLIHKPEGAIFLWLWFKDLPITTEQLYQRLKARGVLMVPGHNFFPGLDKPWPHTHQCMRMNYVPEPEKIEAGVKILAEEIERAWAESH

SEQ ID NO: 8315 - DNA, 474 bp, Escherichia coli
atgaaccggtttattattgcggatgcgacgaaatgtatcggttgccgtacctgtgaagtggcttgcgcagtgtcgcatcaggagaatcaggattgcgctgcgttgtcaccagacgagtttatttcccgtattcgtgtcattaaagatcatacttacaccacggcagtagcctgtcatcagtgtgaagatgcaccgtgcgcaaatgtgtgccctgttgacgcgataagccgcgaacatgggcatattttcgttgaacaatcacgttgcattggctgtaaaagctgtatgctggcttgcccgtttggtgcgatggaggtcgtttcttcgcgcaaaaaggcgagggcgattaagtgcgatctgtgctggcatcgggcgacggggccggcctgtgttgaagcctgcccgacaaaggcgttgcagtgcgtggatgtcgagaaagtgcagcggcatcggctacggcagcagcctgtttga

SEQ ID NO: 8316 - protein, 157 aa, Escherichia coli
MNRFIIADATKCIGCRTCEVACAVSHQENQDCAALSPDEFISRIRVIKDHTYTTAVACHQCEDAPCANVCPVDAISREHGHIFVEQSRCIGCKSCMLACPFGAMEVVSSRKKARAIKCDLCWHRATGPACVEACPTKALQCVDVEKVQRHRLRQQPV

SEQ ID NO: 8317 - DNA, 813 bp, Escherichia coli
atggcgcaggaaaaagagcgcccagccggaagccagagtctgtttcgtgggttgatgctgattgagattttgagcaactatccaaacggttgtccgttggcgcatctttcggagctggctggtttaaataagagtaccgtccatcgcttattgcagggattacagtcctgcggctatgtgaccaccgcgcccgccgcagggagttatcgcctgaccaccaaatttattgccgtcgggcagaaggcgctatcttcgctgaatatcattcatatcgccgctccgcatcttgaggctctgaacatcgccactggtgaaactattaacttctccagccgcgaagacgatcacgctattttgatttataagttggaacccacaaccgggatgctgcgaacccgtgcctatataggccagcatatgccgctctactgttccgcaatgggcaagatctacatggcgtttggtcacccggactacgtgaagtcatactgggaaagccatcagcatgagatccagccgttaacccgcaataccattaccgagctgcccgcgatgttcgacgaactggcgcacattcgtgaaagtggagcggcgatggacagagaagaaaacgaactcggcgtctcctgtattgctgttccggtgtttgatattcatgggcgggtgccgtacgccgtgtcgatttcgctttcgacatcacgtctgaaacaggtgggagagaaaaatctcctgaaaccactgcgtgaaaccgcgcaggctatttctaatgaactgggatttactgtcagggacgaccagggcgcgattacataa

SEQ ID NO: 8318 - protein, 270 aa, Escherichia coli
MAQEKERPAGSQSLFRGLMLIEILSNYPNGCPLAHLSELAGLNKSTVHRLLQGLQSCGYVTTAPAAGSYRLTTKFIAVGQKALSSLNIIHIAAPHLEALNIATGETINFSSREDDHAILIYKLEPTTGMLRTRAYIGQHMPLYCSAMGKIYMAFGHPDYVKSYWESHQHEIQPLTRNTITELPAMFDELAHIRESGAAMDREENELGVSCIAVPVFDIHGRVPYAVSISLSTSRLKQVGEKNLLKPLRETAQAISNELGFTVRDDQGAIT

SEQ ID NO: 8319 - DNA, 999 bp, Escherichia coli
atgaaagtgacatttgagcagttaaaagcagcctttaatcgggtcttaatttcacgcggcgttgacaacgaaacggctgacgcctgtgcagagatgttcgcccgcaccaccgaatccggcgtttattctcacggcgttaatcgtttccctcgtttcattcaacaactggaaaacggcgatatcattcctgatgcccaacccaaacgtataaccagcctcggcgcaattgaacagtgggacgcccagcgttcgatcggtaacctgacagcgaaaaagatgatggatcgcgccattgaactggctgccgatcacggtattggtctggtggcactacgtaatgccaaccactggatgcgcggcggcagctacggctggcaggcggcggaaaaaggctatattggcatttgctggaccaactccatcgccgtaatgccaccgtggggcgcaaaagagtgtcgcatcggcaccaacccgctgatcgtcgccattccttccacgccgatcaccatggtcgatatgtcgatgtcgatgttctcttacggcatgttagaagttaatcgcctggctggtcgtcagctcccggtagatggtggctttgatgatgagggcaatttgaccaaagaacctggcgttatcgagaaaaatcgccgcattttgccgatgggctactggaaaggttcgggcatgtcgattgtgctggatatgatcgctaccctcctttctgacggcgcatcggttgccgaagtcaccgaggacaacagcgacgaatacggcatttcacaaatttttattgccattgaagtggacaagcttatcgacggtcccacccgcgatgccaaactgcaacgcattatggattacgttaccagtgccgagcgtgctgacgaaaaccaggctattcgtttacccggccacgaatttactaccctgctggcagaaaaccgccgtaacggtattaccgttgatgacagcgtgtgggcaaaaatccaggcgttataa

SEQ ID NO: 8320 - protein, 332 aa, Escherichia coli
MKVTFEQLKAAFNRVLISRGVDNETADACAEMFARTTESGVYSHGVNRFPRFIQQLENGDIIPDAQPKRITSLGAIEQWDAQRSIGNLTAKKMMDRAIELAADHGIGLVALRNANHWMRGGSYGWQAAEKGYIGICWTNSIAVMPPWGAKECRIGTNPLIVAIPSTPITMVDMSMSMFSYGMLEVNRLAGRQLPVDGGFDDEGNLTKEPGVIEKNRRILPMGYWKGSGMSIVLDMIATLLSDGASVAEVTEDNSDEYGISQIFIAIEVDKLIDGPTRDAKLQRIMDYVTSAERADENQAIRLPGHEFTTLLAENRRNGITVDDSVWAKIQAL

SEQ ID NO: 8321 - DNA, 465 bp, Escherichia coli
atgatttttggacatatcgcgcagcctaatccgtgccgtttgcccgccgccattgaaaaggcgctcgattttctgcgcaccaccgacttcaacgccctggaaccgggcgttgtcgaaatcgacggcaagaatatttatgcgcaaattatcgatttaaccacacgcgaggcggtagaaaaccgtccggaagtgcatcgtcggtatatcgatattcagtttctggcgtggggtgaagagaaaatcggcattgccattgatacgggaaacaataaagtcagcgaatcactattagagcagcgcgatattattttttatcacgatagtgaacatgaatcatttatagaaatgataccgggtagttacgctattttcttcccgcaggatgtacatcgcccggcatgtaataaaaatgccactacggcaatacgcaagatcgtggttaaagtggccctcgctgctttataa

SEQ ID NO: 8322 - protein, 154 aa, Escherichia coli
MIFGHIAQPNPCRLPAAIEKALDFLRTTDFNALEPGVVEIDGKNIYAQIIDLTTREAVENRPEVHRRYIDIQFLAWGEEKIGIAIDTGNNKVSESLLEQRDIIFYHDSEHESFIEMIPGSYAIFFPQDVHRPACNKNATTAIRKIVVKVALAAL

SEQ ID NO: 8323 - DNA, 921 bp, Escherichia coli
atgaaaacgaataatgccggttatattatcggcgcgtatccctgtgcaccttcttttcaccaaagaagtgaagaggaagagaaggatttctggcgacaattatctgagactccagacattttggggctggaacaaccttgcctggaaaattttcacccgctgggcgatcaatggttactccgtcatacgccagagagctggaaatttgtcgtcaccgcagtgatggaaaccatgcgtcgccgcagcgaaaacagcgggtttggtctcgcctccagtgatgaagaacagcgccaggcctgcgtggcgtactatcgccacctgttcaataaaatcaactcattgcaggctaataaagtgctcgcactggagctccaggctgcaccgttagcaacgaatcctaatgttatgcaagcgacggacgcttttgcccgctcattgaaagaaatcgccagttgggactggccgtgcaagctggtgctggaacactgcgacgccatgacatcttcttccccccgaaaaggctttttgcctttagaaaatgtgctggaagttattaccgattatgacatcagcatctgtatcaactgggcgcgctctgccattgaagggcgcaatacaacgctgccgctgacccacacccaaatggcgaaacaagccggaaaactcggcgcgttaatgttctctggtacgacgctaaacggggcatacggcgaatggcaggatttacacgcaccgtttgcaccattctgcgcagaaagcctgatgaccacagatcatgttcgcgagttatttaatgtagcagaatcgtcaacattgcattttgctgggatcaagctactggaaataaatgcgacggctgatgtgcaccatcgcatcgaaatattacgcaacggcattcactctctgaatgaatctcgttaa

SEQ ID NO: 8324 - protein, 306 aa, Escherichia coli
MKTNNAGYIIGAYPCAPSFHQRSEEEEKDFWRQLSETPDILGLEQPCLENFHPLGDQWLLRHTPESWKFVVTAVMETMRRRSENSGFGLASSDEEQRQACVAYYRHLFNKINSLQANKVLALELQAAPLATNPNVMQATDAFARSLKEIASWDWPCKLVLEHCDAMTSSSPRKGFLPLENVLEVITDYDISICINWARSAIEGRNTTLPLTHTQMAKQAGKLGALMFSGTTLNGAYGEWQDLHAPFAPFCAESLMTTDHVRELFNVAESSTLHFAGIKLLEINATADVHHRIEILRNGIHSLNESR

SEQ ID NO: 8325 - DNA, 468 bp, Escherichia coli
atgaaacggatactcgaaggcattcttgcgatcatcatcgcaatactgtcttgtattatttttattaatatcattcttcgatatggattccacacaagtatattatcgattgatgaattatcccgacttttatttgtctggttaacctttattggcgcaatcgttgcttatatggacaacagccatgtgcaggttacttttttagtcgaaaaactctcaccggctaatcaacaacgtgtttcgctgctaacccatacgctcattttattgctgtgtctggggctggcctggggcgctatagaaaaaacagcgcaagactggagcaacttatcgcccattcttggcgtccccattggcttaatgtacgccgccgctatccccaccagtctgattatcgcattgctggaattgcgtcacttataccggcagttcacaaatacccccagccgaaaccaacaaggagcctga

SEQ ID NO: 8326 - protein, 155 aa, Escherichia coli
MKRILEGILAIIIAILSCIIFINIILRYGFHTSILSIDELSRLLFVWLTFIGAIVAYMDNSHVQVTFLVEKLSPANQQRVSLLTHTLILLLCLGLAWGAIEKTAQDWSNLSPILGVPIGLMYAAAIPTSLIIALLELRHLYRQFTNTPSRNQQGA

SEQ ID NO: 8327 - DNA, 1278 bp, Escherichia coli
atgacaatccttatatttattgtcagtttgttaggggctatcgcaattggcgttcccatcgcctgggcattattactgtgcggcatttcattgatgttctggatggatatctttgatgtgcaaattctggcacaaacgttggtaaatggcgcagacagcttctccctgttagccatccccttctttgtactggcgggtgagatcatgaacgcgggcggcctgtcgcaacgtatcgtcgacttgccaatgaaactggtaggccacaggccaggcggtctgggttacgtgggcgtgctggcagcgatgatcatggcaagcctgtccggttctgcggttgctgataccgcagctgtcgcggcgctgctggtgccgatgatgcgccaggccaactatccggtaaaccgcgccgccgggcttatcggttccggggggattattgcggccattatcccgccttccataccactcattatcttcggcgtctccagcggactctccatcagcaaactgtttatggcgggcattgcgccaggcatcatgatgggcgtcacgctgatggttacctggtggtggcaggcaaaacgactgaatttaccttgtcagccgaaagcctcactgcgagaagtctggcaatccttagtttccggtatttgggcgctctttttaccgataattattattggcggtttccgttcggggttatttacaccgaccgaagcaggcgcggttgccgccttctacgctctgttcgtctcggtggtggtctatcgcgagatgaccttctccacgctttatcatgtgctgattaacgcggcaaaaaccacatccgtggtgatgttcctggtggcctctgctgcggtatctgcatggcttattacgatcgccgaattacccatgatggtatcggagctattacaaccgttggttgattcgcctcgcttattattcatcgtcattatgctcgctattatggtgatcagtacggtcatggacttaacgcctaccgtattaattcttacaccagtattaatgccattagtgaaagaagcgggaatagatccggtctatttcggcatcatgtttattatcaactgttcaatatcactgattacgcctccagtcggtaatgttcttaacgtggtatgcggcgtggcgaaacttaaatttgacgatgcggtaaaaggcgttgcgccttacgtcatggttttattcatgttgttagcattatttatttttataccggagctcattaccgctcctcttaaatggatgagttaa

SEQ ID NO: 8328 - protein, 425 aa, Escherichia coli
MTILIFIVSLLGAIAIGVPIAWALLLCGISLMFWMDIFDVQILAQTLVNGADSFSLLAIPFFVLAGEIMNAGGLSQRIVDLPMKLVGHRPGGLGYVGVLAAMIMASLSGSAVADTAAVAALLVPMMRQANYPVNRAAGLIGSGGIIAAIIPPSIPLIIFGVSSGLSISKLFMAGIAPGIMMGVTLMVTWWWQAKRLNLPCQPKASLREVWQSLVSGIWALFLPIIIIGGFRSGLFTPTEAGAVAAFYALFVSVVVYREMTFSTLYHVLINAAKTTSVVMFLVASAAVSAWLITIAELPMMVSELLQPLVDSPRLLFIVIMLAIMVISTVMDLTPTVLILTPVLMPLVKEAGIDPVYFGIMFIINCSISLITPPVGNVLNVVCGVAKLKFDDAVKGVAPYVMVLFMLLALFIFIPELITAPLKWMS

SEQ ID NO: 8329 - DNA, 987 bp, Escherichia coli
atgaaattacgttctgtaacctacgctttattaattgccggagtggcgacgttcagcacatcttctctggcggcacaatcattacgtttcggttatgaaacctcacaaaccgattcacaacatattgcggcgaaaaaatttaatgaattactgcaggaaaaaaccaaaggcgaactgaaattaaaactgttcccggatagcacccttggtaatgcgcaggcgatgatcagcggcgtgcgtggcggcactattgatatggagatgtctggctctaacaactttacgggactctcgcccgtcatcaacctgctcgatgtcccgttcctgttccgcgataccgctcacgcgcataaaacgctcgacggcaaagtcggtgatgacctgaaagtctcccttgaaggtaaggggctgaaagtactggcctactgggaaaacggctggcgcgatgtcaccaactcgcgtgcaccggtcaaaacgcctgccgacctgaaaggattgaaaatccgcaccaacaacagcccgatgaatatcgctgcatttaaagtttttggcgctaacccgatcccgatgccgtttgccgaagtctataccgggctggaaacccgcactatcgacgctcaggaacacccgatcaacgtcgtctggtcagcaaaattttatgaagtgcagaagtacctttctctgacccatcacgcctattcgccgcttctggtggtgatcaacaaagcgaagtttgatggcttaaccccggagttccagcaagcactgatctcatctgcacaggaagcgggtagctatcagcgcaaactggtcgccgaagatcagcaaaaaatcatcgacggtatgaaagaagcgggcgtggaagtcatcaccgatctcgaccgcaaagcctttagcgatgcgctgggtacccaggtccgtgacatgtttgttaaagatgttccgcagggtgctgatctgctgaaagccgtggatgaggtgcaataa

SEQ ID NO: 8330 - protein, 328 aa, Escherichia coli
MKLRSVTYALLIAGVATFSTSSLAAQSLRFGYETSQTDSQHIAAKKFNELLQEKTKGELKLKLFPDSTLGNAQAMISGVRGGTIDMEMSGSNNFTGLSPVINLLDVPFLFRDTAHAHKTLDGKVGDDLKVSLEGKGLKVLAYWENGWRDVTNSRAPVKTPADLKGLKIRTNNSPMNIAAFKVFGANPIPMPFAEVYTGLETRTIDAQEHPINVVWSAKFYEVQKYLSLTHHAYSPLLVVINKAKFDGLTPEFQQALISSAQEAGSYQRKLVAEDQQKIIDGMKEAGVEVITDLDRKAFSDALGTQVRDMFVKDVPQGADLLKAVDEVQ

SEQ ID NO: 8331 - DNA, 1497 bp, Escherichia coli
atgacgcaatactggctggggttagattgtggcggtagctggctgaaagccgggctgtatgaccgagaaggccgggaggcgggcgtgcagcgcctgccgctgtgcgcattaagtccacagccaggctgggcagagcgcgacatggcagaactgtggcaatgttgcactgctgtcattcgcgccctgcttacccattctggcgtcagcggggaacaaattgtcggtatcggcatctccgcgcagggaaagggcttatttctacttgataaaaacgacaaaccgctcggtaacgccattttgtcctcggatcgccgggcgatggaaatcgttcgtcgctggcagaaagatggcatcccggaaaaactctatccgctgacccgacaaaccttatggaccgggcatccggtgtcgctgttacgctggctgaaagagcacaaaccagaacgctacgcgcaaattggctgcgtgatgatgacgcacgactacctgcgctggtgtttaaccggcgtcaaaggttgcgaagagagcaatatttctgagtccaatctctacaacatgggtcgcggggaatatgacccgtaccttaccgactggctggggatcgctgaaatcaatcacgccctgccgcctgttgtcggatctgccgaaatctgcggggaaatcaccgctcagacagccgtactgaccggtctgaaagcgggtacccccgttgtcggcggcctgtttgatgtggtttccaccgcactctgcgccggactcgaagacgaattcaccctcaatgcggtgatggggacctgggcggtgaccagcggcataacccacggtttacgtgacggtgaagcgcatccgtatgtctatggtcgctacgttaacgatggtcaatttatcgttcacgaagccagccccacctcttccggcaatctcgaatggtttaccgcacagtggggagaaatctcatttgctgagattaatcaggccgttgccagtttgccgaaagccggtggcgatctcttcttcctgccgttcctgtacggcagcaacgccggactcgaaatgaccagtggtttctacgggatgcaggccattcacacccgtgcacacctcttacaggccatctatgaaggggtggtgttcagccatatgacccatctcaaccggatgcgcgaacgttttactgatgtgcacaccctgcgcgtcactggcggcccggcgcactccgatgtctggatgcaaatgctggcggacgtcagcggtctgcgtatcgagctgccgcaggtggaagaaaccggctgctttggtgcggcacttgccgcccgcgtcggtaccggggtttatcgcgatttcagcgaagcccaacgtgacttgcgacacccggtacgcaccctgctgccggatatggccgcccatcagctttaccaacaaaaataccaacgctatcaacatctcattaccgcacttcagggttatcacgcccgcatcaaggagcacacattatga

SEQ ID NO: 8332 - protein, 498 aa, Escherichia coli
MTQYWLGLDCGGSWLKAGLYDREGREAGVQRLPLCALSPQPGWAERDMAELWQCCTAVIRALLTHSGVSGEQIVGIGISAQGKGLFLLDKNDKPLGNAILSSDRRAMEIVRRWQKDGIPEKLYPLTRQTLWTGHPVSLLRWLKEHKPERYAQIGCVMMTHDYLRWCLTGVKGCEESNISESNLYNMGRGEYDPYLTDWLGIAEINHALPPVVGSAEICGEITAQTAVLTGLKAGTPVVGGLFDVVSTALCAGLEDEFTLNAVMGTWAVTSGITHGLRDGEAHPYVYGRYVNDGQFIVHEASPTSSGNLEWFTAQWGEISFAEINQAVASLPKAGGDLFFLPFLYGSNAGLEMTSGFYGMQAIHTRAHLLQAIYEGVVFSHMTHLNRMRERFTDVHTLRVTGGPAHSDVWMQMLADVSGLRIELPQVEETGCFGAALAARVGTGVYRDFSEAQRDLRHPVRTLLPDMAAHQLYQQKYQRYQHLITALQGYHARIKEHTL

SEQ ID NO: 8333 - DNA, 663 bp, Escherichia coli
atgagtcgaccacttctgcaactggccctcgaccactcatcacttgaagccgcgcagcgcgacgtgacgcggttaaaagacagcgtcgatattgtcgaagcaggcaccattctctgtttaaacgaagggcttggcgccgtgaaagccttgcgcgaacagtgccctgacaaaatcatcgttgccgactggaaggtcgccgacgcgggtgaaacgctcgcgcaacaggcatttggcgcaggcgctaactggatgaccatcatctgcgccgcgccgctcgccacggtggaaaaaggccacgcgatggcgcaacgctgcggcggtgaaatccagatcgagctgttcggcaactggacgctggacgatgcccgtgactggcatcgtattggcgtgcggcaggccatttatcatcgtggtcgtgacgcgcaggccagcgggcaacagtggggcgaggccgatctggcacgcatgaaggcgctttccgatatcggccttgagctttccattaccggcgggattacccctgctgacctgccgctgtttaaagagatccgcgtgaaagcgtttattgccggacgggcgctggcaggcgcagcaaatccggcgcaagtggctggcgatttccatgcgcaaatcgactccatctggggaggcaagcgtgcgtaa

SEQ ID NO: 8334 - protein, 220 aa, Escherichia coli
MSRPLLQLALDHSSLEAAQRDVTRLKDSVDIVEAGTILCLNEGLGAVKALREQCPDKIIVADWKVADAGETLAQQAFGAGANWMTIICAAPLATVEKGHAMAQRCGGEIQIELFGNWTLDDARDWHRIGVRQAIYHRGRDAQASGQQWGEADLARMKALSDIGLELSITGGITPADLPLFKEIRVKAFIAGRALAGAANPAQVAGDFHAQIDSIWGGKRA

SEQ ID NO: 8335 - DNA, 894 bp, Escherichia coli
atgcgcaaatcgactccatctggggaggcaagcgtgcgtaatcatccgttaggcatttatgaaaaagcgctggcgaaagatctctcctggccggagcggctggtgctggcaaaaagctgtggttttgattttgtcgaaatgtcggtggatgaaaccgacgaacggttgtcacgtcttgactggagcgccgcacaacgtgcttcgctggtcactgcgatgatcgaaacgggtgttgctattccgtcaatgtgcctgtccgcacatcgtcgttttccttttggtagccgggacgacgccgtgcgccagcgggcgcgggagattatgagtaaagcgattcgcctggcgcgcgatctcggcattcgtactattcaactggcaggttacgacgtctattacgaggatcatgacgaaggcacccagcaacggtttgctgaagggctggcgtgggcggttgaacaggcagcggcatcacaagtcatgctggcggtggagattatggacaccgcgtttatgaactctatcagcaaatggaaaaagtgggacgaaatgcttgcgtcaccgtggttcaccgtttacccggacgtaggcaatctcagcgcctggggcaatgatgttcccgccgaactgaaactgggcatcgaccgtatcgccgccatccacctgaaagacactcaacccgttaccgaacatagccccggacagttccgcgatgtgccgtttggcgaaggctgtgtcgattttgttggcatcttcaaaacgctgcatgagctgaactatcgcggatcatttctgattgaaatgtggaccgaaaaagccaaagagccggtgctggagattattcaggcgcggcgctggattgaagcgcgtatgcaggaggccggatttatatgttag

SEQ ID NO: 8336 - protein, 297 aa, Escherichia coli
MRKSTPSGEASVRNHPLGIYEKALAKDLSWPERLVLAKSCGFDFVEMSVDETDERLSRLDWSAAQRASLVTAMIETGVAIPSMCLSAHRRFPFGSRDDAVRQRAREIMSKAIRLARDLGIRTIQLAGYDVYYEDHDEGTQQRFAEGLAWAVEQAAASQVMLAVEIMDTAFMNSISKWKKWDEMLASPWFTVYPDVGNLSAWGNDVPAELKLGIDRIAAIHLKDTQPVTEHSPGQFRDVPFGEGCVDFVGIFKTLHELNYRGSFLIEMWTEKAKEPVLEIIQARRWIEARMQEAGFIC

SEQ ID NO: 8337 - DNA, 696 bp, Escherichia coli
atgttagagcaactgaaagctgacgtgctggcggcaaacctggcgcttcccgttcatcatctggtgacgttcacctggggcaatgtcagcgcgatagacgaaacgcggcaatggatggtgattaagccttccggcgttgagtatgaggtaatgaccgccgacgatatggtggtggttgagatagccagcggcaaggtggtggaaggcagcaaaaagccctcttccgacacgccaacgcatctggcgctttaccgtcgctttgcggagattggcggcatagtgcatacccactcgcgccacgccaccatctggtcgcaggtcggacttgatctccccgcctggggcactactcacgccgattatttttacggagccatcccctgcacgcgcctgatgaccgcagaagagatcaacggcgagtatgaataccagaccggcgaagtgatcattaaaaccttcgaagagcgtgggttgaacccggcacaaatcccggcggtactggtgcattctcacggcccgttcgcctggggaaaaaatgccgccgatgcggtgcataacgccgtggtactggaagagtgcgcctatatgggtctgttctcgcgccagcttgcgccacagctccctgcgatgcaaaacgaactgctggataagcactacctgcgtaagcatggggccaatgcctattacgggcagtag

SEQ ID NO: 8338 - protein, 231 aa, Escherichia coli
MLEQLKADVLAANLALPVHHLVTFTWGNVSAIDETRQWMVIKPSGVEYEVMTADDMVVVEIASGKVVEGSKKPSSDTPTHLALYRRFAEIGGIVHTHSRHATIWSQVGLDLPAWGTTHADYFYGAIPCTRLMTAEEINGEYEYQTGEVIIKTFEERGLNPAQIPAVLVHSHGPFAWGKNAADAVHNAVVLEECAYMGLFSRQLAPQLPAMQNELLDKHYLRKHGANAYYGQ

SEQ ID NO: 8339 - DNA, 1539 bp, Escherichia coli
atgaccaataatcccccttcagcacagattaagcccggcgagtatggtttccccctcaaattaaaagcccgctacgacaactttatcggtggcgaatgggtagcgcctgccgatggcgagtattaccagaacctgacgccggtgaccgggcagctactgtgcgaagtggcgtcttcgggcaaacgagacatcgatctggcgctggatgctgcgcataaagtgaaagataaatgggcgcacacctcggtgcaggatcgcgcggcgattctgtttaagattgccgatcgaatggaacaaaaccttgaacttttagcgacggcagaaacctgggataacggcaaacccattcgcgaaaccagtgctgccgacgtgccgctggcgattgatcattttcgctatttcgcctcgtgtattcgggcgcaggaaggtgggatcagtgaagtggatagcgaaaccgtggcctatcatttccatgaaccgttaggcgtggtggggcagattatcccgtggaacttcccgctgctgatggcgagctggaaaatggctcccgcgctggcggctggcaactgtgtggtgctgaaacccgcacgtcttactccgctttctgtactgctgctaatggaaatcgtcggtgatttactgccgccaggggtggtgaacgtggtcaacggcgcaggtggggaaattggcgaatatctggcgacctcgaaacgcatcgccaaagtggcgtttaccggctcaacggaagtgggccaacaaattatgcaatacgccacgcaaaacattattccggtgacgctggagctgggcggcaaatcgccaaatatcttctttgctgatgtgatggatgaagaagatgcctttttcgataaagcgctggaaggctttgcactgtttgcctttaaccagggcgaagtttgcacctgtccaagccgtgctttagtgcaggagtctatctacgaacgctttatggaacgcgctatccgccgtgtcgaaagcattcgcagcggtaacccgctcgacagcgtgacgcaaatgggcgcgcaggtttctcacgggcaactggaaaccatcctcaactacattgatatcggtaaaaaagagggcgctgatgtgctcaccggcgggcgacgcaagctgctggaaggcgaactgaaagacggctactacctcgaaccgacgattctgtttggtcagaacaatatgcgcgtgttccaggaggagatttttggcccggtgctggcggtaaccaccttcaaaacgatggaagaagcgctggagctggcgaacgatacgcaatatggtctgggcgcgggcgtctggagccgcaacggtaatctggcctataagatggggcgcggcattcaggcagggcgcgtgtggaccaactgttatcacgcttacccggcacatgcggcgtttggcggctacaaacaatcaggcattggccgtgaaacccacaaaatgatgcttgagcattaccagcaaaccaagtgcctgctggtgagctactcggataaaccgttggggctgttctga

SEQ ID NO: 8340 - protein, 512 aa, Escherichia coli
MTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 8341 - DNA, 1137 bp, Escherichia coli
gtggcgtggacgcttacccgtctggcgcgcaacgcggcgatccaacgaattaattattgcaatgaagcgggtgaacaggccggattcaacattaccccggtgattgcagaagcgtgcgagcttgtcgacaaacgtgctaccgcgctggcgctgaaagatcagactgaacggttacgcggggccggagccgagttaagccagttacgcctggaagagccgatcaccagctcccagctggaaggtgcgaatactacaacgctggtggcgagaaaaatgctggaaacagggcggtcgccacgcactgaagacgagcatatgattgcgggaaatgcccggctgatggcggaaattccgcacttactcgcagaaccgctgacacctgcgcttattcgccagttacatgccattggtatgggtggaatcaatgacgcgaaatatcgtccgggagaatttcgtgaaacagatgatgttgtgatcgccgactatgatggcaatatagtgcatcaaccgtccgctgcggcattgttaccggaacggctggaaaaagtttgccagtggttaaacagccatgaagggtatattcatccgttggtccgtgcctgcattctgcattttatgctggcccatgaacatccatttcgcgatggcaacgggcgcaccagtcgggcgctgttttactggtatatgctgaaatcgggctacgatgtctttaaatatatttccatcagcagtttgcttcatgctgcaccggtcaaatatgccgccagctaccagtacactgaatcagatggtatggatctgacttatttccttgaatatcaggcgggtgtcattaaacgtgctctgcaaaactggcagcagcatatcgatgaaattacacaacgaagcgcaaaactcgatagtgtgctgtttagctctggtgtgcttaaacgcctgaatccgcgccaggtaacgctcctgaatgtgatgctcgccaatccggggaaagagtacacagttgctgaaattagtgtgagtctgagcgtctcggataatacggcgcggaccgatttacggacaattgttaaagaaggattcgcgcaagagaaaagaattaataaccagcaagcagtgtacgtcgcacactacccgctgtag

SEQ ID NO: 8342 - protein, 378 aa, Escherichia coli
MAWTLTRLARNAAIQRINYCNEAGEQAGFNITPVIAEACELVDKRATALALKDQTERLRGAGAELSQLRLEEPITSSQLEGANTTTLVARKMLETGRSPRTEDEHMIAGNARLMAEIPHLLAEPLTPALIRQLHAIGMGGINDAKYRPGEFRETDDVVIADYDGNIVHQPSAAALLPERLEKVCQWLNSHEGYIHPLVRACILHFMLAHEHPFRDGNGRTSRALFYWYMLKSGYDVFKYISISSLLHAAPVKYAASYQYTESDGMDLTYFLEYQAGVIKRALQNWQQHIDEITQRSAKLDSVLFSSGVLKRLNPRQVTLLNVMLANPGKEYTVAEISVSLSVSDNTARTDLRTIVKEGFAQEKRINNQQAVYVAHYPL

SEQ ID NO: 8343 - DNA, 1152 bp, Escherichia coli
atggcagcttcaaccttttttattccttccgtgaatgttattggtgctgattcattgaatgatgcaatgaatatgatggcagattatggatttacccgtaccttaattgtcaccgacaatatgttaacgaaattgggtatggcgggtgatgtgcaaaaagcactggaagaacgcaatatttttagcgttatttatgatggcacccaacctaaccccaccacggaaaacgtcgccgcaggtttgaaattacttaaagaaaataattgcgatagcgtgatttctttaggcggtggttctccacacgactgcgcaaaaggtattgcgctggttgcagccaacggcggtgacatccgcgattatgaaggcgttgaccgctctgcaaaaccgcagctgccgatgatcgccatcaacaccacggcgggtacggcctctgaaatgacccgtttctgcatcatcactgacgaagcgcgtcacatcaaaatggcgattgtggataaacatgtaactccgctgctttctgtcaatgactcctctctgatgattggtatgccgaagtcactgaccgccgcaacgggtatggatgccttaacgcacgctatcgaagcgtatgtttctattgccgccacgccgatcactgacgcttgtgcactgaaagccgtgaccatgattgccgaaaacctgccgttagccgttgaagatggcagtaatgcgaaagcgcgtgaagcaatggcttatgcccagttcctcgccggtatggcgttcaataatgcttctctgggttatgttcatgcgatggcgcaccagctgggcggtttctacaacctgccacacggtgtatgtaacgccgttttgctgccgcatgttcaggtattcaacagcaaagtcgccgctgcacgtctgcgtgattgtgccgctgcaatgggcgtgaacgtgacaggtaaaaacgacgcggaaggtgctgaagcctgcattaacgccatccgtgaactggcgaagaaagtggatatcccggcaggcctacgcgacctgaacgtgaaagaagaagatttcgcggttctggcgactaatgccctgaaagatgcctgcggctttactaacccgattcaggcaactcacgaagaaattgtggcgatttatcgcgcagcgatgtaa

SEQ ID NO: 8344 - protein, 383 aa, Escherichia coli
MAASTFFIPSVNVIGADSLNDAMNMMADYGFTRTLIVTDNMLTKLGMAGDVQKALEERNIFSVIYDGTQPNPTTENVAAGLKLLKENNCDSVISLGGGSPHDCAKGIALVAANGGDIRDYEGVDRSAKPQLPMIAINTTAGTASEMTRFCIITDEARHIKMAIVDKHVTPLLSVNDSSLMIGMPKSLTAATGMDALTHAIEAYVSIAATPITDACALKAVTMIAENLPLAVEDGSNAKAREAMAYAQFLAGMAFNNASLGYVHAMAHQLGGFYNLPHGVCNAVLLPHVQVFNSKVAAARLRDCAAAMGVNVTGKNDAEGAEACINAIRELAKKVDIPAGLRDLNVKEEDFAVLATNALKDACGFTNPIQATHEEIVAIYRAAM

SEQ ID NO: 8345 - DNA, 1845 bp, Escherichia coli
atgattattgcgactgccggacacgttgaccacggcaaaacaaccttgttgcaggcgattacgggcgtaaatgccgaccgtctgccggaagaaaaaaagcgcggcatgaccatcgatctcggctatgcctactggccgcagccggatggtcgcgtgcctggttttatcgacgtacccggtcatgaaaagtttctttccaacatgctggcgggcgttggtggtattgatcacgcgctgttggtggtggcgtgcgatgacggcgtgatggcacagacccgtgagcatctggcgattttgcagctgaccggtaacccgatgctgacagtggcgctgaccaaagccgatcgcgtggacgaagcgcgtgttgatgaggttgaacgccaggtaaaggaggtgctgcgggaatacggttttgctgaggcaaaactgtttatcaccgcagcaaccgaaggtcggggaattgatgccctgcgcgagcatctgcttcagttaccagaacgtgaacacgccagccaacatagtttccgcctcgcgatcgaccgtgcatttaccgtaaaaggtgccgggctggtcgtcaccggtacggcgttaagcggggaagtgaaggtaggcgattcactatggctgactggtgtaaataaaccgatgcgcgtgcgtgcgctacatgcgcaaaatcagccaacagaaactgcccatgccgggcagcgtatcgcgcttaacatcgcgggtgatgcggaaaaagagcagattaaccgtggcgactggctgcttgccgatgtgccgccggagccgttcacacgggtgattgtcgagcttcaaacccatacaccgctgacccagtggcagccgctgcatattcaccacgccgccagccacgttacgggacgcgtttcgctgctggaagataaccttgccgagctggtgttcgacacgccgctgtggctggcggataacgatcgcttagtgctgcgcgatatctcggcccgcaacacgctggcgggggcgcgtgtggtgatgcttaacccgccgcgccgcggtaagcgtaagccggaatatctgcaatggctggcgtctcttgcacgggcgcagagcgatgccgatgcgttatctgttcatctggaacgcggcgcggttaaccttgcggatttcgcctgggcacggcagctcaacggcgaagggatgcgcgaactgctgcaacagcctggttatattcaggctggttacagcttgttgaatgcgccagttgccgcccgctggcagcggaaaattctcgacacattagcgacttatcatgagcaacatcgcgatgaacctggtcctgggcgcgaacgtctgcgacgtatggcgttgccaatggaagatgacgcgctggtactgttgctgattgaaaagatgcgcgaaagcggcgacatccacagccatcacggctggctgcatctgccggatcataaagcgggcttcagcgaagagcagcaggccatctggcaaaaagcagagccgctgtttggtgacgagccatggtgggtgcgtgacctggcaaaagagacgggaaccgacgagcaggcaatgcgcctgacgctacgccaggcggcgcaacaggggataattactgcgatcgtcaaagatcgttattaccgtaacgatcggattgtcgaatttgccaatatgatccgcgatctcgatcaggaatgcggttcaacctgcgcggcggatttccgcgatcgcttaggcgtaggccgcaagctggcaattcagattctggaatattttgaccgtattggctttacgcgtcgtcgtggaaatgatcatttattgcgcgacgcattattatttccggaaaaataa

SEQ ID NO: 8346 - protein, 614 aa, Escherichia coli
MIIATAGHVDHGKTTLLQAITGVNADRLPEEKKRGMTIDLGYAYWPQPDGRVPGFIDVPGHEKFLSNMLAGVGGIDHALLVVACDDGVMAQTREHLAILQLTGNPMLTVALTKADRVDEARVDEVERQVKEVLREYGFAEAKLFITAATEGRGIDALREHLLQLPEREHASQHSFRLAIDRAFTVKGAGLVVTGTALSGEVKVGDSLWLTGVNKPMRVRALHAQNQPTETAHAGQRIALNIAGDAEKEQINRGDWLLADVPPEPFTRVIVELQTHTPLTQWQPLHIHHAASHVTGRVSLLEDNLAELVFDTPLWLADNDRLVLRDISARNTLAGARVVMLNPPRRGKRKPEYLQWLASLARAQSDADALSVHLERGAVNLADFAWARQLNGEGMRELLQQPGYIQAGYSLLNAPVAARWQRKILDTLATYHEQHRDEPGPGRERLRRMALPMEDDALVLLLIEKMRESGDIHSHHGWLHLPDHKAGFSEEQQAIWQKAEPLFGDEPWWVRDLAKETGTDEQAMRLTLRQAAQQGIITAIVKDRYYRNDRIVEFANMIRDLDQECGSTCAADFRDRLGVGRKLAIQILEYFDRIGFTRRRGNDHLLRDALLFPEK

SEQ ID NO: 8347 - DNA, 1392 bp, Escherichia coli
atgacaaccgaaacgcgttccctctatagtcaacttccggctattgatcgcttattgcgcgatagctccttcctttctttgcgtgatacttatggtcacacccgcgtggtggaattgctgcgtcagatgcttgacgaagcgcgagaagtgattcgtgacagccagacgctgcccgcgtggtgtgaaaactgggcgcaagaagtcgatgcccggttgacgaaagaggcgcaaagcgcgctgcgtccggtgatcaacctgacgggaaccgtgctgcataccaaccttgggcgagctttacaggcggaagccgcggtggaagccgttacgaaggctatgcgttcgccagtgaccctcgagtacgatctggacgacgccggacgcggacatcgcgatcgggcgctggcgcagctgctgtgccgtattacgggggcggaagatgcctgtattgttaataacaatgcggcggcggtgttattgatgttggcggccactgccagcgggaaagaggtggtggtttctcgcggcgaactggtggagattggcggcgcgtttcgtattcctgatgtcatgcgtcaggcaggctgcaccctacacgaagtggggaccaccaaccgcacgcacgctaatgattatcgccaggcggtgaatgaaaataccgcgctgttgatgaaagtacataccagtaactacagcattcagggattcaccaaagcgatagatgaagcggaactggtggcgctcggcaaagagctggatgtccccgtagtgactgatttaggcagtggctcgctggtcgatcttagccagtacggtttgccgaaagagccaatgccgcaggagttgattgcggcgggcgtcagtctggtgagcttctccggcgacaagttgttaggcgggccgcaggcaggaattattgttggtaaaaaagagatgatcgcccgactgcaaagccacccgctgaagcgtgcattacgcgcggataaaatgacccttgcggcgctggaagccacgttgcgtctttatttacaccctgaagcgctgagtgaaaaattaccgaccctgcgcctgcttacccgcagcgcagaggtcattcaaatccaggcacaacgtttacaggctccccttgccgcacattacggcgcggagtttgcggtacaggttatgccatgtctttcgcagattggcagtggttcgctgccggttgatcgcctgccgagcgcggcattaacgtttacaccccatgatggacgcggtagccaccttgagtcattagccgcccgctggcgtgaattgccagtgccggtgattggtcgtatttatgacggacgattgtggctggatttacgctgccttgaagatgagcaacggtttttggagatgttgttgaaatga

SEQ ID NO: 8348 - protein, 463 aa, Escherichia coli
MTTETRSLYSQLPAIDRLLRDSSFLSLRDTYGHTRVVELLRQMLDEAREVIRDSQTLPAWCENWAQEVDARLTKEAQSALRPVINLTGTVLHTNLGRALQAEAAVEAVTKAMRSPVTLEYDLDDAGRGHRDRALAQLLCRITGAEDACIVNNNAAAVLLMLAATASGKEVVVSRGELVEIGGAFRIPDVMRQAGCTLHEVGTTNRTHANDYRQAVNENTALLMKVHTSNYSIQGFTKAIDEAELVALGKELDVPVVTDLGSGSLVDLSQYGLPKEPMPQELIAAGVSLVSFSGDKLLGGPQAGIIVGKKEMIARLQSHPLKRALRADKMTLAALEATLRLYLHPEALSEKLPTLRLLTRSAEVIQIQAQRLQAPLAAHYGAEFAVQVMPCLSQIGSGSLPVDRLPSAALTFTPHDGRGSHLESLAARWRELPVPVIGRIYDGRLWLDLRCLEDEQRFLEMLLK

SEQ ID NO: 8349 - DNA, 609 bp, Escherichia coli
atgaaactcgtcggtagctacaccagcccgtttgtacgcaaactttctattctgttgttagaaaagggcataacgttcgaatttattaatgaactgccctataacgcggataacggcgtggcgcaatttaacccgttaggaaaagtgccggtgctggtgaccgaagagggcgaatgctggtttgattcgccgatcatcgctgaatatattgaattaatgaatgttgctccggcgatgttgccgcgtgatccgctggagtcgttgcgggtgcgcaaaattgaggcgctggcggatggcattatggatgccgggctggtatcggtgcgtgaacaggcgcgtccggcggcgcagcagtctgaagatgaattgttacgtcagcgtgagaaaatcaaccgcagtctggatgtgctggaaggatatctggtcgatggcacactcaaaaccgatacggtcaatctggcgactatcgccattgcctgtgccgtcggatatctcaatttccgccgcgttgcgccaggctggtgtgtcgaccgcccacacttagtcaaactggtcgaaaacctgtttagccgcgaaagttttgctcgcaccgaaccgccaaaggcttga

SEQ ID NO: 8350 - protein, 202 aa, Escherichia coli
MKLVGSYTSPFVRKLSILLLEKGITFEFINELPYNADNGVAQFNPLGKVPVLVTEEGECWFDSPIIAEYIELMNVAPAMLPRDPLESLRVRKIEALADGIMDAGLVSVREQARPAAQQSEDELLRQREKINRSLDVLEGYLVDGTLKTDTVNLATIAIACAVGYLNFRRVAPGWCVDRPHLVKLVENLFSRESFARTEPPKA

SEQ ID NO: 8351 - DNA, 1137 bp, Escherichia coli
atggatctattgattgttttaacttacgtggcgctggcgtgggcggtctttaaaatcttccgcattccggtgaatcagtggacgctggcgacggcggcgctgggaggcgtgtttctggtgagtggtttgattttgttgatgaactacaaccacccttacacttttaccgcgcaaaaggcagtgatagcgatccccatcacgccacaggtgacgggaattgttactgaagtcaccgacaaaaataatcagcttattcagaagggcgaggtgctttttaagctcgacccggttcgttaccaggcgcgagttgacaggcttcaggcagacctgatgacggcgacgcataatataaagacgctgcgcgcgcagctcactgaagcgcaggccaacaccacccaggtttcagcggagcgcgaccgtctgtttaaaaattatcaacgttatctgaaaggcagccaggcggcggtgaatccgttctcggaacgtgacatcgacgatgcgcggcaaaatttcctcgcgcaggatgcgctggtgaaaggctcggtggcggagcaggcgcagatccagagccagctcgacagtatggttaacggcgagcaatcgcagattgtgagcttaagagcgcaacttactgaagcaaaatataaccttgagcagactgtcattcgcgcaccgagcaatggctacgtcactcaggtactgatccgcccaggtacatacgcagctgccttgccgctgcgtccggtgatggtcttcatccccgagcaaaaacggcaaattgtcgcccaatttcggcaaaactcgctgttacgtctgaaacccggcgatgatgcggaagtggtgtttaacgcgctacctgggcaggtgtttcacggcaaactgaccagtattttacctgtcgtgccaggcggttcttatcaggcgcagggggtattgcaatcattaacggtcgtgcccggcacggacggtgtgctgggaaccattgaactggaccctaacgctgatatcgatgccttacccgacggcatctacgcccaggtggcagtttactccgaccatttcagccatgtttcggtgatgcggaaagtgctgctaagaatgaccagttggatgcattatctttatttggatcattga

SEQ ID NO: 8352 - protein, 378 aa, Escherichia coli
MDLLIVLTYVALAWAVFKIFRIPVNQWTLATAALGGVFLVSGLILLMNYNHPYTFTAQKAVIAIPITPQVTGIVTEVTDKNNQLIQKGEVLFKLDPVRYQARVDRLQADLMTATHNIKTLRAQLTEAQANTTQVSAERDRLFKNYQRYLKGSQAAVNPFSERDIDDARQNFLAQDALVKGSVAEQAQIQSQLDSMVNGEQSQIVSLRAQLTEAKYNLEQTVIRAPSNGYVTQVLIRPGTYAAALPLRPVMVFIPEQKRQIVAQFRQNSLLRLKPGDDAEVVFNALPGQVFHGKLTSILPVVPGGSYQAQGVLQSLTVVPGTDGVLGTIELDPNADIDALPDGIYAQVAVYSDHFSHVSVMRKVLLRMTSWMHYLYLDH

SEQ ID NO: 8353 - DNA, 363 bp, Escherichia coli
atgtttctaaactatttcgcgttgggagtgctgatcttcgtctttctggtgattttttatggaatcatcgcgatacatgacatcccttatctgattgccaaaaagcgcaaccatccccatgccgacgctattcatacggcgggctgggtaagcctgtttaccctgcatgttatctggccgttcctgtggatctgggcgacgctctatcaaccggagcgcggctggggcatgcagtcgcatgttacgccgcaagagaaaacgactgacgcggaaatcgccgcactttctgaccggatttcccggctggagcaccaactcgccgccgagaaaaagactgactattccacgtttccggagatctaa

SEQ ID NO: 8354 - protein, 120 aa, Escherichia coli
MFLNYFALGVLIFVFLVIFYGIIAIHDIPYLIAKKRNHPHADAIHTAGWVSLFTLHVIWPFLWIWATLYQPERGWGMQSHVTPQEKTTDAEIAALSDRISRLEHQLAAEKKTDYSTFPEI

SEQ ID NO: 8355 - DNA, 1914 bp, Escherichia coli
atgtcatccgatattaagatcaaagtgcaaagctttggtcgtttcctcagcaacatggtgatgccaaatatcggcgcgtttatcgcgtggggtatcatcaccgcgttatttattccaacagggtggttaccgaacgaaacgctggcgaagctggtcgggccgatgatcacttatctcctgccgctgctgatcggttataccggtggtaagctggtaggcggcgaacgtggcggcgtagtcggtgccatcaccaccatgggcgttatcgtcggcgcagatatgccgatgttcctcggctctatgattgcaggtccgctgggcggctggtgcattaagcacttcgaccgctgggtagacggtaagatcaaatccggttttgaaatgctggtgaataacttctccgcaggcatcatcgggatgatcctcgctattctggcatttctcggcattggcccggttgttgaagccctgtctaaaatgctggcggcgggcgttaacttcatggttgtccatgacatgctgccgctggcgtctatctttgttgaaccggcgaaaatcctgttcctcaacaacgccattaaccacggtatcttctcgccgctgggtattcagcagtcccatgaactgggtaaatccatcttcttcctgattgaagctaacccaggtccgggtatgggcgtgctgctggcgtacatgttctttggtcgtggtagcgctaaacagtctgcgggcggtgcggcaatcatccacttcctgggcggtatccacgaaatctacttcccgtatgtgctgatgaatccgcgtctgattctggccgttatcctcggtggtatgactggcgtgtttacgctgactatcctgggcggtgggctggtttctccggcatctccgggttctatccttgctgtactggcgatgacaccaaaaggtgcatacttcgctaacatcgcgggtgtgtgtgcggcgatggctgtctccttcgttgtctctgccattctgctgaaaaccagcaaagtgaaagaagaagatgatattgaagcagcaactcgtcgtatgcaggacatgaaagctgagtctaaaggcgcgtctccactgtctgcgggcgatgtgactaacgacctgagccacgtacgtaaaatcatcgttgcctgtgatgccggtatgggttccagtgcgatgggcgcaggcgtgctgcgtaagaaaattcaggatgcaggtctgtcgcagatttcggtcactaacagcgcgatcaacaacctgccgccagatgtggacctggtcatcactcaccgtgacctgaccgaacgcgctatgcgccaggttccgcaggcacagcatatttcgctgaccaacttcctcgacagcggcctgtacaccagcctgaccgaacgtctggttgctgcccagcgccatactgaaaacgaagtgaaagtgaaagacagtctgaaagacagctttgacgattccagtgctaatctgttcaaactgggcgcggagaacatcttcctcggtcgcaaagcggccaccaaagaagaagcgattcgttttgctggcgagcagctggtgaaaggcggttacgttgagccggaatacgttcaggcgatgttggatcgtgaaaaactgaccccgacttatctgggtgagtctatcgcggtgccacacggtacggttgaagcgaaagatcgcgtactgaaaacgggcgtggtgttctgccagtatccggaaggcgtgcgcttcggtgaagaagaagatgacattgcccgtctggtgattggtattgctgcccgtaacaacgagcacattcaggttatcaccagcctgaccaatgcactggatgatgagtctgtcatcgagcgtctggcacacaccaccagcgtggatgaagtgctggaactgctggcaggtcgtaagtaa

SEQ ID NO: 8356 - protein, 637 aa, Escherichia coli
MSSDIKIKVQSFGRFLSNMVMPNIGAFIAWGIITALFIPTGWLPNETLAKLVGPMITYLLPLLIGYTGGKLVGGERGGVVGAITTMGVIVGADMPMFLGSMIAGPLGGWCIKHFDRWVDGKIKSGFEMLVNNFSAGIIGMILAILAFLGIGPVVEALSKMLAAGVNFMVVHDMLPLASIFVEPAKILFLNNAINHGIFSPLGIQQSHELGKSIFFLIEANPGPGMGVLLAYMFFGRGSAKQSAGGAAIIHFLGGIHEIYFPYVLMNPRLILAVILGGMTGVFTLTILGGGLVSPASPGSILAVLAMTPKGAYFANIAGVCAAMAVSFVVSAILLKTSKVKEEDDIEAATRRMQDMKAESKGASPLSAGDVTNDLSHVRKIIVACDAGMGSSAMGAGVLRKKIQDAGLSQISVTNSAINNLPPDVDLVITHRDLTERAMRQVPQAQHISLTNFLDSGLYTSLTERLVAAQRHTENEVKVKDSLKDSFDDSSANLFKLGAENIFLGRKAATKEEAIRFAGEQLVKGGYVEPEYVQAMLDREKLTPTYLGESIAVPHGTVEAKDRVLKTGVVFCQYPEGVRFGEEEDDIARLVIGIAARNNEHIQVITSLTNALDDESVIERLAHTTSVDEVLELLAGRK

SEQ ID NO: 8357 - DNA, 1329 bp, Escherichia coli
atgcctgatgcgacgctgacgcgtcttatcaggcctacaggtcagtgccaaacacgtaggccggataaggcgtttacgccgcatccggcaaaaagcccctctcctcacggagagggtttgggtgagggaaaagcctcaccccagccctctcgggtaaaaacattgatgaaggttaatactatgaaagcattacattttggcgcaggtaatatcggtcgtggctttatcggtaaactgctggcggacgcgggtatccaactgacgtttgccgatgtaaatcaggtggtacttgatgccctgaatgcccgtcatagctatcaggttcatgtggtcggcgaaaccgagcaggtggataccgtttctggcgtcgatgccgtcagcagcattggcgatgatgtcgttgatctgattgctcaggtcgatttagtcactaccgccgttggccctgtcgtgctggaacgtattgctccggccatcgccaaagggctggtgaaacgtaaagaacaaggtaatgaatccccactgaacatcatcgcctgtgaaaacatggtccgcggcaccacgcagctgaaaggccatgtgatgaacgccctgccggaagatgccaaagcgtgggtagaagaacacgttggctttgttgattccgccgttgaccgcatcgtaccgccttcggcttcggcaactaacgatccgctggaagtgacggtagaaaccttcagcgaatggattgtcgataaaacgcagttcaaaggcacgctgccaaacatccctggcatggaattaaccgacaatctgatggcatttgtcgaacgtaaactcttcaccctgaatacaggtcatgctataaccgcgtacctcggaaaactggccggtcatcagaccattcgtgacgcaattctcgacgagaaaatccgcgcggtggtaaaaggggcaatggaagaaagcggcgcggtactgatcaagcgctacgactttgatgctgacaaacatgcggcatacatccagaaaatcctcggtcgtttcgagaacccgtacctgaaagatgatgtagaacgcgtaggccgtcagccgctgcgtaaactgagtgctggcgaccgtctgatcaagccactgctcggaaccctggaatatggtctgccacataaaaacctgattgaaggtattgccgctgcaatgcacttccgcagtgaagatgacccgcaggctcaggaactggcagcgctgattgccgacaaaggcccacaagccgcgctggcacagatttccggtcttgatgccaacagcgaggttgtatccgaggcggtaaccgcttataaagcaatgcaataa

SEQ ID NO: 8358 - protein, 442 aa, Escherichia coli
MPDATLTRLIRPTGQCQTRRPDKAFTPHPAKSPSPHGEGLGEGKASPQPSRVKTLMKVNTMKALHFGAGNIGRGFIGKLLADAGIQLTFADVNQVVLDALNARHSYQVHVVGETEQVDTVSGVDAVSSIGDDVVDLIAQVDLVTTAVGPVVLERIAPAIAKGLVKRKEQGNESPLNIIACENMVRGTTQLKGHVMNALPEDAKAWVEEHVGFVDSAVDRIVPPSASATNDPLEVTVETFSEWIVDKTQFKGTLPNIPGMELTDNLMAFVERKLFTLNTGHAITAYLGKLAGHQTIRDAILDEKIRAVVKGAMEESGAVLIKRYDFDADKHAAYIQKILGRFENPYLKDDVERVGRQPLRKLSAGDRLIKPLLGTLEYGLPHKNLIEGIAAAMHFRSEDDPQAQELAALIADKGPQAALAQISGLDANSEVVSEAVTAYKAMQ

SEQ ID NO: 8359 - DNA, 588 bp, Escherichia coli
atggtggaccaggcgcaggataccctgcgcccgaataacagattgtcagatatgcaggcaacaatggaacaaacccaggcctttgaaaaccgtgtgcttgagcgtctgaatgctggcaaaaccgtgcgaagctttctgatcaccgccgtcgagcttttgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacgagtacgcttttaccgacgacgaaatccttggaccctttggtgaactgcattgcgtggcggcgttaccaccgccgccacagtttgaacctgcagactccagtttgtatgcaatgcaaattcagcgttaccaacaggctgtacgatcaacaatggtcctttcactgacagagctgatttcaaaaatcagcttaaaaaaagcctttcaaaagtaa

SEQ ID NO: 8360 - protein, 195 aa, Escherichia coli
MVDQAQDTLRPNNRLSDMQATMEQTQAFENRVLERLNAGKTVRSFLITAVELLTEAVNLLVLQVFRKDDYAVKYAVEPLLDGDGPLGDLSVRLKLIYGLGVINRQEYEDAELLMALREELNHDGNEYAFTDDEILGPFGELHCVAALPPPPQFEPADSSLYAMQIQRYQQAVRSTMVLSLTELISKISLKKAFQK

SEQ ID NO: 8361 - DNA, 210 bp, Escherichia coli
atgggcaaattaggtgaaaacgttccgcttcttatcgataaagccgtagatttcatggcatccagccaggcgttccgggagtatctgaaaaaactacctccccgtaacgcgattccgtccggaatacctgatgaaagcgtgccgttatatctacaacgtctggagtattatcgtcagctttatcgtccgaaacaggtagaggagaagtaa

SEQ ID NO: 8362 - protein, 69 aa, Escherichia coli
MGKLGENVPLLIDKAVDFMASSQAFREYLKKLPPRNAIPSGIPDESVPLYLQRLEYYRQLYRPKQVEEK

SEQ ID NO: 8363 - DNA, 363 bp, Escherichia coli
atgaaagaagtcgaaaaaaacgaaatcaaacgtctcagcgatcgtctggacgccatccgtcaccagcaggccgatctatcgctggttgaagccgcagacaaatatgccgaactggaaaaagagaaagccacgctggaagcagaaattgctcgcctgcgcgaagttcacagccagaaactcagcaaagaagcgcagaaactgatgaagatgccgttccagcgtgcaatcaccaaaaaagagcaggctgatatgggcaaactgaaaaaaagtgttcgcggactggtggttgtgcacccaatgaccgcgctgggccgtgaaatgggcctgcaaaagatgacagggttctcaaagactgcgttttaa

SEQ ID NO: 8364 - protein, 120 aa, Escherichia coli
MKEVEKNEIKRLSDRLDAIRHQQADLSLVEAADKYAELEKEKATLEAEIARLREVHSQKLSKEAQKLMKMPFQRAITKKEQADMGKLKKSVRGLVVVHPMTALGREMGLQKMTGFSKTAF

SEQ ID NO: 8365 - DNA, 450 bp, Escherichia coli
gtggtgaaggcagttaaagacaaacaggacgaatttgtctttacagaatttaacccggcacaaacccaatacttcattttaaataacggttctgttggtttggcagggaaaatactgtctattgacgcagtagaaaacggcagcgttattcgtatttcactggttaacttattaagtgttcctgtatcaaatatgggtttctacgcgacatgggggggagaaaaacccaccgacatcaacgcattagcaaaatggcagcaattgctatttagtacctcaatgaactcctccctgaaattattaccaggtcaatggcaagacattaatttgacgctaaaaggtgtctcgcccaacaacctcaaatatctgaaattagccatcaacatggcaaatattcagttcgaccgtcttcaacctgctgaatctccacagcggaaaaacaaaaaataa

SEQ ID NO: 8366 - protein, 149 aa, Escherichia coli
MVKAVKDKQDEFVFTEFNPAQTQYFILNNGSVGLAGKILSIDAVENGSVIRISLVNLLSVPVSNMGFYATWGGEKPTDINALAKWQQLLFSTSMNSSLKLLPGQWQDINLTLKGVSPNNLKYLKLAINMANIQFDRLQPAESPQRKNKK

SEQ ID NO: 8367 - DNA, 4752 bp, Escherichia coli
atgaacaaaatatttaaagttatctggaatccggcgacaggcagttacaccgttgccagtgaaacagcaaaaagtcgtggtaaaaaaagcgggcgcagtaagctgttaatttctgcactggttgcgggtgggttgctgtcttcttttagcgtatgggcaaacgccgggaatgacgacggtcagggtattggaacaggcacaggctgggttgctattggtgaaagcgcaaaggcaaccgcctatacagatagtaatggtgccagtactgcggtcggttataaatctaacgcccagggagtctggagttccgctattggtgcacttaccagtgcacttggtgattcttcaatggccttcggtgttaatgccgtttcaaccggtcaacgaagtattgctatgggtgcatcatcaagctcactcggtgagtattcaatagcgcttggacgatatgcaagttcgggtggtatgttttcgctcgcgcaaggggacagatccaatgcagctggtttgaacgccactgcggtggggagtaacagtaatgcggcgggcgcgaaagctattgcgctaggaaatgcagctaaagctactgaaattatgagcattgctcttggtgacactgccaatgcctcgaaagaatattctatggcgctgggagtaagtagcgccgcatctgcggctaacgcgattgccgtaggccgcaacagtgctgcggcaggcgtagacagccttgccttaggtagactatccgtagccagcgcagcaaacgccattgctatgggtgcagagagcgaagctgctgaaaatgcgacggctattggcaataacgcgcatgcaaaaggggtgaatagcatcgcgatgggctccgggagcattgccgataaagtcaatactatcgcgttgggtaatggcagccagtctctggcagataacgcaattgctattggtcagggcaacaaggctaatggcactgatgctatcgctctgggtaatgctagcctgtcgagcggcttaaactcgattgccctgggcaagaccagtgttgtcactggcgataatagtcttgcgcttggtagtaataccaatgccaatggtattaactctgtcgcgctaggtgcagattccattgcggatcaagacaattccgtttctgtcggcagtagctcattacaacgcaagatcgttaatgtaaaaaatggcgcgatcaaggctgacagccacgacgccattaatggctcacagctttatgccatcagcgactcaatagccaaaaggcttggaggaggctcatcggtaaaccctgacgacggtacagttaacgcaccaacctacaatttaaaaaatggtaacaaaaataacgttggcagtgcgctcactgtacttgatgaaaacaccctgcaatgggaccaaatcaaaggcaaatacagcgccgttcatggtagctcaacgaccagcgtaatcactgatgtggcgaacggtacgatttcagcagccagtaaagatgcggttaacggctctcagttgtatgacctgcagcaggatgctctgttgtggaacggcacagcattcagtgccgcgcacggcaccgaagccaccagcaaaatcactaacgtcaccgctggcaacctgactgccagcagcactgacgccgttaacggctctcagctcaaaaccaccaacgacaacgtgacgaccaacaccaccaacatcgccactaacaccaccaacatcaccaacctgactgacgctgttgacagtctcggtgacgactccctgctatggaacaaaacagctggcgcattcagcgccgctcacggcactgacgccaccagcaagatcaccaatgtcaaagccggtgacctgacagctggcagcactgacgccgttaacggctcccagctcaaaaccaccaacgataacgtgtcgaccaacaccaccaacatcgccactaacaccaccaacatcaccaacctgacggattccgttggcgaccttaaggacgattctctgctgtggaacaaagcggctggcgcattcagcgccgcgcacggtaccgaagctaccagcaagatcaccaacttactggctggcaagatatcttctaacagcactgatgccattaatggctcacaactttatggcgtagcggattcatttacgtcatatcttggtggtggtgctgatatcagcgatacgggtgtattaagtgggccaacctacactattggtggtactgactacactaacgtcggtgatgctctggcagccattaacacatcatttagcacatcactcggcgacgccctactttgggatgcaaccgcaggcaaattcagcgccaaacacggcattaataatgctcccagtgtaatcactgatgttgcaaacggtgcagtctcgtccaccagcagcgacgccattaacggttcacaactttatggtgttagtgactacattgccgatgctctgggcgggaatgctgtggtgaacactgacggcagtatcactacaccgacttatgccatcgctggcggcagttacaacaacgtcggtgacgcgctggaagcgatcgataccacgctggatgatgctctgctgtgggatacaacagccaatggcggtaacggtgcatttagcgccgctcacgggaaagataaaactgccagtgtaatcactaacgtcgctaacggtgcagtctctgccaccagcagcgatgccattaatggctcacagctctatagcaccaataagtacatcgctgatgcgctgggtggtgatgcagaagtcaacgctgacggaactatcactgcaccgacttacaccattgcaaataccgattacaacaacgtcggtgaagccctggatgcgctcgataataacgctctgctgtgggatgaagacgcaggtgcctacaacgccagccatgatggcaatgccagcaaaatcaccaacgttgcggctggtgatctctccacaaccagtaccgatgctgttaacggttcccagttaaacgcaaccaatattctggttacgcaaaatagccaaatgattaaccagcttgccggtaacaccagtgaaacctacatcgaagaaaatggtgcaggtattaactatgtgcgtaccaatgataccggtttaaccttcaccgatgccagcgcagcaggtattggctctaccgctgtggggtataacactgttgccaaaggcgatagcagcgtggccatgggttataactcttttgccaaaggcgatagcagcgtggccatcggtcagggcagctacagcggcgttgatacgggtatcgctctgggtagcagctccgtttccagccgtgtaatagttaaaggttctcgtaacaccagcgtatcggaagaaggtgttgtgattggttatgacaccacggatggcgaactgcttggtgcattgtcgatcggtgatgatggtaaatatcgtcaaatcatcaacgtcgcggatggttctgaagcccatgacgctgttacggttcgccagttgcagaacgccattggtgcagtcgcaaccacaccaaccaaatactatcacgccaactcaacggctgaagactcactggcagtcggtgaagactcgctggcaatgggcgcgaaaaccatcgttaatggtaatgcgggtattggtatcggcctgaacactttagttctggctgatgcgatcaacggtattgctatcggttctaacgcacgcgcaaatcatgccgacagcattgcaatgggtaatggttctcagactacccgtggtgcacagaccaactacactgcctacaacatggatgcaccgcagaactctgtgggtgaattctccgtaggtagcgaagacggtcaacgtcagatcaccaacgtcgcagcaggttcggcggataccgatgcggttaacgtgggtcagttgaaagtaacggacgcgcaggtttcccagaatacccagagcattactaacctgaacactcaggtcactaatctggatactcgcgtgaccaatatcgaaaatggcattggcgatatcgtaaccaccggtagtactaagtacttcaagaccaacaccgatggcgcagacgccaacgcgcagggtaaagacagtgttgcgattggttctggttccattgctgccgctgataacagcgtcgcgctgggcacgggttccgtagcagacgaagaaaatacgatctctgtgggttcttctaccaaccagcgccgtatcaccaacgttgctgccggtgttaatgccaccgatgcggttaacgtttcacaactgaagtcttctgaagcaggcggcgtgcgctacgacaccaaagctgatggctctatcgactacagcaacatcactctcggtggcggcaatagcggtacgactcgcatcagcaacgtttctgctggcgtgaacaacaacgacgcagtgaactatgcgcagttgaagcaaagtgtgcaggaaacgaagcaatacaccgatcagcgcatggttgagatggataacaaactgtccaaaactgaaagcaagctgagtggtggtatcgcttctgcaatggcaatgaccggtctgccgcaggcttacacgccgggagccagcatggcctctattggtggtggtacttacaacggtgaatcggcagttgctttaggtgtgtcgatggtgagcgccaatggtcgttgggtctacaaattacaaggtagtaccaatagccagggtgaatactccgccgcgctcggtgccggtattcagtggtaa

SEQ ID NO: 8368 - protein, 1583 aa, Escherichia coli
MNKIFKVIWNPATGSYTVASETAKSRGKKSGRSKLLISALVAGGLLSSFSVWANAGNDDGQGIGTGTGWVAIGESAKATAYTDSNGASTAVGYKSNAQGVWSSAIGALTSALGDSSMAFGVNAVSTGQRSIAMGASSSSLGEYSIALGRYASSGGMFSLAQGDRSNAAGLNATAVGSNSNAAGAKAIALGNAAKATEIMSIALGDTANASKEYSMALGVSSAASAANAIAVGRNSAAAGVDSLALGRLSVASAANAIAMGAESEAAENATAIGNNAHAKGVNSIAMGSGSIADKVNTIALGNGSQSLADNAIAIGQGNKANGTDAIALGNASLSSGLNSIALGKTSVVTGDNSLALGSNTNANGINSVALGADSIADQDNSVSVGSSSLQRKIVNVKNGAIKADSHDAINGSQLYAISDSIAKRLGGGSSVNPDDGTVNAPTYNLKNGNKNNVGSALTVLDENTLQWDQIKGKYSAVHGSSTTSVITDVANGTISAASKDAVNGSQLYDLQQDALLWNGTAFSAAHGTEATSKITNVTAGNLTASSTDAVNGSQLKTTNDNVTTNTTNIATNTTNITNLTDAVDSLGDDSLLWNKTAGAFSAAHGTDATSKITNVKAGDLTAGSTDAVNGSQLKTTNDNVSTNTTNIATNTTNITNLTDSVGDLKDDSLLWNKAAGAFSAAHGTEATSKITNLLAGKISSNSTDAINGSQLYGVADSFTSYLGGGADISDTGVLSGPTYTIGGTDYTNVGDALAAINTSFSTSLGDALLWDATAGKFSAKHGINNAPSVITDVANGAVSSTSSDAINGSQLYGVSDYIADALGGNAVVNTDGSITTPTYAIAGGSYNNVGDALEAIDTTLDDALLWDTTANGGNGAFSAAHGKDKTASVITNVANGAVSATSSDAINGSQLYSTNKYIADALGGDAEVNADGTITAPTYTIANTDYNNVGEALDALDNNALLWDEDAGAYNASHDGNASKITNVAAGDLSTTSTDAVNGSQLNATNILVTQNSQMINQLAGNTSETYIEENGAGINYVRTNDTGLTFTDASAAGIGSTAVGYNTVAKGDSSVAMGYNSFAKGDSSVAIGQGSYSGVDTGIALGSSSVSSRVIVKGSRNTSVSEEGVVIGYDTTDGELLGALSIGDDGKYRQIINVADGSEAHDAVTVRQLQNAIGAVATTPTKYYHANSTAEDSLAVGEDSLAMGAKTIVNGNAGIGIGLNTLVLADAINGIAIGSNARANHADSIAMGNGSQTTRGAQTNYTAYNMDAPQNSVGEFSVGSEDGQRQITNVAAGSADTDAVNVGQLKVTDAQVSQNTQSITNLNTQVTNLDTRVTNIENGIGDIVTTGSTKYFKTNTDGADANAQGKDSVAIGSGSIAAADNSVALGTGSVADEENTISVGSSTNQRRITNVAAGVNATDAVNVSQLKSSEAGGVRYDTKADGSIDYSNITLGGGNSGTTRISNVSAGVNNNDAVNYAQLKQSVQETKQYTDQRMVEMDNKLSKTESKLSGGIASAMAMTGLPQAYTPGASMASIGGGTYNGESAVALGVSMVSANGRWVYKLQGSTNSQGEYSAALGAGIQW

SEQ ID NO: 8369 - DNA, 1656 bp, Escherichia coli
atgaatctctggcaacaaaactacgatcccgccgggaatatctggctttccagcctgatagcatcgcttcccatcctgtttttcttctttgcgctgattaagctcaaactgaaaggatacgtcgccgcctcatggacggtggcaatcgcccttgccgtggctttgctgttctataaaatgccggtcgctaacgcgctggcctcggtggtttatggcttcttctacgggttgtggcccatcgcgtggatcattattgcagcggtgttcgtctataagatctcggtgaaaaccgggcagtttgacatcatccgctcgtctattctttcgataacccctgaccagcgcctgcaaatgctgatcgtcggtttctgtttcggcgctttccttgaaggagccgcaggctttggcgcaccggtagcaattaccgccgcattgctggtcggtctgggctttaaaccactgtacgccgccgggctgtgcctgattgttaacaccgcgccagtggcatttggtgcgatgggtattccgattctggtcgccgggcaggtaacaggcatcgacagctttgagattggtcagatggtggggcgtcagctgccgtttatgaccattatcgtgctgttctggatcatggcgattatggacggctggcgcggtatcaaagagacgtggcctgcggtcgtggttgcgggcgggtcgtttgccattgctcaatacctcagctctaactttattgggccggaactgccagacattatctcttcgctggtatcgctgctctgtctgacactgttcctcaaacgctggcaaccagtgcgcgtattccgcttcggtgacttaggggcgtcacaggttgatatgacgctggctcacacaggttacacggcaggtcaggtgctgcgcgcctggacaccgttcctgttcctgaccgccaccgtaacgctgtggagtatcccgccgtttaaagccctgttcgcttcaggcggtgcgctgtatgagtgggtgatcaacattccggtgccgtacctcgataaactggttgcccgtatgccgccagtggtcagcgaagcgacagcgtatgccgccgtgtttaagtttgactggttctctgccactggcaccgccattctgtttgctgccctgctctcgattgtctggctgaagatgaaaccatctgacgctatcagcaccttcggcagcacgctgaaagaactggctctgcccatctactccatcggtatggtgctggcattcgcctttatctcgaactattcaggactgtcatcaacactggcgctggcactggcgcacaccggtcatgcattcaccttcttctcgccgttcctcggctggcttggggtattcctgaccgggtcggatacgtcatctaatgctttgtttgccgctttgcaggctaccgccgcacaacaaattggcgtttctgacctgttgctggttgcagccaacaccaccggtggtgtcaccggcaaaatgatctctccgcaatctatcgctatcgcctgtgcggcggtaggtctggtgggcaaagagtctgatttgttccgctttactgtcaaacacagcctgatcttcacctgtatggtgggcgtgatcaccacgcttcaggcctatgtcttaacgtggatgattccttaa

SEQ ID NO: 8370 - protein, 551 aa, Escherichia coli
MNLWQQNYDPAGNIWLSSLIASLPILFFFFALIKLKLKGYVAASWTVAIALAVALLFYKMPVANALASVVYGFFYGLWPIAWIIIAAVFVYKISVKTGQFDIIRSSILSITPDQRLQMLIVGFCFGAFLEGAAGFGAPVAITAALLVGLGFKPLYAAGLCLIVNTAPVAFGAMGIPILVAGQVTGIDSFEIGQMVGRQLPFMTIIVLFWIMAIMDGWRGIKETWPAVVVAGGSFAIAQYLSSNFIGPELPDIISSLVSLLCLTLFLKRWQPVRVFRFGDLGASQVDMTLAHTGYTAGQVLRAWTPFLFLTATVTLWSIPPFKALFASGGALYEWVINIPVPYLDKLVARMPPVVSEATAYAAVFKFDWFSATGTAILFAALLSIVWLKMKPSDAISTFGSTLKELALPIYSIGMVLAFAFISNYSGLSSTLALALAHTGHAFTFFSPFLGWLGVFLTGSDTSSNALFAALQATAAQQIGVSDLLLVAANTTGGVTGKMISPQSIAIACAAVGLVGKESDLFRFTVKHSLIFTCMVGVITTLQAYVLTWMIP

SEQ ID NO: 8371 - DNA, 792 bp, Escherichia coli
gtggatgattccttaatgattgttttacccagacgcctgtcagacgaggttgccgatcgtgtgcgggcgctgattgatgaaaaaaacctggaagcgggcatgaagttgcccgctgaacgtcaactggcgatgcaactcggcgtgtcgagaaattcactgcgcgaggcgctggcgaaactggtaagcgaaggtgtgctgctcagtcgacgtggcggcgggacgtttattcgctggcgtcatgacacatggtcggagcaaaacatcgtccagccgctgaaaacgctgatggccgatgatccggattacagtttcgatattctggaagcccgatacgccattgaagccagcaccgcatggcatgcagcaatgcgcgccacacctggcgaaaaagaaaagattcagctttgctttgaagcaacgctaagtgaagacccggatctcgcctcacaagcggacgttcgttttcatctggcgattgccgaagcttcacataacattgtgttgctgcaaaccatgcgcggtttcttcgatgtcctgcaatcctctgtgaagcatagccgccagcggatgtacctggtacccccggttttttcacagctgaccgaacaacatcaggcggtcattgacgccatttttgccggtgatgctgacggggcgcgtaaagcaatgatggcgcaccttagctttgttcacaccaccatgaaacgattcgatgaagatcaggctcgccatgcacgtattacccgcctgcctggtgaccataatgagcattcgagggagaaaaacgcatga

SEQ ID NO: 8372 - protein, 263 aa, Escherichia coli
MDDSLMIVLPRRLSDEVADRVRALIDEKNLEAGMKLPAERQLAMQLGVSRNSLREALAKLVSEGVLLSRRGGGTFIRWRHDTWSEQNIVQPLKTLMADDPDYSFDILEARYAIEASTAWHAAMRATPGEKEKIQLCFEATLSEDPDLASQADVRFHLAIAEASHNIVLLQTMRGFFDVLQSSVKHSRQRMYLVPPVFSQLTEQHQAVIDAIFAGDADGARKAMMAHLSFVHTTMKRFDEDQARHARITRLPGDHNEHSREKNA

SEQ ID NO: 8373 - DNA, 1191 bp, Escherichia coli
atgattatttccgcagccagcgattatcgcgccgcagcgcaacgcattctgccgccgttcctgttccactatatggatgggggggcatattctgaatacacgctgcgccgcaacgtggaagatttgtcagaaatggcgctgcgccagcgtattctgaaaaacatgtctgacttaagcctggaaacgacgctgtttaatgagaaattgtcgatgccggtggcgctaggtccggtaggtttgtgtggcatgtatgcgcgacgcggcgaagttcaggctgccaaagcagcagatgcgcatggcattccgtttactctctcgacggtttccgtttgcccgattgaagaagtggctccggctatcaaacgtccgatgtggttccagctttatgtgctgcgcgatcgcggctttatgcgtaacgccctggagcgagcaaaagccgcgggttgttcgacgctggttttcaccgtggatatgccaacaccgggagcgcgttatcgtgatgcgcattctgggatgagcggcccgaacgcggcaatgcgccgctatttacaggcggtgacgcatccgcaatgggcgtgggatgtgggcctgaacggtcgtccgcatgatttaggtaatatctcggcttacctcggcaaaccgaccggactggaagattacatcggttggctggccaataacttcgatccgtccatctcatggaaagaccttgagtggatccgcgacttctgggatggcccgatggtaatcaaagggatacttgatccggaagatgcgcgggatgcagtacgctttggcgctgacggaattgtggtttctaaccacggcggtcgtcagttggacggcgtgctctcttctgcgcgtgccctgcctgctattgcagatgccgtgaaaggtgatatcgccattctggcagatagcgggattcgtaacgggctggacgttgtgcgtatgatcgcgctcggtgctgataccgtactgctgggccgcgctttcctgtatgcgctggcaacagcgggccaggcgggtgtagctaatctgctaaatctgatcgaaaaagagatgaaagtggcgatgacgctgactggcgcgaaatcgattagcgaaattacgcaagattcgctggtgcaggtgctgggtaaagagttgccggcggcattggctccgatggcgaaagggaatgcagcttaa

SEQ ID NO: 8374 - protein, 396 aa, Escherichia coli
MIISAASDYRAAAQRILPPFLFHYMDGGAYSEYTLRRNVEDLSEMALRQRILKNMSDLSLETTLFNEKLSMPVALGPVGLCGMYARRGEVQAAKAADAHGIPFTLSTVSVCPIEEVAPAIKRPMWFQLYVLRDRGFMRNALERAKAAGCSTLVFTVDMPTPGARYRDAHSGMSGPNAAMRRYLQAVTHPQWAWDVGLNGRPHDLGNISAYLGKPTGLEDYIGWLANNFDPSISWKDLEWIRDFWDGPMVIKGILDPEDARDAVRFGADGIVVSNHGGRQLDGVLSSARALPAIADAVKGDIAILADSGIRNGLDVVRMIALGADTVLLGRAFLYALATAGQAGVANLLNLIEKEMKVAMTLTGAKSISEITQDSLVQVLGKELPAALAPMAKGNAA

SEQ ID NO: 8375 - DNA, 474 bp, Escherichia coli
atgctaaacatcgtactttacgaaccagaaattccgccaaatactggcaacatcatccgtctttgcgctaataccggctttcgtctgcatatcatcgaaccgatgggatttgcctgggacgataagcgcctgcgccgcgcggggctggactatcacgagtttaccgccgttacgcgtcatcatgactatcgcgcgtttctcgaagcagaaaatccccagcgcctgtttgccctcaccacgaaaggtacgcctgctcacagcgccgtaagctatcaggatggcgactatctaatgtttggcccggaaacgcgcggcctgccagcgagcattcttgatgccctgcccgctgaacaaaaaattcgtattccaatggtgccggacagccgcagcatgaacctgtccaatgcggtgtcggtggtggtgtatgaagcctggcgccagctggggtatccgggagcggtgttgagagattaa

SEQ ID NO: 8376 - protein, 157 aa, Escherichia coli
MLNIVLYEPEIPPNTGNIIRLCANTGFRLHIIEPMGFAWDDKRLRRAGLDYHEFTAVTRHHDYRAFLEAENPQRLFALTTKGTPAHSAVSYQDGDYLMFGPETRGLPASILDALPAEQKIRIPMVPDSRSMNLSNAVSVVVYEAWRQLGYPGAVLRD

SEQ ID NO: 8377 - DNA, 822 bp, Escherichia coli
atgtcgtgtgaagaactggaaattgtctggaacaatattaaagctgaagccagaacgctggcggactgtgagccaatgctggccagtttttaccacgcgacgctactcaagcacgaaaaccttggcagtgcactgagctacatgctggcgaacaagctgtcatcgcccattatgccggctattgctatccgtgaagtggtggaagaagcctacgccgccgacccggaaatgatcgcctctgcggcctgtgatattcaggcggtgcgtacccgtgacccggcggtggataaatactcaaccccgttgctatatctgaagggttttcatgctttgcaggcgtatcgcatcggtcactggttgtggaatcagggccgtcgcgcgctggctatttttctacaaaaccaggtctctgtaacgttccaggttgatatacacccggcagcaaaaattggtcgcggtatcatgctcgaccacgcgacaggcatcgtcgttggtgaaacggcggtgattgaaaacgacgtatcgattctgcaatccgttacccttggcggtacgggtaaatctggcggagaccgtcacccgaaaattcgtgaaggcgtgatgattggcgcaggcgcgaaaattctcggtaatattgaagttgggcgcggcgcgaagattggcgcaggttccgtggtgctgcaaccggtgccgccgcacactactgccgctggcgttccggcacgcattgtcggcaagccggatagcgataaaccgtcaatggatatggatcagcatttcaacggcattaaccatacgtttgagtatggtgatgggatctga

SEQ ID NO: 8378 - protein, 273 aa, Escherichia coli
MSCEELEIVWNNIKAEARTLADCEPMLASFYHATLLKHENLGSALSYMLANKLSSPIMPAIAIREVVEEAYAADPEMIASAACDIQAVRTRDPAVDKYSTPLLYLKGFHALQAYRIGHWLWNQGRRALAIFLQNQVSVTFQVDIHPAAKIGRGIMLDHATGIVVGETAVIENDVSILQSVTLGGTGKSGGDRHPKIREGVMIGAGAKILGNIEVGRGAKIGAGSVVLQPVPPHTTAAGVPARIVGKPDSDKPSMDMDQHFNGINHTFEYGDGI

SEQ ID NO: 8379 - DNA, 1020 bp, Escherichia coli
atgaaccaacgtaatgcttcaatgactgtgatcggtgccggctcgtacggcaccgctcttgccattaccctggcaagaaatggccacgaggttgtcctctggggccatgaccctgaacatatcgcaacgcttgaacgcgaccgctgtaacgccgcgtttctccccgatgtgccttttcccgatacgctccatcttgaaagcgatctcgccactgcgctggcagccagccgtaatattctcgtcgtcgtacccagccatgtctttggtgaagtgctgcgccagattaaaccgctgatgcgtcctgatgcgcgtctggtgtgggcgaccaaagggctggaagcagaaaccggacgtctgttacaggacgtggcgcgtgaggccttaggcgatcaaattccgctggcggttatctctggcccaacgtttgcgaaagaactggcggcaggtttaccgacggccatttcgctggcctcgacggaccagacctttgccgatgacctccagcaattgctgcactgtggcaaaagtttccgcgtttacagcaacccggatttcatcggtgtgcagcttggcggcgcggtgaaaaacgtcattgccattggcgcggggatgtccgacggtatcggttttggcgcgaatgcgcgtacggcgctgatcactcgtgggctggctgagatgtcgcgtcttggcgcggcgctgggtgccgatcctgccacctttatgggcatggcggggctgggcgatctggtgcttacctgtaccgacaaccagtcgcgtaaccgccgttttggcatgatgctcggtcagggcatggatgtacaaagcgcgcaggagaaaattggtcaagtggtggaaggctaccgcaatacgaaagaagtccgcgaactggcgcatcgcttcggcgttgaaatgccaataaccgaggaaatttatcaagtattatattgcggaaaaaacgcgcgcgaggcagcattgactttactaggtcgtgcacgcaaggacgagcgcagcagccactaa

SEQ ID NO: 8380 - protein, 339 aa, Escherichia coli
MNQRNASMTVIGAGSYGTALAITLARNGHEVVLWGHDPEHIATLERDRCNAAFLPDVPFPDTLHLESDLATALAASRNILVVVPSHVFGEVLRQIKPLMRPDARLVWATKGLEAETGRLLQDVAREALGDQIPLAVISGPTFAKELAAGLPTAISLASTDQTFADDLQQLLHCGKSFRVYSNPDFIGVQLGGAVKNVIAIGAGMSDGIGFGANARTALITRGLAEMSRLGAALGADPATFMGMAGLGDLVLTCTDNQSRNRRFGMMLGQGMDVQSAQEKIGQVVEGYRNTKEVRELAHRFGVEMPITEEIYQVLYCGKNAREAALTLLGRARKDERSSH

SEQ ID NO: 8381 - DNA, 528 bp, Escherichia coli
gtgaacgttggcattacattgcgcagtattttaaggacaacacttaagggttttctacacatgtcagaacaaaacaacaccgaaatgactttccagatccaacgtatttataccaaggatatttctttcgaagcgccgaacgcgccgcacgttttccagaaagattggcaaccagaagttaaacttgatctggatacggcatctactcaactggcagatgacgtttacgaagtggtactgcgtgttaccgtaacggcctccctgggcgaagaaaccgcgttcctgtgtgaagttcagcagggcggtattttctccatcgcgggtatcgaaggcacccagatggcacattgcctgggcgcatactgcccgaacattctgttcccgtatgctcgtgagtgcatcaccagcatggtatcccgcggtacattcccgcaactgaaccttgcgccggttaacttcgatgcgctgttcatgaactatttgcagcagcaggctggcgaaggtactgaagaacatcaggatgcctga

SEQ ID NO: 8382 - protein, 175 aa, Escherichia coli
MNVGITLRSILRTTLKGFLHMSEQNNTEMTFQIQRIYTKDISFEAPNAPHVFQKDWQPEVKLDLDTASTQLADDVYEVVLRVTVTASLGEETAFLCEVQQGGIFSIAGIEGTQMAHCLGAYCPNILFPYARECITSMVSRGTFPQLNLAPVNFDALFMNYLQQQAGEGTEEHQDA

SEQ ID NO: 8383 - DNA, 252 bp, Escherichia coli
atggccaatgttgaaatctataccaaagaaacctgcccgtattgccatcgtgcaaaagcactgctgagcagcaagggcgtgagttttcaggagttgccgatcgatggcaatgccgctaagcgtgaagagatgatcaaacgcagcggtcgcactacggttccacagatttttattgacgcacagcacattggtggctgtgatgacttgtatgcattggatgcacgtggtggactggatcccctgctgaaataa

SEQ ID NO: 8384 - protein, 83 aa, Escherichia coli
MANVEIYTKETCPYCHRAKALLSSKGVSFQELPIDGNAAKREEMIKRSGRTTVPQIFIDAQHIGGCDDLYALDARGGLDPLLK

SEQ ID NO: 8385 - DNA, 432 bp, Escherichia coli
atgcaagaaattatgcaatttgttggccgtcatcccatactgagtatcgcctggatcgcgttactggtggcggttcttgtgactacgtttaagagcctgacctcgaaagtgaaggtgattactcgtggtgaagctacgcgtctgatcaacaaagaagacgctgtggttgtggatttacgtcagcgtgatgacttccgtaaaggccatatcgcaggttctatcaacctgttgccgagcgaaatcaaagccaacaatgttggtgagcttgagaagcacaaagacaaaccggttatcgtggtagatggttctggcatgcagtgccaggagcctgcaaacgcgctgacgaaagctggttttgcgcaagtattcgtactgaaagaaggcgtcgctggctgggctggcgaaaacttgcctttggtgcgcggcaaataa

SEQ ID NO: 8386 - protein, 143 aa, Escherichia coli
MQEIMQFVGRHPILSIAWIALLVAVLVTTFKSLTSKVKVITRGEATRLINKEDAVVVDLRQRDDFRKGHIAGSINLLPSEIKANNVGELEKHKDKPVIVVDGSGMQCQEPANALTKAGFAQVFVLKEGVAGWAGENLPLVRGK

SEQ ID NO: 8387 - DNA, 1689 bp, Escherichia coli
ttgcggggcgctacgaaaaaaaagcgtaaatctggcatctgcttgccgcgagcggtcgtatattttgatcttcagaggctattttatcgattcagctgtagtaaaattacgcaaattttgactcttgagtatgaggttgtcgcaatgtcggtttctaaaaaacctatggtactggtgattctggatggctatggctatcgcgaagaacagcaggataacgccatttttagtgctaaaaccccggtaatggatgcactgtgggccaatcgtccgcataccctgatcgacgcttccggtttggaagtcggtctgcctgaccgtcagatgggcaactccgaagtaggccacgttaacctgggtgccggccgcatcgtgtatcaggacctgactcgtctggacgttgaaatcaaagatcgcgctttctttgctaatccggtgttgactggtgcagtagataaagcgaaaaacgcaggcaaagcagtacacattatgggtctgctctccgcaggtggtgtacacagccacgaagatcacatcatggcgatggtagaactggcagctgaacgcggcgcagaaaaaatctacctacacgcattccttgacggtcgcgacactccgccgcgcagtgctgaatcctcgctgaaaaaattcgaagagaaatttgccgcgctgggtaaaggccgcgtagcgtccatcattggtcgttactacgcgatggaccgcgataaccgttgggatcgcgttgaaaaagcttatgacctgctgactctggcgcaaggtgagttccaggccgataccgccgttgccggtttgcaggctgcttatgctcgcgacgaaaacgacgagttcgtgaaagcgaccgttattcgtgcagaaggtcagccagatgcggcaatggaagacggcgatgcgctgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgctgccgacatcaaaaccgcagtggcttacccacccgcttccctggttaacaccttcggcgagtggatggcgaaaaacgacaaaactcagctgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggcaatcaagagcggcaaatacgacaccattatctgtaactatccgaacggcgacatggtaggtcacaccggggtgatggaagcggcggttaaagcggttgaagcgctggatcactgcgtggaagaagtcgcgaaagcggttgagtccgtgggtggacaactgctgatcaccgctgaccacggtaacgctgaacagatgcgcgatccggcaacgggtcaggcacacacagcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataa

SEQ ID NO: 8388 - protein, 562 aa, Escherichia coli
MRGATKKKRKSGICLPRAVVYFDLQRLFYRFSCSKITQILTLEYEVVAMSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 8389 - DNA, 1260 bp, Escherichia coli
atgacacgggccgtgaaaccgcgcaggtttgcaatcaggcccatcatctacgccagcgttctgagcgctggcgtattgttgtgcgccttttccgcccacgcggatgagcgtgaccaactcaaatccattcaggctgacatcgccgcgaaagagcgcgcggtacgccaaaagcaacaacaacgcgcaagcctgctcgcacaattgaaaaagcaggaagaagcgatctctgaagccacccgtaaactgcgcgaaacgcaaaacacgcttaatcaactgaataaacagattgatgagatgaacgcgtcgattgccaaactagagcagcaaaaagccgcccaggagcgcagcctcgccgcgcaactggatgccgcgtttcgtcagggtgaacataccggtattcagctgattctcagcggtgaagaaagccagcgtgggcagcggttacaggcttatttcggctatctcaaccaggcgcgacaagaaaccattgctcagttgaaacaaacgcgtgaagaagtcgctatgcagcgtgccgaactggaagagaaacagagcgagcaacaaacgcttttatatgagcagcgcgcccaacaggcgaagctgacccaggcgttgagcgagcgtaagaaaacactggcagggctggagtcttccatccagcaaggtcagcaacagttgagcgagctgcgcgccaacgaatcccgtctgcgtaacagcattgcccgtgcggaagccgcggcgaaagcgcgtgctgaacgtgaagcgcgcgaagcccaggcggttcgcgaccgccagaaagaagcgacgcgcaaaggcaccacctacaagccgaccgaaagcgaaaaatcgctgatgtcccgtaccggtggtctgggcgcaccgcgcggtcaggcattctggccagttcgcgggccgacgctgcatcgctatggcgaacagctacagggtgaattacgctggaaagggatggtgattggtgcctctgaaggtactgaagttaaagcgattgccgacggccgggtgattctggctgactggctgcaaggctacggtctggtggtggtggttgagcatggtaaaggcgacatgagtctttacggctataatcagagcgcactggtgagcgttggttcgcaggttcgcgcgggccagccaattgcactggtgggcagcagtggcggtcagggtcggccttcactctatttcgaaattcgccgccagggtcaggcggtcaatccacagccgtggttgggaagataa

SEQ ID NO: 8390 - protein, 419 aa, Escherichia coli
MTRAVKPRRFAIRPIIYASVLSAGVLLCAFSAHADERDQLKSIQADIAAKERAVRQKQQQRASLLAQLKKQEEAISEATRKLRETQNTLNQLNKQIDEMNASIAKLEQQKAAQERSLAAQLDAAFRQGEHTGIQLILSGEESQRGQRLQAYFGYLNQARQETIAQLKQTREEVAMQRAELEEKQSEQQTLLYEQRAQQAKLTQALSERKKTLAGLESSIQQGQQQLSELRANESRLRNSIARAEAAAKARAEREAREAQAVRDRQKEATRKGTTYKPTESEKSLMSRTGGLGAPRGQAFWPVRGPTLHRYGEQLQGELRWKGMVIGASEGTEVKAIADGRVILADWLQGYGLVVVVEHGKGDMSLYGYNQSALVSVGSQVRAGQPIALVGSSGGQGRPSLYFEIRRQGQAVNPQPWLGR

SEQ ID NO: 8391 - DNA, 1035 bp, Escherichia coli
atgatgaacagcaccaataaacttagtgttattattccgttatataatgcgggcgatgatttccgcacttgtatggaatctttaattacgcaaacatggactgctctggaaatcattattattaacgatggttcaacggataattctgttgaaatagcaaagcattacgcagaaaactatccgcacgttcgtttgttgcatcaggcgaattctggcgcatcggtggcgcgtaatcgtgggattgaagtggcaacgggaaaatatgtcgcttttgtcgatgctgacgatgaggtctatcccaccatgtacgaaacgctgatgaccatggcgttagaggacgacctcgacgtggcgcagtgcaacgctgattggtgttttcgtgaaacgggtgaaacctggcaatccatccctaccgatcgccttcgctcaaccggtgtattaactggtccggactggctgcggatgggactttcttcccgccgttggacacacgtggtctggatgggggtttatcgccgcgatgttattgttaaaaataacattaaatttattgccggattacatcatcaggatattgtctggacaacagaatttatgtttaacgcgctgcgtgcgcgatataccgagcaatcattatataaatattatctgcataatacgtcagtgagtcggttgcatagacaagggaataaaaaccttaattatcaacgtcactatattaagattacccgcctgctggagaaattaaatcgaaattatgccgacaaaattacgatttatccggaatttcatcagcaaataacttacgaagcattgcgtgtttgccatgcggtgcgcaaagagccggatattattacccgccaacggatgattgctgagatatttacttccggtatgtataagcgcctgattaccaatgtgcgcagcgtgaaggtgggttaccaggcgttactgtggtctttccgcttatggcaatggcgcgacaaaacgcggtcgcaccatcgcattacgcgtagcgcctttaatttgcgctag

SEQ ID NO: 8392 - protein, 344 aa, Escherichia coli
MMNSTNKLSVIIPLYNAGDDFRTCMESLITQTWTALEIIIINDGSTDNSVEIAKHYAENYPHVRLLHQANSGASVARNRGIEVATGKYVAFVDADDEVYPTMYETLMTMALEDDLDVAQCNADWCFRETGETWQSIPTDRLRSTGVLTGPDWLRMGLSSRRWTHVVWMGVYRRDVIVKNNIKFIAGLHHQDIVWTTEFMFNALRARYTEQSLYKYYLHNTSVSRLHRQGNKNLNYQRHYIKITRLLEKLNRNYADKITIYPEFHQQITYEALRVCHAVRKEPDIITRQRMIAEIFTSGMYKRLITNVRSVKVGYQALLWSFRLWQWRDKTRSHHRITRSAFNLR

SEQ ID NO: 8393 - DNA, 960 bp, Escherichia coli
ttgtttccatttcgtcgtaacgttcttgcatttgccgctctgttggcgctctcctcccccgtaattgctggcaaacttgccatcgtcattgatgattttgggtatcgcccgcacaacgaaaaccaggtgctggcgatgccttccgctatctccgtcgctgtattacccgattcaccgcacgccagagagatggcgaccaaagcacataacagcggtcacgaagtgttgattcatctaccgatggcaccactgagtaaacagccgctggagaaaaatacgctacgcccggagatgagcagcgacgaaattgagcgcattattcgtagtgcggtcaataacgtgccctatgccgtggggatcaacaaccacatgggcagcaagatgacctctaacctgtttggtatgcagaaagtgatgcaggcgctggagcgttacaatctttacttcctcgacagcgtaaccatcggtaatacccaggcgatgcgcgccgcgcaaggcactggcgtgaaggtgatcaaacggaaggtgttcctcgacgattcgcaaaatgaagcggacatccgtatgcaatttaatcgcgcaattgacctggcacgtcgcaacggttcaaccattgccattggacatcctcacccttcaacggtacgcgtgctacaacagatggtttataacctgccgccagacattacgctggtgaaagccagcagcttgttgaatgaaccgcaggttgatacgtctacaccgccgaaaaacactgtgcccgacacaccgcgtaatccattccgtggcgtgaagctgtgcaaaccgaagaagccgatagaacctgtttatgctaatcgcttctttgaagtattaagcgaaagcatcagccagagcacgctgatcgtttacttccagcatcagtggcaaggctggggcaaacagcccgaatcggcaaaacttaacgctagcgcaaattaa

SEQ ID NO: 8394 - protein, 319 aa, Escherichia coli
MFPFRRNVLAFAALLALSSPVIAGKLAIVIDDFGYRPHNENQVLAMPSAISVAVLPDSPHAREMATKAHNSGHEVLIHLPMAPLSKQPLEKNTLRPEMSSDEIERIIRSAVNNVPYAVGINNHMGSKMTSNLFGMQKVMQALERYNLYFLDSVTIGNTQAMRAAQGTGVKVIKRKVFLDDSQNEADIRMQFNRAIDLARRNGSTIAIGHPHPSTVRVLQQMVYNLPPDITLVKASSLLNEPQVDTSTPPKNTVPDTPRNPFRGVKLCKPKKPIEPVYANRFFEVLSESISQSTLIVYFQHQWQGWGKQPESAKLNASAN

SEQ ID NO: 8395 - DNA, 984 bp, Escherichia coli
atgaccgacgttcctgtaccggaactcgggcataacgatctgctgattaaaatccgtaaaacagccatctgcgggactgacgttcacatctataactgggatgagtggtcgcaaaaaaccatcccggtgccgatggtcgtgggccatgaatatgtcggtgaagtggtaggtattggtcaggaagtgaaaggcttcaagattggcgatcgcgtttctggcgaaggccatatcacctgcggtcactgtcgcaactgtcgtggcggtcgtacccatctgtgccgcaacacgatcggcgtcggtgttaaccgtccgggctgcttcgccgagtatctggtgattccggcgttcaacgccttcaaaatcccggacaatatctccgacgacctggcttccatttttgatcccttcggtaacgctgtgcataccgcgctgtcgttcgatctggttggcgaggatgtgctggtctctggtgcaggtccgataggtattatggctgcggcggtggcgaaacacgttggtgcacgcaatgtggtgatcactgatgttaacgaataccgccttgagctggcacgcaaaatgggtatcacccgtgcggttaacgtcgctaaagaaaaccttaatgatgtgatgacagaactgggcatgaccgaaggctttgatgtcggtctggaaatgtccggtgcgccgccagcgtttcgtaccatgctcgacaccatgaaccacggcggtcgtattgcgatgctgggtattccaccgtccgatatgtctatcgactggaccaaagtaatctttaaaggcttgttcattaaaggtatttacggtcgtgagatgtttgaaacctggtacaagatggcggcgctgattcagtctggcctcgatctctcgccgatcattacccatcgtttctctatcgatgatttccagaagggctttgacgctatgcgttcgggccagtccgggaaagttattctgagctgggattaa

SEQ ID NO: 8396 - protein, 327 aa, Escherichia coli
MTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMTELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 8397 - DNA, 1197 bp, Escherichia coli
atgcgtggagaattttatcagcagttaaccaacgatctggaaaccgcacgggcggaagggttgtttaaagaagagcgcattattacgtctgcgcagcaagcagatatcactgtggctgatggaagccacgtcattaacttttgtgccaacaactatctcggactggcgaatcatccggatctgattgcggcggcaaaggcgggaatggattctcacggtttcggcatggcttcggtgcgttttatttgcggcactcaggacagccataaagagcttgaacaaaaactggcggccttcctggggatggaagatgcgattctctactcttcctgctttgatgctaacggcggcctgtttgaaacgctgctgagcgcggaggacgccattatctccgacgcactgaaccacgcgtctattattgatggtgtgcgtctgtgtaaagccaaacgctatcgttatgccaacaacgatatgcaggagctggaagcacgtctgaaagaagcgcgtgaagccggtgcgcgtcatgtgctgattgccaccgatggtgtgttctcgatggacggcgtgattgccaacctgaagggcgtttgcgatctggcagataaatacgatgccctggtgatggtagacgactcccacgcggtcggttttgtcggtgaaaatggtcgtggttcccatgaatactgcgatgtgatggggcgtgtagacatcattaccggtacgttgggtaaagcgttgggcggggcttctggtggttataccgcggggcgcaaagaagtggttgagtggctgcgccagcgttctcgtccgtacctgttctccaactcgctggcaccagcgattgtcgccgcatccatcaaagtactggagatggtcgaagcgggtagcgagctgcgtgaccgtctgtgggcgaacgcgcgtcagttccgtgagcaaatgtcggcggcgggctttaccctggcgggagccgatcacgccattattcccgtcatgcttggcgatgcggtagtggcgcagaaatttgcccgtgagctgcaaaaagagggcatttacgtcaccggtttcttctatccggtcgttcctaaaggtcaggcgcgtattcgtacccagatgtctgcggcgcatacccctgagcaaattacgcgtgcagtagaagcattcacgcgtattggtaaacaactgggcgttatcgcctga

SEQ ID NO: 8398 - protein, 398 aa, Escherichia coli
MRGEFYQQLTNDLETARAEGLFKEERIITSAQQADITVADGSHVINFCANNYLGLANHPDLIAAAKAGMDSHGFGMASVRFICGTQDSHKELEQKLAAFLGMEDAILYSSCFDANGGLFETLLSAEDAIISDALNHASIIDGVRLCKAKRYRYANNDMQELEARLKEAREAGARHVLIATDGVFSMDGVIANLKGVCDLADKYDALVMVDDSHAVGFVGENGRGSHEYCDVMGRVDIITGTLGKALGGASGGYTAGRKEVVEWLRQRSRPYLFSNSLAPAIVAASIKVLEMVEAGSELRDRLWANARQFREQMSAAGFTLAGADHAIIPVMLGDAVVAQKFARELQKEGIYVTGFFYPVVPKGQARIRTQMSAAHTPEQITRAVEAFTRIGKQLGVIA

SEQ ID NO: 8399 - DNA, 933 bp, Escherichia coli
atgatcatcgttaccggcggcgcgggctttatcggaagcaacatcgttaaagccctgaatgataaaggcatcaccgatattctggtggtggacaacctgaaagacggcaccaagtttgtgaacctggtggatctggatatcgcggactatatggataaggaagacttcctgatccagattatggctggcgaagagttcggcgatgtcgaagcgattttccacgaaggcgcgtgctcttccaccaccgagtgggacggcaagtatatgatggataacaactatcaatactccaaagagctgctgcactactgtctggagcgcgaaatcccgttcctgtatgcctcttccgcagccacttacggtggacgcacctccgactttattgaatcccgcgaatatgaaaaaccgttgaatgtctacggttactcaaaattcctgtttgatgaatatgttcgccaaatcctgcctgaagcgaactcacagattgttggcttccgttatttcaacgtttatggaccgcgtgaaggccataaaggcagcatggcgagcgtcgctttccatctcaacacccagcttaataacggtgaatcaccgaagctgttcgaaggtagcgagaactttaaacgtgacttcgtctatgtgggcgacgtggcagatgtaaacctgtggttcctggaaaatggcgtttccggcatcttcaacctcggcaccggtcgtgcggaatccttccaggcagtagcagatgctacgcttgcttatcacaagaaaggccaaatcgaatacattccgttcccggataaactgaaaggccgctaccaggcgttcactcaggcagatctgacgaatctgcgcgcggcgggttacgataaaccgttcaaaaccgttgccgaaggcgtaacggaatacatggcctggctgaatcgtgacgcataa

SEQ ID NO: 8400 - protein, 310 aa, Escherichia coli
MIIVTGGAGFIGSNIVKALNDKGITDILVVDNLKDGTKFVNLVDLDIADYMDKEDFLIQIMAGEEFGDVEAIFHEGACSSTTEWDGKYMMDNNYQYSKELLHYCLEREIPFLYASSAATYGGRTSDFIESREYEKPLNVYGYSKFLFDEYVRQILPEANSQIVGFRYFNVYGPREGHKGSMASVAFHLNTQLNNGESPKLFEGSENFKRDFVYVGDVADVNLWFLENGVSGIFNLGTGRAESFQAVADATLAYHKKGQIEYIPFPDKLKGRYQAFTQADLTNLRAAGYDKPFKTVAEGVTEYMAWLNRDA

SEQ ID NO: 8401 - DNA, 1047 bp, Escherichia coli
atgaaaatactggtgatcggcccgtcttgggttggcgacatgatgatgtcgcaaagtctctatcgcacgctccaggcgcgctatccccaggcgataatcgacgtgatggcaccggcatggtgccgtccattattatcgcggatgccggaagttaacgaagcgatccctatgcctctcggtcacggagcgctggaaatcggcgaacgccgcaaactgggtcatagtctgcgtgaaaagcgctacgaccgcgcctacgtcttacctaactccttcaaatccgcattagtgcctttcttcgcaggtattcctcatcgcaccggctggcgcggcgagatgcgctacggtttactcaacgatgtacgcgtgctcgataaagaagcctggccgctaatggtggaacgctatgtcgcgctggcctatgacaaaggtattatgcgtaccgcacaagatctgccgcagccattgttatggccgcagttgcaggtgagcgaaggtgaaaaatcatatacctgtaatcaattttcgctttcatcagaacgtccgatgattggtttttgcccgggtgcggagtttggtccggcaaaacgctggccacactaccactatgcggagctggcaaagcagctgattgatgaaggttatcaggtggttctgtttggctcggcgaaagatcatgaggcgggcaatgagattcttgccgctttgaatacagagcagcaggcatggtgtcggaatctggcgggagaaacacagcttgatcaagcggttatcctgattgcagcctgtaaagccattgttactaacgattctggtctgatgcacgttgcggcggcgctcaatcgtccgctggttgccctgtatggaccaagcagcccggacttcacaccaccgctatcccataaagcacgcgtgatccgcctgattaccggctatcacaaagtgcgtaaaggtgacgctgcggagggttatcaccagagcttgatcgacattactccccagcgcgtactggaagaactcaacgcgctattgttacaagaggaagcctga

SEQ ID NO: 8402 - protein, 348 aa, Escherichia coli
MKILVIGPSWVGDMMMSQSLYRTLQARYPQAIIDVMAPAWCRPLLSRMPEVNEAIPMPLGHGALEIGERRKLGHSLREKRYDRAYVLPNSFKSALVPFFAGIPHRTGWRGEMRYGLLNDVRVLDKEAWPLMVERYVALAYDKGIMRTAQDLPQPLLWPQLQVSEGEKSYTCNQFSLSSERPMIGFCPGAEFGPAKRWPHYHYAELAKQLIDEGYQVVLFGSAKDHEAGNEILAALNTEQQAWCRNLAGETQLDQAVILIAACKAIVTNDSGLMHVAAALNRPLVALYGPSSPDFTPPLSHKARVIRLITGYHKVRKGDAAEGYHQSLIDITPQRVLEELNALLLQEEA

SEQ ID NO: 8403 - DNA, 981 bp, Escherichia coli
atgcgggttctgatcgttaaaacatcgtcgatgggcgatgttctccacacgctgcccgcactcactgatgcccagcaggcaatcccagggattaagtttgactgggtggtggaagaagggttcgcacagattccttcctggcacgctgccgttgagcgagttattcctgtggcaatacgtcgctggcgtaaagcctggttctcggctcccataaaagctgaacgcaaagcgtttcgtgaagcgctacaagcaaagaactatgacgcagttatcgacgcccaggggctggtaaaaagcgcggcgctggtgacgcgtctggcgcatggcgtaaagcatggaatggactggcaaaccgctcgcgaaccgttagccagcctgttttacaatcgtaaacatcatattgcaaaacagcagcacgccgtagaacgcacccgcgaactgtttgccaaaagtctgggctatagcaaaccacaaacccagggcgattatgctatcgcacagcatttcctgacgaacctgcctacagatgctggcgaatatgccgtatttcttcatgcaacaacccgagatgataaacactggccggaagaacactggcgagaattgattggtttactggctgattcaggaatacggattaaacttccgtggggcgcgccgcatgaggaagaacgggcgaaacgactggcggaaggatttgcttatgttgaagtattgccgaagatgagtctggaaggcgttgcccgcgtactggccggggctaaatttgtagtgtcggtggatacggggttaagccatttaacggcggcactggatagacccaatatcacggtttatggacctaccgatccgggattaattggtgggtatgggaagaatcagatggtttgtagggctccggggaatgagttgtctcaattgacagcaaatgctgttaagcaattcattgaagaaaacgctgaaaaagctgccatgatttaa

SEQ ID NO: 8404 - protein, 326 aa, Escherichia coli
MRVLIVKTSSMGDVLHTLPALTDAQQAIPGIKFDWVVEEGFAQIPSWHAAVERVIPVAIRRWRKAWFSAPIKAERKAFREALQAKNYDAVIDAQGLVKSAALVTRLAHGVKHGMDWQTAREPLASLFYNRKHHIAKQQHAVERTRELFAKSLGYSKPQTQGDYAIAQHFLTNLPTDAGEYAVFLHATTRDDKHWPEEHWRELIGLLADSGIRIKLPWGAPHEEERAKRLAEGFAYVEVLPKMSLEGVARVLAGAKFVVSVDTGLSHLTAALDRPNITVYGPTDPGLIGGYGKNQMVCRAPGNELSQLTANAVKQFIEENAEKAAMI

SEQ ID NO: 8405 - DNA, 1254 bp, Escherichia coli
atgtcgttttgttggaatgaaattaactctggtgtcaagtctttaattctcatattatgtatgttgtctttaatgactttgtctttgtgggatgatgttgcaacaaagtttcttcatgcagctggaattatatctgcattatattttctagcgacaccaaaaaaaacaataactaataatcctactttgttaattttcatctcattatgtcttttgggtatcgttaatatcatctggtattcacattataaagtttcaggctcggtttataccaatgcatatcgtggcccaatggaaactggaaaaattgccttgtgtagtgcttttattttcttagttctttttgctaaagatgagatgagaaccaaaataaaatttgggaaactaattctgttcgcatccttggcaacgcagttacttttttttgcgcatgccatgtggcaacatttctatttaaacgtcgaccgtgttgcattatcagcttcccacgctacaacagcaggctacatcatccttttcccttctttactggcatcaattctcattttaaaatccgactttagacataaaacaacattatatacaattaacttcatgcttagcttatgtgctgttatagtaactgaaacgcgtgcagccatattagtgtttccattctttgcgttactattaatcgtaatggatagttatattaataagcgaattaattataagttatattgttttattgcgattgcattattagcaggtgtattttcttttaaagatacattacttacgagaatgaatgacttaaatagggatttagttaattattcgcatgataacaccagaacttcagtcggtgcccgtctggcaatgtatgaagttggtttaaaaacatattctccaataggacaatcactggaaaaacgtgcggaaaaaatacatgaactagaagagaaagagcctagattaagtggtgctttaccctttgtagattctcatttgcataacgatctcatagatacgttatcaacgcgtggtattcctggagtagcattaacaattttagccttttcagcaatattcatatatgccttaagaactgctaaagaaccttatattttaatcttgcttttttcactactggtagtaggcctaagtgatgtaatactcttttctaaaccggttccgactgctgtgtttgtcaccataatattgctttgtgcttattttaaagtacaatcggaccaatgtttattagataagtaa

SEQ ID NO: 8406 - protein, 417 aa, Escherichia coli
MSFCWNEINSGVKSLILILCMLSLMTLSLWDDVATKFLHAAGIISALYFLATPKKTITNNPTLLIFISLCLLGIVNIIWYSHYKVSGSVYTNAYRGPMETGKIALCSAFIFLVLFAKDEMRTKIKFGKLILFASLATQLLFFAHAMWQHFYLNVDRVALSASHATTAGYIILFPSLLASILILKSDFRHKTTLYTINFMLSLCAVIVTETRAAILVFPFFALLLIVMDSYINKRINYKLYCFIAIALLAGVFSFKDTLLTRMNDLNRDLVNYSHDNTRTSVGARLAMYEVGLKTYSPIGQSLEKRAEKIHELEEKEPRLSGALPFVDSHLHNDLIDTLSTRGIPGVALTILAFSAIFIYALRTAKEPYILILLFSLLVVGLSDVILFSKPVPTAVFVTIILLCAYFKVQSDQCLLDK

SEQ ID NO: 8407 - DNA, 984 bp, Escherichia coli
atgagcaatgattaccctttagtatccataataataccgacgtataattcatctgattacattactgaaactctaacgaaattagaaaaacaaacttacccaaattttgaaattgttattgttaatgatggttctaaagataacacatcaagtgttttgagagagtatgggttaacccactctcgattaattattatcaataaagaaaatggcggtgtttcgtctgccaggaatacaggtatccgcaaggcgcaaggacagtttatatgttttatggatgatgatgatgagatagatcctaactatctgctgaagatgtattccagacaacatgagacgggaggggatgcgatttattgtgggctttatggccatcatataaaaaatggtgttacttactcacctataaatacagattttaatgaagggtctttacttttcgattttttttataaaaaggtcagattccatataggatgcttgtttataagaaaacaactcctggaagataataatcttttttttgatgaagatttacgactaggagaagatctggattttatctatcgactgctaattacatgcgatatgtatgcggttccatattatatgtataagcataactatagagaaaattccttaatgaactcatgtagaaccatcactcattatcgacatgagtcatttgcgcacgaaagaatctactcttctgtgatgcagttatacaaaggtaaccggaaagaagaaattcatacattattgagtaaaaatagaacttatcataaaactcgttatttatggaatgttctacttaatggcgattttgaattattaaatcaattagttgaaagcaatgaaaaagaattgaaagattgtaatcttcttggcaagagagataagaggcgagcaaagatattagcatcaaaaaactatattctctggaggatggtaagactggtaaatagaaaaaagaataaacgttag

SEQ ID NO: 8408 - protein, 327 aa, Escherichia coli
MSNDYPLVSIIIPTYNSSDYITETLTKLEKQTYPNFEIVIVNDGSKDNTSSVLREYGLTHSRLIIINKENGGVSSARNTGIRKAQGQFICFMDDDDEIDPNYLLKMYSRQHETGGDAIYCGLYGHHIKNGVTYSPINTDFNEGSLLFDFFYKKVRFHIGCLFIRKQLLEDNNLFFDEDLRLGEDLDFIYRLLITCDMYAVPYYMYKHNYRENSLMNSCRTITHYRHESFAHERIYSSVMQLYKGNRKEEIHTLLSKNRTYHKTRYLWNVLLNGDFELLNQLVESNEKELKDCNLLGKRDKRRAKILASKNYILWRMVRLVNRKKNKR

SEQ ID NO: 8409 - DNA, 927 bp, Escherichia coli
atggatttattagctgagagtattactgaagtcgctgtctctggggaaattgctaacaccgatcgtgtgttaaatatcgcttacggtattgaccgcaactttttatttggtgcggcagtatctatgcaatcagttgttatgcataacccggaccttgcggttaagtttcatctctttactgactacattgatgaagattatctacaacgtgttaatgcttttaccagcaaaaatgctaacgttgaagtaagaatttataaagtatccagtgcctttattgatatcttccccagcctgaaacagtggtcttatgcaacattcttccgtttagttgcgttccagtatctgagtgaaactattgaaaatctgttatatatcgatgctgatgtcatatgtaaaggctcattagctggattgcttgatattaattttgatggcgataagttcgcggctgttattaaagatgtgccttttatgcaggaaaaacctgcgaagcgtctggctatagagggacttccagggaattatttcaacgccggtgtagtatatctgcagcttgaagcatgggcgaaaaatgattttatgaataaagccattgctatgctggcaagtgacccgcagcacacgaaatataaatgccttgatcaggatattttaaatattctgttctttagtcattgtatttttattagcggcgattatgattgcttttatggcattgactatgagttaaaaaataaaagcgatgaagattataaaaagaccattaccgatgatactaagctgattcattatgttggcgtaacgaagccstggaacgactggacgaattatcctgccagaagtattttaatgaggcttatcaggtttcttgctggaatgatgtggcgtttattccagccacgaatgaaaagcagtatcaagtga

SEQ ID NO: 8410 - protein, 308 aa, Escherichia coli
MDLLAESITEVAVSGEIANTDRVLNIAYGIDRNFLFGAAVSMQSVVMHNPDLAVKFHLFTDYIDEDYLQRVNAFTSKNANVEVRIYKVSSAFIDIFPSLKQWSYATFFRLVAFQYLSETIENLLYIDADVICKGSLAGLLDINFDGDKFAAVIKDVPFMQEKPAKRLAIEGLPGNYFNAGVVYLQLEAWAKNDFMNKAIAMLASDPQHTKYKCLDQDILNILFFSHCIFISGDYDCFYGIDYELKNKSDEDYKKTITDDTKLIHYVGVTKPWNDWTNYPARSILMRLIRFLAGMMWRLFQPRMKSSIK

SEQ ID NO: 8411 - DNA, 693 bp, Escherichia coli
atgattacaagtatacgctatcgcggcttctcattttattacaaagataacgataataaatataaagaaatctttgatgaaatactggcctataattttaaaacagtaaaagtattacgtaatattgatgataccaaagtatcgttgattgatacgaaatatggtcgctatgtttttaaagtctttgccccgaaaacgaaaaggaatgaacgttttttaaaatcttttgtaaaaggtgactactatcagaatttgatcgttgaaaccgatcgtgtcagaagtgcaggtcttacttttcctaatgatttttattttctggctgagcgtaaaattttcaactatgccagtgtttttatcatgcttatcgagtatgtcgagggcgtagagctcaatgatatgccgattattccagaagatgttaaagcagaaattaaggcttcaatggaaaaattgcatgccttaaatatgctatcgggcgacccacaccggggtaactttatcgttagtaaagatggtgtcaggataattgacctctccggtaaaagctgtacggcagagcggaaagcccgtgatcgtctggccatggaacgtcacctgggtattgccaacgaaataaaagattatggctactattcagtaatctacagaaccaaactacgcaaatttattaaaaaattaaaaggcaaagcgtaa

SEQ ID NO: 8412 - protein, 230 aa, Escherichia coli
MITSIRYRGFSFYYKDNDNKYKEIFDEILAYNFKTVKVLRNIDDTKVSLIDTKYGRYVFKVFAPKTKRNERFLKSFVKGDYYQNLIVETDRVRSAGLTFPNDFYFLAERKIFNYASVFIMLIEYVEGVELNDMPIIPEDVKAEIKASMEKLHALNMLSGDPHRGNFIVSKDGVRIIDLSGKSCTAERKARDRLAMERHLGIANEIKDYGYYSVIYRTKLRKFIKKLKGKA

SEQ ID NO: 8413 - DNA, 996 bp, Escherichia coli
atgaatgaatttataaaagaacggttttcgtatttagcagataataaaaaagaaaacgccccagagctaaatgtttcctacggtatcgataagaattttttgtatggtgctggcgtttcaatttcttccgttttgattaataattcagatattaattttgtctttcatgttttcactgattatgtggatgatgattatttaaagtcatttaatgaaacagcaaaacaatttaatacctcaattattgtatatttaattgacccaaaatactttgctgatctgccgacgtcacagttttggtcgtacgcgacatacttcagggtattgtcctttgaatatctgagtgaaagtatttccacactgctgtatctggatgccgatgtcgtttgtaaaggaagtctgaaacctctcacaaaaattatatttaaagatgagtttgctgcggttattcctgacaatgatagtactcaggcggcatgtgcaaaacgtcttaacattcccgaaatgaatggacgttatttcaatgcaggcgttatctatgtcaatcttaaaaaatggcatgaagcaaatttgacaccgtatttactcacgcttttacgaggggaaactaaatatggctctcttaaatatttagatcaggatgcgttgaatatcgcatttaatatgaataatatctacctcgcgaaggattttgatactatttataccctgaaaaacgaacttcatgatcgtagtcatcgaaagtatcagcaaaccattaccgataaaacagtattgattcactatacagggataactaaaccatggcatagctgggctggatatccgtctgcatcatactttaatatcgcgcgtgaacaatctccctggaagaaatatcctcttaaagaggcgcggactgttgcagaaatgcagaaacaatataagcatctgtttgcccatggtgagtatattaaaggtataacttcattaattaagtacaagcttaagaaataa

SEQ ID NO: 8414 - protein, 331 aa, Escherichia coli
MNEFIKERFSYLADNKKENAPELNVSYGIDKNFLYGAGVSISSVLINNSDINFVFHVFTDYVDDDYLKSFNETAKQFNTSIIVYLIDPKYFADLPTSQFWSYATYFRVLSFEYLSESISTLLYLDADVVCKGSLKPLTKIIFKDEFAAVIPDNDSTQAACAKRLNIPEMNGRYFNAGVIYVNLKKWHEANLTPYLLTLLRGETKYGSLKYLDQDALNIAFNMNNIYLAKDFDTIYTLKNELHDRSHRKYQQTITDKTVLIHYTGITKPWHSWAGYPSASYFNIAREQSPWKKYPLKEARTVAEMQKQYKHLFAHGEYIKGITSLIKYKLKK

SEQ ID NO: 8415 - DNA, 1017 bp, Escherichia coli
atgagtgcccactattttaatccacaagagatgatcaataagacaatcatcttcgatgaaagcccagaggcgtcagtggcatcatcattccatgttgcttatggcattgatcagaactttctttttggttgtggtgtttcaatcacgtcagttttgttacataacaacgacgtgagttttgtcttccacgtttttattgatgatatccctgaagccgatatccagcgtttatcccaattagcgaaaagctatcatacctgtatccagatccatctggtgaattgtgaacggcttaaggcattaccgacgaccaaaaattggtctattgccatgtatttccgttttgtaattgcagattactttattgatcaacaagataagatcctgtacctggatgctgatatcgcctgtcagggaaacttaaagccgctgataacaatggatcttgccaataacgttgctgctgttgttactgaacgcgatgctaactggtggtcgttacggggtcaaagtctgcagtgtaatgaacttgaaaagggttactttaattcaggtgtcctgttaattaatacactagcgtgggcgcaggagtccgtttctgctaaagcgatgtcgatgcttgctgataaagccatcgtttcccgtttaacctatatggatcaagatatccttaatcttatcctgttagggaaagttaaattcattgatgctaaatacaatacgcaatttagtttaaattatgaattaaaaaaatcatttgtttgtccaattaatgatgaaaccgtattaattcattatgtcggcccgacaaaaccctggcattactgggccggttatccaagtgcgcaaccttttatcaaagccaaagaagcatcgccctggaaaaatgaaccgttaatgcggccagttaactcaaattatgctcgttattgcgctaagcataattttaaacaaaacaaaccaattaacgggataatgaattatatttattatttttatttaaagataataaaatga

SEQ ID NO: 8416 - protein, 338 aa, Escherichia coli
MSAHYFNPQEMINKTIIFDESPEASVASSFHVAYGIDQNFLFGCGVSITSVLLHNNDVSFVFHVFIDDIPEADIQRLSQLAKSYHTCIQIHLVNCERLKALPTTKNWSIAMYFRFVIADYFIDQQDKILYLDADIACQGNLKPLITMDLANNVAAVVTERDANWWSLRGQSLQCNELEKGYFNSGVLLINTLAWAQESVSAKAMSMLADKAIVSRLTYMDQDILNLILLGKVKFIDAKYNTQFSLNYELKKSFVCPINDETVLIHYVGPTKPWHYWAGYPSAQPFIKAKEASPWKNEPLMRPVNSNYARYCAKHNFKQNKPINGIMNYIYYFYLKIIK

SEQ ID NO: 8417 - DNA, 798 bp, Escherichia coli
atggttgaacttaaagagccgtttgccacgttatggcgcggtaaagatccttttgaggaagttaaaaccttgcagggtgaggtatttcgtgaactggaaactcgccgcactctgcgctttgaaatggcgggcaaaagctattttctcaaatggcatcgcggcacgaccctgaaagagataatcaaaaatttactctcattgcggatgccagtattaggcgcagaccgcgaatggaatgcgattcatcgactgcgggatgtcggcgttgatactatgtatggggtggcattcggcgaaaaaggcattaatccgctgaccagaacctcgtttattattaccgaagatctgacaccaaccatcagtctggaagattactgtgctgactgggcgaccaacccaccagatgttcgcgtaaagcgtatgcttattaagcgtgtcgcgacgatggtgcgcgatatgcatgctgcgggcattaaccaccgtgactgttatatctgtcatttcctgctgcacttgcctttttccggtaaggaagaggtgttaaaaatttcagtaattgacctgcaccgggcgcagatacgtgcaaaagtaccgcgtcgttggcgggataaagatcttattggactttatttttcttcgatgaatattggcctgactcagcgggatatctggcggtttatgaaagtgtattttgtcgccccgcttaaagacattatcaagcaggaacaagggctgctgtcgcaagcagaagaaaaagccacaaaaatcagggaaagaacgattcgaaaatcgttgtaa

SEQ ID NO: 8418 - protein, 265 aa, Escherichia coli
MVELKEPFATLWRGKDPFEEVKTLQGEVFRELETRRTLRFEMAGKSYFLKWHRGTTLKEIIKNLLSLRMPVLGADREWNAIHRLRDVGVDTMYGVAFGEKGINPLTRTSFIITEDLTPTISLEDYCADWATNPPDVRVKRMLIKRVATMVRDMHAAGINHRDCYICHFLLHLPFSGKEEVLKISVIDLHRAQIRAKVPRRWRDKDLIGLYFSSMNIGLTQRDIWRFMKVYFVAPLKDIIKQEQGLLSQAEEKATKIRERTIRKSL

SEQ ID NO: 8419 - DNA, 1125 bp, Escherichia coli
atgatcgttgctttttgtttatataaatattttccctttggcggtttgcagcgcgattttatgcgtattgctcagacagtcgccgcccgaggtcatcatgttcgggtttatacccagtcgtgggaaggcgaatgccctgatgtatttgaactgatcaaagtgccggttaaatcgcataccaatcacgggcgcaatgcggagtattttgcctgggtgcaaaaacatttacgcgaacatcccgtcgataaagtcgttggattcaacaaaatgccggggctggacgtttattatgccgctgatgtttgctatgccgagaaagtagcgcaggaaaaaggctttttctatcgcctgacgtcacgttatcgccattatgccgcctttgagcgggcaaccttcgaacagggcaagccgacacagctgctgatgctgacagataagcaaatcgccgatttccagaaacattatcagactgaagcggagcgttttcatattctgcctccggggatttatcctgatcgtaaatatagccagcagccagccaatagccgtgaaatcttccgtaagaagaatggaataaccgaacaacaatatttattgttgcaggttggttcagacttcacgcgtaaaggtgtcgatcgttccattgaagcacttgcttcgttaccggattcgctgcgccacaacacattactatatgttgttgggcaggataaaccgcgaaaatttgaggcgctggcagaaaaacgcggcgtgcgcagtaatgttcacttcttctcggggcgcaacgatgtctcggaattaatggcagcggcggatttattacttcatcctgcctaccaggaagccgcgggaattgtactgctggaagcgataactgcaggattaccggtactaacaacagccgtttgtggctatgcgcattatattgtcgacgccaattgcggcgaggctattgctgagccattccgccaggaaacattgaatgagattttacgcaaagcgttaacgcaatcttcattgcgccaggcatgggcggaaaatgcgcgacattatgctgatacacaagatttatacagtctgccagagaaagcggcggacatcataacgggtggtctggatggttga

SEQ ID NO: 8420 - protein, 374 aa, Escherichia coli
MIVAFCLYKYFPFGGLQRDFMRIAQTVAARGHHVRVYTQSWEGECPDVFELIKVPVKSHTNHGRNAEYFAWVQKHLREHPVDKVVGFNKMPGLDVYYAADVCYAEKVAQEKGFFYRLTSRYRHYAAFERATFEQGKPTQLLMLTDKQIADFQKHYQTEAERFHILPPGIYPDRKYSQQPANSREIFRKKNGITEQQYLLLQVGSDFTRKGVDRSIEALASLPDSLRHNTLLYVVGQDKPRKFEALAEKRGVRSNVHFFSGRNDVSELMAAADLLLHPAYQEAAGIVLLEAITAGLPVLTTAVCGYAHYIVDANCGEAIAEPFRQETLNEILRKALTQSSLRQAWAENARHYADTQDLYSLPEKAADIITGGLDG

SEQ ID NO: 8421 - DNA, 1059 bp, Escherichia coli
gtggataagccatttcgaagaattttgctcattaagatgcgttttcatggggatatgttattaactactcccgtcattagttcgctgaaaaaaaattaccctgacgcaaaaatcgatgtgctgctttatcaggacaccatcccgatcctgtctgaaaatccagagattaacgcgctctacggcataaaaaataaaaaagcaaaagcctcagaaaaaattgccaacttttttcatctcatcaaggtattacgtgccaataagtatgaccttatcgttaatcttaccgatcaatggatgattgctatactggttcgtttattaaatgcccgtgtgaaaatttcccaggattatcatcatcggcagtctgctttttggcgtaatagtttcactcatttggtgccgttgcagggtggaaatgtggtggaaagtaacttatccgtgctgacgccattgggacttgaatcgttggtgaagcagacaaccatgagttacccgcctgcaagctggaaacgtatgcgtcgcgaacttgatcatgcaggtgttggacaaaattatgtggttatccaacctacggcgcggcaaatcttcaaatgctgggacaacgccaagttttccgctgtgattgatgccttacatgctcgtggttatgaagtcgttctgacgtccggcccagataaagacgatctggcctgcgtcaatgaaattgcccagggatgccagacgctaccagtaacggcgctggccggaaaggtgaccttcccggaacttggtgcgttaatcgatcatgcccagctgtttattggcgttgattccgcaccggcgcatattgccgctgcagttaatacgccgctgatatcgctgtttggtgcgacagaccatattttctggcgtccctggtcaaataacatgattcaattctgggcgggagattaccgggaaatgccaacgcgcgatcagcgtgaccgaaatgagatgtatctttcggttattccggcggcagatgtcattgctgctgtcgataaattactgccctcctccacgacaggtacgtcgttatga

SEQ ID NO: 8422 - protein, 352 aa, Escherichia coli
MDKPFRRILLIKMRFHGDMLLTTPVISSLKKNYPDAKIDVLLYQDTIPILSENPEINALYGIKNKKAKASEKIANFFHLIKVLRANKYDLIVNLTDQWMIAILVRLLNARVKISQDYHHRQSAFWRNSFTHLVPLQGGNVVESNLSVLTPLGLESLVKQTTMSYPPASWKRMRRELDHAGVGQNYVVIQPTARQIFKCWDNAKFSAVIDALHARGYEVVLTSGPDKDDLACVNEIAQGCQTLPVTALAGKVTFPELGALIDHAQLFIGVDSAPAHIAAAVNTPLISLFGATDHIFWRPWSNNMIQFWAGDYREMPTRDQRDRNEMYLSVIPAADVIAAVDKLLPSSTTGTSL

SEQ ID NO: 8423 - DNA, 1278 bp, Escherichia coli
atgctcgaattgctttacaccgcccttttctaccttattcagccgctgatctggatacggctctgggtgcgcggacgtaaggctccggcctatcgaaaacgctggggtgaacgttacggtttttaccgccatccgctaaaaccaggcggcattatgctgcactccgtctccgtcggtgaaactctggcggcgatcccgttggtgcgcgcactgcgtcatcgttatcctgatttaccgattaccgtaacaaccatgactccaaccggttcggagcgcgtacaatcggctttcgggaaggatgttcagcacgtttatctgccgtatgacctgcccgatgcactcaaccgtttcctgaataaagtcgaccctaaactggtgttgattatggaaaccgaactatggcctaacctgattgcggcgctacataaacgtaaaattccgctggtgatcgctaacgcgcgactctctgcccgctcggccgcaggttatgccaaactgggtaaattcgtccgccgcttgctgcgtcgtattacgctgattgccgcccaaaatgaagaagatggtgcacgttttgtggcgctgggcgcaaaaaataatcaggtgaccgttaccggtagcctgaaattcgatatttctgtaacgccgcagttggctgctaaagccgtgacgctgcgccgccagtgggcaccacaccgcccggtatggattgccaccagcactcatgaaggcgaagagagtgtggtgatcgccgcacatcaggcattgttacagcaattcccgaatttattgctcatcttggtaccccgtcatccagaacgcttcccggatgcgattaaccttgtccgccaggctggactaagctatatcacacgatcttcaggggaagtcccctccaccagcacgcaggttgtggttggcgatacgatgggcgagttgatgttactgtacggcattgccgatctcgcctttgttggcggttcactggttgaacgtggtgggcataatccgctggaagcggccgcacacgctattccggtattgatggggccgcatacgtttaactttaaagacatttgcgcgcggctggagcaggcaagcgggctgattaccgttaccgatgccactacgcttgcaaaagaggtttcctctttactcaccgacgccgattaccgtagtttctatggccgtcatgccgttgaagtgctgtatcaaaaccagggcgcgctacagcgtctgcttcaactgctggaaccttacctgccaccgaaaacgcattga

SEQ ID NO: 8424 - protein, 425 aa, Escherichia coli
MLELLYTALFYLIQPLIWIRLWVRGRKAPAYRKRWGERYGFYRHPLKPGGIMLHSVSVGETLAAIPLVRALRHRYPDLPITVTTMTPTGSERVQSAFGKDVQHVYLPYDLPDALNRFLNKVDPKLVLIMETELWPNLIAALHKRKIPLVIANARLSARSAAGYAKLGKFVRRLLRRITLIAAQNEEDGARFVALGAKNNQVTVTGSLKFDISVTPQLAAKAVTLRRQWAPHRPVWIATSTHEGEESVVIAAHQALLQQFPNLLLILVPRHPERFPDAINLVRQAGLSYITRSSGEVPSTSTQVVVGDTMGELMLLYGIADLAFVGGSLVERGGHNPLEAAAHAIPVLMGPHTFNFKDICARLEQASGLITVTDATTLAKEVSSLLTDADYRSFYGRHAVEVLYQNQGALQRLLQLLEPYLPPKTH

SEQ ID NO: 8425 - DNA, 480 bp, Escherichia coli
atgcaaaaacgggcgatttatccgggtactttcgatcccattaccaatggtcatatcgatatcgtgacgcgcgccacgcagatgttcgatcacgttattctggcgattgccgctagtcccagtaaaaaaccgatgtttacccttgaagagcgtgtggaactggcacagcaggcaaccgcacatctggggaacgtggaagtggtcgggtttagtgatttgatggcgaacttcgcccgtaatcaacacgctacggtgctgattcgtggcctgcgtgcggtggcggattttgaatatgaaatgcagctggcgcatatgaatcgccacttaatgccggagctggaaagtgtgtttctgatgccgtcgaaagagtggtcgtttatctcttcatcgttggtgaaagaggtggcgcgccatcagggcgatgtcacccatttcctgccggagaatgtccatcaggcgctgatggcgaagttagcgtag

SEQ ID NO: 8426 - protein, 159 aa, Escherichia coli
MQKRAIYPGTFDPITNGHIDIVTRATQMFDHVILAIAASPSKKPMFTLEERVELAQQATAHLGNVEVVGFSDLMANFARNQHATVLIRGLRAVADFEYEMQLAHMNRHLMPELESVFLMPSKEWSFISSSLVKEVARHQGDVTHFLPENVHQALMAKLA

SEQ ID NO: 8427 - DNA, 810 bp, Escherichia coli
atgcctgaattacccgaagttgaaaccagccgtcgcggcatagaaccgcatctcgttggtgcaaccattcttcatgcggtggtgcgcaacggacgcttgcgctggccggtttcagaagagatctaccgtttaagcgaccaaccagtgcttagcgtgcagcgccgggctaaatatctgctgctggagctgcctgagggctggattatcattcatttggggatgtctggcagcctgcgcatccttccagaagaacttccccctgaaaagcatgaccatgtggatttggtgatgagcaacggcaaagtgctgcgctacaccgatccgcgccgctttggtgcctggctatggaccaaagagctggaagggcacaacgtgctggcccatcttggaccggagccgcttagtgacgatttcaacggtgagtacctgcatcagaagtgcgcgaagaaaaaaacggcgattaaaccgtggctgatggataacaagctggtggtaggcgtagggaatatctatgccagcgaatcgctgtttgcggcggggatccatccggatcggctggcgtcatcactgtcgctggcggagtgtgaattgttagctcgggtgattaaagcggtgttgctgcgttcgattgagcagggcggtacaacgctgaaagattttctgcaaagtgatggtaaaccgggctatttcgctcaggaattgcaggtttacgggcgaaaaggtgagccgtgtcgggtgtgcggtacgccgattgtggcgactaaacatgcgcagcgggcaacgttttattgtcggcagtgccagaagtaa

SEQ ID NO: 8428 - protein, 269 aa, Escherichia coli
MPELPEVETSRRGIEPHLVGATILHAVVRNGRLRWPVSEEIYRLSDQPVLSVQRRAKYLLLELPEGWIIIHLGMSGSLRILPEELPPEKHDHVDLVMSNGKVLRYTDPRRFGAWLWTKELEGHNVLAHLGPEPLSDDFNGEYLHQKCAKKKTAIKPWLMDNKLVVGVGNIYASESLFAAGIHPDRLASSLSLAECELLARVIKAVLLRSIEQGGTTLKDFLQSDGKPGYFAQELQVYGRKGEPCRVCGTPIVATKHAQRATFYCRQCQK

SEQ ID NO: 8429 - DNA, 168 bp, Escherichia coli
atggctaaaggtattcgtgagaaaatcaagctggtttcttctgctggtactggtcacttctataccactacgaagaacaaacgtactaagccggaaaaactggaactgaaaaaattcgatccagttgttcgccagcacgtgatctacaaagaagcgaaaatcaaataa

SEQ ID NO: 8430 - protein, 55 aa, Escherichia coli [sequence omitted]

SEQ ID NO: 8431 - DNA, 237 bp, Escherichia coli
atgtcccgagtctgccaagttactggcaagcgtccggtgaccggtaacaaccgttcccacgcactgaacgcgactaaacgccgtttcctgccgaatctgcactctcaccgtttctgggttgagagcgagaagcgttttgtcaccctgcgcgtatctgctaaaggtatgcgtgtaatcgataaaaaaggcatcgatacagttctggctgaactgcgtgcccgtggcgaaaagtactaa

SEQ ID NO: 8432 - protein, 78 aa, Escherichia coli [sequence omitted]

SEQ ID NO: 8433 - DNA, 630 bp, Escherichia coli
atgctgaagtttggtattagcgccttaacggatgtcgagctgttggcgctatttctgcgtaccggaacgcgcggtaaagatgtattaaccctggcaaaagagatgctggagaatttcggctctctttatggcttgttaacctctgaatatgagcaatttagtggcgttcatggaattggcgtggcgaaattcgcccagttaaaggggattgccgaactggcgcggcgttactacaacgtacggatgcgtgaagaaagccctttactcagcccggagatgacgagggaatttttacaaagccagctcacgggcgaggagcgggagatctttatggtgatctttctcgactcccaacaccgggttataacgcatagccgtcttttttccggcacgctaaaccatgttgaagtccatcctcgggaaattatccgcgaagcgataaaaataaacgcctcggcgctgatccttgcgcataatcacccttcgggttgtgctgaacccagtaaagcggataaactcattactgaacggataataaagagttgtcagttcatggatttacgcgtgctcgaccatatcgtgattgggcgtggagagtatgtttcttttgccgaacgcggctggatttaa

SEQ ID NO: 8434 - protein, 209 aa, Escherichia coli
MLKFGISALTDVELLALFLRTGTRGKDVLTLAKEMLENFGSLYGLLTSEYEQFSGVHGIGVAKFAQLKGIAELARRYYNVRMREESPLLSPEMTREFLQSQLTGEEREIFMVIFLDSQHRVITHSRLFSGTLNHVEVHPREIIREAIKINASALILAHNHPSGCAEPSKADKLITERIIKSCQFMDLRVLDHIVIGRGEYVSFAERGWI

SEQ ID NO: 8435 - DNA, 1221 bp, Escherichia coli
atgagcctggccggtaaaaaaatcgttctcggcgttagcggcggtattgctgcctataaaacccctgaactggtgcgtcgtttgcgcgatcgcggggccgatgtccgcgtagccatgaccgaagcggcaaaagcctttatcaccccacttagcttgcaggcggtttctggttatcccgtttccgacagtctgctggacccggcagccgaagccgctatgggccatattgagctgggaaaatgggctgatttagtgattctcgcccctgccacggcagatttaattgcccgtgttgcagccggaatggcgaatgacctggtatcgacgatttgtctggctacacctgcgcctgtagccgtgctccccgccatgaaccagcagatgtaccgtgccgccgccacccagcataatttagaggtgcttgcctcgcgtggtttgctcatctgggggccagacagcggcagtcaggcttgtggtgatatcggcccagggcgaatgctcgatccgttaaccattgtggatatggcggtagcgcatttttcgcccgtcaacgacctgaaacatctgaacattatgattaccgccggtccgacgcgtgaaccgctcgatcccgtgcgttatatctctaatcacagctccggcaagatgggttttgctatcgccgccgccgcagcccgtcgtggtgcgaacgtcacgctggtatcaggtccggtttcattaccgacgccaccgtttgttaaccgtgttgatgtgatgaccgcgctggaaatggaagccgccgtgaatgcttcagtacagcagcaaaatatttttatcggttgcgccgccgtggcggattatcgcgcagctaccgtggccccagaaaaaatcaaaaagcaggccacgcagggtgatgaattaacaataaaaatggttaaaaaccccgatatcgtcgcaggcgttgccgcactaaaagaccatcgaccctacgtcgttggatttgccgccgaaacaaataatgtggaagaatacgcccggcaaaaacgtatccgtaaaaaccttgatctgatctgcgcgaacgatgtttcccagccaactcaaggatttaacagcgacaacaacgcattacaccttttctggcaggacggagataaagtcttaccgcttgagcgcaaagagctccttggccaattattactcgacgagatcgtgacccgttatgatgaaaaaaatcgacgttaa

SEQ ID NO: 8436 - protein, 406 aa, Escherichia coli
MSLAGKKIVLGVSGGIAAYKTPELVRRLRDRGADVRVAMTEAAKAFITPLSLQAVSGYPVSDSLLDPAAEAAMGHIELGKWADLVILAPATADLIARVAAGMANDLVSTICLATPAPVAVLPAMNQQMYRAAATQHNLEVLASRGLLIWGPDSGSQACGDIGPGRMLDPLTIVDMAVAHFSPVNDLKHLNIMITAGPTREPLDPVRYISNHSSGKMGFAIAAAAARRGANVTLVSGPVSLPTPPFVNRVDVMTALEMEAAVNASVQQQNIFIGCAAVADYRAATVAPEKIKKQATQGDELTIKMVKNPDIVAGVAALKDHRPYVVGFAAETNNVEEYARQKRIRKNLDLICANDVSQPTQGFNSDNNALHLFWQDGDKVLPLERKELLGQLLLDEIVTRYDEKNRR

SEQ ID NO: 8437 - DNA, 459 bp, Escherichia coli
atgatgaaaaaaatcgacgttaagattctggacccgcgcgttgggaaggaatttccgctcccgacttatgccacctctggctctgccggacttgacctgcgtgcctgtctcgacgacgccgtagaactggctccgggtgacactacgctggttccgaccgggctggcgattcatattgccgatccttcactggcggcaatgatgctgccgcgctccggattgggacataagcacggtatcgtgcttggtaacctggtaggattgatcgattctgactatcagggccagttgatgatttccgtgtggaaccgtggtcaggacaacttcaccattcaacctggcgaacgcatcgcccagatgatttttgttccggtagtacaggctgaatttaatctggtggaagatttcgacgccaccgaccgcggtgaaggcggctttggtcactctggtcgtcagtaa

SEQ ID NO: 8438 - protein, 152 aa, Escherichia coli
MMKKIDVKILDPRVGKEFPLPTYATSGSAGLDLRACLDDAVELAPGDTTLVPTGLAIHIADPSLAAMMLPRSGLGHKHGIVLGNLVGLIDSDYQGQLMISVWNRGQDNFTIQPGERIAQMIFVPVVQAEFNLVEDFDATDRGEGGFGHSGRQ

SEQ ID NO: 8439 - DNA, 597 bp, Escherichia coli
atggcagaaaaacaaactgcgaaaaggaaccgtcgcgaggaaatacttcagtctctggcgctgatgctggaatccagcgatggaagccaacgtatcacgacggcaaaactggccgcctctgtcggcgtttccgaagcggcactgtatcgccacttccccagtaagacccgcatgttcgatagcctgattgagtttatcgaagatagcctgattactcgcatcaatctgattctgaaagatgagaaggacaccacagcgcgcctgcgtctgattgtgttgctgcttctcggttttggtgagcgtaatcctggcctgacccgcatcctcactggtcatgcactaatgtttgaacaggatcgcctgcaagggcgcatcaaccagctattcgagcgtattgaagcgcagttgcgtcaggtattgcgtgaaaagagaatgcgtgagggcgaaggctacgcgacggatgaaaccctgctggcaagccagatcctggccttctgtgaaggtatgctgtcacgctttgtccgcagcgagtttaaataccgcccgacggatgactttgacgcccgctggccgctaattgctgcacagttgcagtaa

SEQ ID NO: 8440 - protein, 198 aa, Escherichia coli
MAEKQTAKRNRREEILQSLALMLESSDGSQRITTAKLAASVGVSEAALYRHFPSKTRMFDSLIEFIEDSLITRINLILKDEKDTTARLRLIVLLLLGFGERNPGLTRILTGHALMFEQDRLQGRINQLFERIEAQLRQVLREKRMREGEGYATDETLLASQILAFCEGMLSRFVRSEFKYRPTDDFDARWPLIAAQLQ

SEQ ID NO: 8441 - DNA, 642 bp, Escherichia coli
atgaaaccatatcagcgccagtttattgaatttgcgcttagcaagcaggtgttaaagtttggcgagttcacgctgaaatccgggcgcaaaagcccctatttcttcaacgccgggctgtttaataccgggcgcgatctggcactgttaggccgtttttacgctgaagcattggtggattccggcattgagttcgatctgctgtttggccctgcttacaaagggatcccgattgccaccacaactgccgtggcgctggcggagcatcatgacctggacctgccgtactgctttaaccgcaaagaagcaaaagaccacggtgaaggcggcaatctggtcggtagcgcgttacaaggacgcataatgctggtggatgatgtgatcaccgccggaacggcgattcgcgagtcgatggaaattattcaggccaatggcgcgacgcttgctggcgtattgatttcgctcgatcgtcaggaacgggggcgcggcgagatttcggcaattcaggaagttgagcgtgattacaactgcaaagtgatctctatcatcaccttgaaagatctgattgcctatctggaagagaagccagaaatggcggaacatctggcggcggttaaggcctatcgcgaagagttcggcgtttaa

SEQ ID NO: 8442 - protein, 213 aa, Escherichia coli
MKPYQRQFIEFALSKQVLKFGEFTLKSGRKSPYFFNAGLFNTGRDLALLGRFYAEALVDSGIEFDLLFGPAYKGIPIATTTAVALAEHHDLDLPYCFNRKEAKDHGEGGNLVGSALQGRIMLVDDVITAGTAIRESMEIIQANGATLAGVLISLDRQERGRGEISAIQEVERDYNCKVISIITLKDLIAYLEEKPEMAEHLAAVKAYREEFGV

SEQ ID NO: 8443 - DNA, 717 bp, Escherichia coli
atgcgtccagcaggccgtagcaataatcaggtgcgtcccgttaccctgactcgtaactatacaaaacatgcagaaggctcggtgctggtcgaatttggcgataccaaagtgttgtgtaccgcctctattgaagaaggcgtgccgcgcttcctgaaaggtcagggccagggctggatcaccgcagagtacggtatgctgccgcgttctacccatacccgtaacgcgcgtgaagcggcgaaaggtaagcagggtggacgcacaatggaaatccagcgtctgatcgcccgtgctcttcgcgcggcagtagatttgaaagcactgggtgagttcaccattacgctggactgcgacgtgcttcaggctgatggtggcacgcgtaccgcttcgattacgggtgcctgcgtggcgctggcagatgcgctacagaagctggtggaaaacggcaagctgaaaactaatccaatgaaagggatggtagccgcggtctctgtcgggattgtgaacggcgaagcggtttgcgatctggaatatgttgaagactctgccgcagagaccgacatgaacgtagtgatgaccgaagacgggcgtatcattgaagtgcaggggacggcagaaggcgaaccgttcacccacgaagagttactcaccttgttggcgctggcccgagggggaatcgaatccattgtagcgacgcagaaggcggcgctggcaaactga

SEQ ID NO: 8444 - protein, 238 aa, Escherichia coli
MRPAGRSNNQVRPVTLTRNYTKHAEGSVLVEFGDTKVLCTASIEEGVPRFLKGQGQGWITAEYGMLPRSTHTRNAREAAKGKQGGRTMEIQRLIARALRAAVDLKALGEFTITLDCDVLQADGGTRTASITGACVALADALQKLVENGKLKTNPMKGMVAAVSVGIVNGEAVCDLEYVEDSAAETDMNVVMTEDGRIIEVQGTAEGEPFTHEELLTLLALARGGIESIVATQKAALAN

SEQ ID NO: 8445 - DNA, 864 bp, Escherichia coli
atgatccgcagtatgaccgcctacgcccggcgtgaaatcaagggtgaatgggggagcgcaacctgggaaatgcgctcggtaaaccagcgttatctggaaacttactttcgtctgccggagcagttccgtagccttgaacctgtcgttcgcgagcgtattcgttctcgcctgacgcgcggtaaagtggaatgtaccctgcgctatgagccagatgttagcgcgcaaggtgagctgatcctcaacgaaaaactggctaaacagctggtaactgccgcgaactgggtaaaaatgcagagcgacgaaggagaaatcaacccggttgatattctacgctggccgggcgtgatggcagcccaggagcaagatctcgacgcgattgcagctgaaattctcgcggcgttggatggcaccctggatgactttatcatcgcgcgcgaaaccgaaggtcaggcgctgaaagtgttgattgagcagcgtctggaaggcgtcaccgccgaagtggtcaaagtccgcgcccatatgccggaaatcctgcaatggcagcgtgagcgtctggtagcgaagctggaagatgctcaggtgcaactggaaaacaaccgtctggagcaggagttggttctgctggcacaacgaattgacgttgccgaagaactggaccgcctcgaagcgcatgtcaaagagacctacaacattctgaagaaaaaagaagcggttggccgtcgtctggactttatgatgcaggagttcaaccgcgagtcgaacactcttgcttcgaaatctatcaatgccgaagtgacgaattctgccatcgagctgaaagtgttgattgagcagatgcgcgagcagatccagaacattgaataa

SEQ ID NO: 8446 - protein, 287 aa, Escherichia coli
MIRSMTAYARREIKGEWGSATWEMRSVNQRYLETYFRLPEQFRSLEPVVRERIRSRLTRGKVECTLRYEPDVSAQGELILNEKLAKQLVTAANWVKMQSDEGEINPVDILRWPGVMAAQEQDLDAIAAEILAALDGTLDDFIIARETEGQALKVLIEQRLEGVTAEVVKVRAHMPEILQWQRERLVAKLEDAQVQLENNRLEQELVLLAQRIDVAEELDRLEAHVKETYNILKKKEAVGRRLDFMMQEFNRESNTLASKSINAEVTNSAIELKVLIEQMREQIQNIE

SEQ ID NO: 8447 - DNA, 189 bp, Escherichia coli
ttgaagaaatacggcattatggcactgaagggcaagaattttggtcagcgagagaattggcaccgttactggattatcgggactggcgcaattttcaaaaggtactggcccgcgcgactcaagcgtgcgaagccagcaatcaagctgcatctgaccatttcgttgaaaccaccaaaatggttgtattag

SEQ ID NO: 8448 - protein, 62 aa, Escherichia coli
MKKYGIMALKGKNFGQRENWHRYWIIGTGAIFKRYWPARLKRAKPAIKLHLTISLKPPKWLY

SEQ ID NO: 8449 - DNA, 825 bp, Escherichia coli
atgaacgaacatcatcaaccttttgaagaaatacggcattatggcactgaagggcaagaattttggtcagcgagagaattggcaccgttactggattatcgggactggcgcaattttcaaaaggtactggcccgcgcgactcaagcgtgcgaagccagcaatcaagctgcatctgaccatttcgttgaaaccaccaaaatggttgtattaggttcaggggctcaacgagaacttgaagatgttcatctctcccgctatgcctgttacctggtagtacaaaacggcgaccctgcgaaaccggttattgcggcagggcaaacttattttgctatccagacccgacggcaggagctggctgacgatgaagctttcaggcaacttcgtgaagacgaaaagcgtctttttctgagaaatgagttgaaagaacataacaaacaattagttgaggcagcgcagcaagctggggtagcgacagctatcgatttcgccatatttcagaatcatggttaccggggactgtatggtggattagatcagaaagccatccatcagcggaaggggctgaaaaagagtcagaagatcctggatcatatgggttcaacagaactggcggctaatctctttcgagctacccaaacagaagaaaaactcaagcgggatggcgtgaattcaaaacagcaagctaataccacacactttgacgtgggtcgcaaggtgaggcaaaccattcaggaacttggcggaaccatgcctgaggagttgccgaccccgcaggtcagcatcaagcagttggaaaacagtgtaaaaattacagagaagaaatag

SEQ ID NO: 8450 - protein, 274 aa, Escherichia coli
MNEHHQPFEEIRHYGTEGQEFWSARELAPLLDYRDWRNFQKVLARATQACEASNQAASDHFVETTKMVVLGSGAQRELEDVHLSRYACYLVVQNGDPAKPVIAAGQTYFAIQTRRQELADDEAFRQLREDEKRLFLRNELKEHNKQLVEAAQQAGVATAIDFAIFQNHGYRGLYGGLDQKAIHQRKGLKKSQKILDHMGSTELAANLFRATQTEEKLKRDGVNSKQQANTTHFDVGRKVRQTIQELGGTMPEELPTPQVSIKQLENSVKITEKK

SEQ ID NO: 8451 - DNA, 618 bp, Escherichia coli
atgctgttacacattttgtatttggttggcattactgccgaagccatgacgggggcgctggcggccggacgacggcgcatggatacatttggcgtaattattattgcgaccgccacggcaattggcggagggtcagtgcgcgatattctgctgggccactatccgctcggctgggtcaaacacccggaatatgtgattatcgtcgctaccgccgcagtactcaccactatcgttgctcctgtaatgccttatctgcgcaaagtgtttctggtgctcgatgcgctcggactggtggtcttttctatcatcggcgcacaggttgcactggatatggggcacggcccaattattgccgttgtcgcggcggtaaccaccggcgtgtttggcggcgttttgcgcgatatgttctgtaaacgcattccactggtattccagaaagagttgtatgccggtgtctcatttgcctccgccgtgctgtacatcgcgctgcaacactatgtttctaaccatgatgttgtgattatctccaccctggtattcggcttttttgcccgtttactggcgctacgtcttaagctgggattaccggtcttttactacagccacgaaggtcactaa

SEQ ID NO: 8452 - protein, 205 aa, Escherichia coli
MLLHILYLVGITAEAMTGALAAGRRRMDTFGVIIIATATAIGGGSVRDILLGHYPLGWVKHPEYVIIVATAAVLTTIVAPVMPYLRKVFLVLDALGLVVFSIIGAQVALDMGHGPIIAVVAAVTTGVFGGVLRDMFCKRIPLVFQKELYAGVSFASAVLYIALQHYVSNHDVVIISTLVFGFFARLLALRLKLGLPVFYYSHEGH

SEQ ID NO: 8453 - DNA, 1518 bp, Escherichia coli
gtggaagacggtgtttacgatcagttaagcgcccgtctcacgcagtggcaacgctgttttgggaacgagactcgcgatgtgatgatgccgcctttaaacggtgcggttatgcatccggttgcccatacgggtgtacgcaaaatggcggataaaaacgcattaagtctgtggatgcgcgaacgtagcgatctttgggtgcagccaaaagttgatggcgttgcggtaaccctggtttatcgggacgggaaactgaacaaagcaatcagtcgcggtaatggcctgaaaggcgaggactggacgcagaaagttcgcttaatttccgctgtgccgcaaaccgttagcgggcctttagccaacagcacgcttcagggggaaatatttctccagcgcgaggggcatatccaacaacaaatggggggaataaatgcccgcgcaaaagttgctggcctgatgatgcgccaggggaatagcgatacgctaaactcactggctgtttttgtctgggcatggccggatggaccgcatttaatgaccgatcgtttaaaggatctggctaccgcaggttttactttaacgcagacgtatacccgcgcggttaaaaatgctgatgaggttgcgcacgtacgcaatgagtggtggaaagcaaaattacccttcgtcaccgatggcgtggttgtgcgagcggcgaaagaacccgaatcccgtcattggttaccgggccaggcggagtggctggtggcctggaaatatcaacctgtagctcaggttgccgaagtgaaggcgattcagtttgcggtgggtaagagcggtaaaatatcggtggtggcgtcactcgcacctgtcatgctggatgataaaaaagtccagcgggtgaatattggttccgtcaggcgctggcaggagtgggatattgcgcctggtgatcagatcctcgtcagccttgccggtcaggggattcctcgcattgatgatgtggtctggcgcggagcagaacgtacaaaaccgacaccaccagaaaaccgctttaactcgttgacctgctactttgcttctgatgtttgtcaggaacagttcatttcacgcttagtctggctggggtcaaaacaggttctggggcttgatggcattggtgaggccggctggcgcgccctgcatcagactcatcgctttgagcatatcttttcctggcttttattaacgccagagcaattacagaacacgccggggatcgcgaaaagtaaaagtgcgcagttatggcatcagtttaatctggctcgtcagcagccttttactcgctgggtgatggcaatgggaataccgctaacccgggcggcgcttaatgccagtgatgaacggtcctggtcgcaacttttatttagcacggaacagttctggcagcagcagccggggactggatcggggcgcgccagacaggttattgaatggaaggaaaatgcgcaaatcaagaagctgggcagttggctggctgcccagcagatcacaggttttgaaccttag

SEQ ID NO: 8454 - protein, 505 aa, Escherichia coli
MEDGVYDQLSARLTQWQRCFGNETRDVMMPPLNGAVMHPVAHTGVRKMADKNALSLWMRERSDLWVQPKVDGVAVTLVYRDGKLNKAISRGNGLKGEDWTQKVRLISAVPQTVSGPLANSTLQGEIFLQREGHIQQQMGGINARAKVAGLMMRQGNSDTLNSLAVFVWAWPDGPHLMTDRLKDLATAGFTLTQTYTRAVKNADEVAHVRNEWWKAKLPFVTDGVVVRAAKEPESRHWLPGQAEWLVAWKYQPVAQVAEVKAIQFAVGKSGKISVVASLAPVMLDDKKVQRVNIGSVRRWQEWDIAPGDQILVSLAGQGIPRIDDVVWRGAERTKPTPPENRFNSLTCYFASDVCQEQFISRLVWLGSKQVLGLDGIGEAGWRALHQTHRFEHIFSWLLLTPEQLQNTPGIAKSKSAQLWHQFNLARQQPFTRWVMAMGIPLTRAALNASDERSWSQLLFSTEQFWQQQPGTGSGRARQVIEWKENAQIKKLGSWLAAQQITGFEP

SEQ ID NO: 8455 - DNA, 264 bp, Escherichia coli
ttgcctgtgattcactgcaataaagacgattctcaggaagcgtcctcgcagactccgtttttgccactcggctttgctttcaccacgttgtatatctgcctgactatctacagcggaggtgatgatgaaagtatggatggcgatattaataagtatcttgtgctggcaatcatcggcgtgggcggtctgtccggcctggtcgccagccagagcacaggaagaaatttcccgcctgcaacagcaaataaaacagtgggacgatga

SEQ ID NO: 8456 - protein, 87 aa, Escherichia coli
MPVIHCNKDDSQEASSQTPFLPLGFAFTTLYICLTIYSGGDDESMDGDINKYLVLAIIGVGGLSGLVASQSTGRNFPPATANKTVGR

SEQ ID NO: 8457 - DNA, 681 bp, Escherichia coli
gtgtataataagctcgtatgtaggctttatttcgctaatcacatacgaaagatactcatggctcaaggcacgctttatattgtttctgcccccagtggcgcgggtaaatccagcctgattcaggctttattaaaaacccaaccgttgtatgacacccaggtttctgtttcacacaccacacgccaaccgcgtcctggtgaagtccacggtgaacattatttctttgttaatcatgatgaatttaaagaaatgattagtagagatgcgttcctcgaacacgcagaagtttttggtaattactatggcacttcgcgtgaggccattgagcaagtactggcgaccggtgtcgatgtttttctcgatatcgactggcagggtgcgcagcaaattcgccagaagatgccgcacgcgcggagtatctttattttaccgccgtctaaaatcgaactggaccgccgtctacgcggtcgcggtcaggacagcgaagaggtcattgcaaagcgtatggcgcaagctgttgcagaaatgagccattacgccgaatatgattacctgattgtgaatgatgacttcgataccgcgttgaccgatttgaagaccattattcgcgccgaacgtctgcgcatgagccgccaaaagcagcgtcatgacgctttaatcagcaaattgttggcagactga

SEQ ID NO: 8458 - protein, 226 aa, Escherichia coli
MYNKLVCRLYFANHIRKILMAQGTLYIVSAPSGAGKSSLIQALLKTQPLYDTQVSVSHTTRQPRPGEVHGEHYFFVNHDEFKEMISRDAFLEHAEVFGNYYGTSREAIEQVLATGVDVFLDIDWQGAQQIRQKMPHARSIFILPPSKIELDRRLRGRGQDSEEVIAKRMAQAVAEMSHYAEYDYLIVNDDFDTALTDLKTIIRAERLRMSRQKQRHDALISKLLAD

SEQ ID NO: 8459 - DNA, 276 bp, Escherichia coli
atggcacgcgtaactgttcaggacgctgtagagaaaattggtaaccgttttgacctggtactggtcgccgcgcgtcgcgctcgtcagatgcaggtaggcggaaaggatccgctggtaccggaagaaaacgataaaaccactgtaatcgcgctgcgcgaaatcgaagaaggtctgatcaacaaccagatcctcgacgttcgcgaacgccaggaacagcaagagcaggaagccgctgaattacaagccgttaccgctattgctgaaggtcgtcgttaa

SEQ ID NO: 8460 - protein, 91 aa, Escherichia coli [sequence omitted]

SEQ ID NO: 8461 - DNA, 2109 bp, Escherichia coli
ttgtatctgtttgaaagcctgaatcagctgattcaaaactacctgccggaagaccaaatcaagcgtctgcggcaggcgtatctcgttgcacgtgatgctcacgaggggcaaacacgttcaagcggtgaaccctatatcacgcacccggtggcggttgcctgcattctggccgagatgaaactcgactatgaaacgctgatggcggcgctgctgcatgatgtgattgaagatacacccgccacctaccaggacatggaacagctttttggtaaaagcgtcgccgagctggtagagggggtgtcgaaacttgataaactcaagttccgcgataagaaagaggcgcaggccgaaaactttcgcaagatgattatggcgatggtgcaggatatccgcgtcattctcatcaaacttgccgaccgtacccacaacatgcgcacgctgggctcacttcgcccggacaaacgtcgccgcatcgcccgtgaaactctcgaaatatacagcccgctggcgcaccgtttaggtatccaccacattaaaaccgaactcgaggagctgggttttgaggcgctgtatcccaaccgttatcgcgtaatcaaagaagtggtgaaagccgcgcgcggcaaccgtaaagagatgatccagaagattctttctgaaatcgaagggcgtttgcaggaagcgggaataccgtgccgcgtcagtggtcgcgaaaaacatctttattcgatttactgcaaaatggtgctcaaagagcagcgttttcactcaatcatggacatctacgctttccgcgtgatcgtcaatgattctgacacctgttatcgcgtgctgggccagatgcacagcctgtacaagccgcgtccgggccgcgtgaaagactatatcgccattccaaaagcgaacggctatcagtctttgcacacctcgatgattggcccgcacggcgtgccggttgaggtccagatccgtaccgaagatatggatcagatggcggagatgggtgttgccgcgcactgggcttataaagagcacggcgaaaccagcactaccgcgcaaatacgcgcccagcgctggatgcaaagcctgctggagctgcaacagagtgccggtagctcgtttgaatttatcgagagcgttaaatccgatctcttcccggatgagatttacgttttcacaccagaagggcgcattgtcgaactgcctgccggtgcaacgcccgtcgacttcgcttatgcggtgcataccgatatcggccatgcctgcgtgggcgcacgcgtcgaccgccagccttacccgctgtctcagccgcttactagcggtcaaaccgttgaaatcattaccgcaccgggtgctcgcccgaatgccgcgtggctgaactttgtcgtcagctcgaaagcgcgcgccaaaattcgtcagttgctgaaaaacctcaagcgtgatgattctgtaagcctgggccgtcgtctgctcaaccatgcgttgggtggtagccgtaagctcaatgaaatcccgcaggaaaatattcagcgcgagctggaccgcatgaagctggcaacgcttgacgatctgctggcagaaatcggccttggtaacgcaatgagcgtggtggtcgcgaaaaatctgcaacatggggacgcctccattccaccggcaacccaaagtcacggacatctgcccattaaaggtgccgatggcgtgctgatcacctttgcgaaatgctgccgcccaattcctggcgacccgattatcgcccacgtcagccccggtaaaggtctggtgatccaccatgaatcctgccgtaacatccgtggctaccagaaagagccagagaagtttatggctgttgaatgggataaagagacggcgcaggaattcatcaccgaaatcaaggtggagatgttcaatcatcagggcgcgctggcaaacctgacggcggcaattaacaccacgacctcgaatattcaaagtttgaatacggaagagaaagatggtcgcgtctatagcgcctttattcgtctgaccgcccgtgaccgtgtgcatctggcgaatatcatgcgcaaaatccgcgtgatgccagacgtgattaaagtcacccgaaaccgaaattaa

SEQ ID NO: 8462 - protein, 702 aa, Escherichia coli
MYLFESLNQLIQNYLPEDQIKRLRQAYLVARDAHEGQTRSSGEPYITHPVAVACILAEMKLDYETLMAALLHDVIEDTPATYQDMEQLFGKSVAELVEGVSKLDKLKFRDKKEAQAENFRKMIMAMVQDIRVILIKLADRTHNMRTLGSLRPDKRRRIARETLEIYSPLAHRLGIHHIKTELEELGFEALYPNRYRVIKEVVKAARGNRKEMIQKILSEIEGRLQEAGIPCRVSGREKHLYSIYCKMVLKEQRFHSIMDIYAFRVIVNDSDTCYRVLGQMHSLYKPRPGRVKDYIAIPKANGYQSLHTSMIGPHGVPVEVQIRTEDMDQMAEMGVAAHWAYKEHGETSTTAQIRAQRWMQSLLELQQSAGSSFEFIESVKSDLFPDEIYVFTPEGRIVELPAGATPVDFAYAVHTDIGHACVGARVDRQPYPLSQPLTSGQTVEIITAPGARPNAAWLNFVVSSKARAKIRQLLKNLKRDDSVSLGRRLLNHALGGSRKLNEIPQENIQRELDRMKLATLDDLLAEIGLGNAMSVVVAKNLQHGDASIPPATQSHGHLPIKGADGVLITFAKCCRPIPGDPIIAHVSPGKGLVIHHESCRNIRGYQKEPEKFMAVEWDKETAQEFITEIKVEMFNHQGALANLTAAINTTTSNIQSLNTEEKDGRVYSAFIRLTARDRVHLANIMRKIRVMPDVIKVTRNRN

SEQ ID NO: 8463 - DNA, 690 bp, Escherichia coli
atgaacccaacacgttatgcacgcatctgcgaaatgctcgccaggcggcagcctgatctgaccgtctgcatggagcaggtccacaaacctcataacgtttctgcgattattcgtaccgcagatgccgttggcgtacatgaagttcatgctgtctggcctggcagccggatgcgcaccatggcttcggcagctgcgggtagtaacagctgggtacaggtgaaaacgcaccgcaccattggcgatgccgtcgctcatctgaaaggccagggcatgcagattctggcaacccatctttctgataacgctgttgatttccgcgaaattgattacactcgcccgacctgtattttgatgggacaggagaaaacgggcatcacgcaggaagcgttggccctggcggatcaggatatcatcattccgatgatcggcatggtgcagtcgctgaatgtttccgttgcctcagccctcattctttacgaagcccagcgccagcggcaaaatgcgggcatgtacctgcgtgaaaacagcatgttgccggaagccgagcaacaacgcctgctgtttgaaggcggctatccggtgctggcgaaagtcgcaaaacgcaaaggtctgccctacccccacgttaatcagcaaggcgagattgaagccgatgctgactggtggtccaccatgcaggccgcagggtaa

SEQ ID NO: 8464 - protein, 229 aa, Escherichia coli
MNPTRYARICEMLARRQPDLTVCMEQVHKPHNVSAIIRTADAVGVHEVHAVWPGSRMRTMASAAAGSNSWVQVKTHRTIGDAVAHLKGQGMQILATHLSDNAVDFREIDYTRPTCILMGQEKTGITQEALALADQDIIIPMIGMVQSLNVSVASALILYEAQRQRQNAGMYLRENSMLPEAEQQRLLFEGGYPVLAKVAKRKGLPYPHVNQQGEIEADADWWSTMQAAG

SEQ ID NO: 8465 - DNA, 2115 bp, Escherichia coli
gtggtccaccatgcaggccgcagggtaagcgcgatgaaaggtcgcctgttagatgctgtcccgctcagttccctaacgggcgttggcgcagcgcttagtaacaagctggcgaaaatcaacctgcataccgtacaggatttgctcttacaccttcctctgcgctacgaagatcgcacacatctctaccccatcggtgaactactgccgggtgtttatgccacggtggaaggcgaagtgctgaactgcaatatctccttcggcggtcggcggatgatgacctgccagatcagcgacggttccggcattctcactatgcgctttttcaacttcaatgcggcaatgaaaaatagcctggcgacaggccgccgcgtgctggcctatggcgaagcaaagcgcggcaaatatggtgcggagatgatccacccggaataccgcgtacagggcgatctcagcacgccagagttacaggaaacgctcacgccggtttacccaactacggaaggcgtaaagcaggctacgctgcgtaaattaaccgaccaggcgctggatctgctcgacacatgcgccattgaagaactcctgccgccggaactgtcacaaggaatgatgacgctaccggaagcgttgcgcactttgcaccgcccgccgccgacgctacagcttagcgatctcgaaaccgggcagcatccggcacaacgccggctgattctggaagagttgctggcgcacaacctcagcatgttggcgttacgtgccggtgcacaacgttttcatgctcagccgctgagcgccaatgacgcgctgaaaaataaactcctcgccgccttaccgttcaagccaacgggcgcacaggcacgcgtagtggcggagatcgagcgcgatatggcgctggatgtgccgatgatgcgtctggtgcagggcgatgtaggttccggtaaaacgctggtcgctgccctcgccgcgttgcgtgcggttgcccacggcaaacaggtggccctgatggcaccaaccgaattactcgccgagcagcacgccaataactttcgtaactggtttgcaccgctcggtatcgaagtaggctggctcgccggaaaacagaaaggtaaagcacgactggctcagcaagaagccatcgccagcggtcaggtgcagatgattgttggtacgcacgccattttccaggaacaggtgcagtttaacggcctggcgctggtgattatcgacgaacagcatcgttttggcgtacatcagcgtctggcgttatgggagaaaggccagcagcagggcttccatccgcatcagttgatcatgaccgccacgcccatcccccgcacgctggcgatgactgcgtatgccgatctcgatacctcggtgatagatgagctgccaccaggccgcacgccagtgactacggtcgctattcctgatacccgccgtaccgatatcattgaccgcgtgcgccacgcctgtatgactgaagggcgtcaggcgtactgggtttgtacgttgattgaagagtcggaattactggaagcgcaggcggcggaagcgacctgggaagagttgaaactggcgctaccagagttgaatgttggcctggtacacggacggatgaaacccgccgagaaacaggcggtgatggcgtcgtttaaacaaggtgaactacacctgctggttgccactactgtcattgaagtcggtgttgatgtacccaatgccagtctgatgattatcgaaaacccggagcgtctgggtctggcgcagttacaccagttacgtggccgcgtgggtcgtggcgcggtggcctctcactgcgtgctgctctacaaaacgccgctctccaaaaccgcgcaaatccgcctgcaggtactacgcgacagcaacgatggttttgtgattgcacagaaagatctggagattcgcggccctggcgaattgttaggtacacgtcagacggggaatgctgaatttaaagtggcggatttactgcgcgatcaggcgatgatcccggaagttcagcgcctggcgcgacatattcacgaacgttacccacaacaggcaaaagccctgatagaacgctggatgccagaaacagaacgttactcgaatgcgtaa

SEQ ID NO: 8466 - protein, 704 aa, Escherichia coli
MVHHAGRRVSAMKGRLLDAVPLSSLTGVGAALSNKLAKINLHTVQDLLLHLPLRYEDRTHLYPIGELLPGVYATVEGEVLNCNISFGGRRMMTCQISDGSGILTMRFFNFNAAMKNSLATGRRVLAYGEAKRGKYGAEMIHPEYRVQGDLSTPELQETLTPVYPTTEGVKQATLRKLTDQALDLLDTCAIEELLPPELSQGMMTLPEALRTLHRPPPTLQLSDLETGQHPAQRRLILEELLAHNLSMLALRAGAQRFHAQPLSANDALKNKLLAALPFKPTGAQARVVAEIERDMALDVPMMRLVQGDVGSGKTLVAALAALRAVAHGKQVALMAPTELLAEQHANNFRNWFAPLGIEVGWLAGKQKGKARLAQQEAIASGQVQMIVGTHAIFQEQVQFNGLALVIIDEQHRFGVHQRLALWEKGQQQGFHPHQLIMTATPIPRTLAMTAYADLDTSVIDELPPGRTPVTTVAIPDTRRTDIIDRVRHACMTEGRQAYWVCTLIEESELLEAQAAEATWEELKLALPELNVGLVHGRMKPAEKQAVMASFKQGELHLLVATTVIEVGVDVPNASLMIIENPERLGLAQLHQLRGRVGRGAVASHCVLLYKTPLSKTAQIRLQVLRDSNDGFVIAQKDLEIRGPGELLGTRQTGNAEFKVADLLRDQAMIPEVQRLARHIHERYPQQAKALIERWMPETERYSNA

SEQ ID NO: 8467 - DNA, 1206 bp, Escherichia coli
atgtttcatctcgatactttagcaacgcttgttgccgcaacgctgacgttgctgctcgggcgcaagttggtccattccgtctcctttttgaaaaaatacaccataccggaacctgttgcgggtggtttattagtggcgctggcgctgctgatactgaaaaaaagcatgggctgggaagtcaactttgatatgtccctgcgcgatccgttgatgctggctttcttcgccaccattggcctgaacgccaaccttgccagtctgcgagctggtgggcgtgtggtgggggttttcctgattgtggttgttggcctgttggtgatgcaaaatgccattggcattggtatggctagcctgttagggcttgatccgctgatggggctgctggccggttctattacgctttcgggcggtcacggtacgggtgctgcatggagtaaattgttcattgaacgttatggcttcaccaatgcgacagaagtggcgatggcctgtgcaacgttcggtttggtgctgggcgggctgatcggtggcccggtggcgcgttatctggtgaaacactccaccacaccgaacggtattccggatgatcaggaagttccgactgcgttcgagaagccggatgtgggccgcatgatcacctcgctggtgctgattgaaactatcgcgctgattgctatctgcctgacggtggggaaaattgttgcgcaacttttggctggtactgcttttgaactaccgacctttgtctgtgtactatttgttggcgtgattctgagcaacggtctgtcaatgatgggcttttaccgcgtctttgagcgagcggtatccgtgctgggtaacgtaagcctgtcgttgttcctggcgatggcgctgatggggctgaaactgtgggagctggcttcgctggcgttgccgatgctggcgattctggtggtacagaccatcttcatggcgttgtatgccatcttcgttacctggcgcatgatgggcaaaaactacgatgcggcagtgctggctgcgggtcactgtggctttggccttggtgcgacaccaacggcaatcgctaacatgcaggcgatcactgaacgctttggcccgtcgcacatggcgttcctggtcgtgccgatggtcggtgcgttctttatcgatatcgtcaatgcgctggtgattaagctgtatttgatgttgccgatttttgccggttaa

SEQ ID NO: 8468 - protein, 401 aa, Escherichia coli
MFHLDTLATLVAATLTLLLGRKLVHSVSFLKKYTIPEPVAGGLLVALALLILKKSMGWEVNFDMSLRDPLMLAFFATIGLNANLASLRAGGRVVGVFLIVVVGLLVMQNAIGIGMASLLGLDPLMGLLAGSITLSGGHGTGAAWSKLFIERYGFTNATEVAMACATFGLVLGGLIGGPVARYLVKHSTTPNGIPDDQEVPTAFEKPDVGRMITSLVLIETIALIAICLTVGKIVAQLLAGTAFELPTFVCVLFVGVILSNGLSMMGFYRVFERAVSVLGNVSLSLFLAMALMGLKLWELASLALPMLAILVVQTIFMALYAIFVTWRMMGKNYDAAVLAAGHCGFGLGATPTAIANMQAITERFGPSHMAFLVVPMVGAFFIDIVNALVIKLYLMLPIFAG

SEQ ID NO: 8469 - DNA, 1392 bp, Escherichia coli
atgtctgtttccaccctcgagtcagaaaatgcgcaaccggttgcgcagactcaaaacagcgaactgatttaccgtcttgaagatcgtccgccgcttcctcaaaccctgtttgccgcctgtcagcatttgctggcgatgttcgttgcggtgatcacgccagcgctattaatctgccaggcgctgggtttaccggcacaagacacgcaacacattattagtatgtcgctgtttgcctccggtgtggcatcgattattcaaattaaggcctggggtccggttggctccgggttgttgtctattcagggcaccagcttcaactttgttgctccgctgattatgggcggcacagcgctgaagaccggtggtgctgatgttcctaccatgatggcagctttgttcggcacgttgatgctggcaagttgtaccgagatggtgatctcccgcgttctgcatctggcgcgccgcattattacgccgctggtttctggcgttgtggtgatgattatcggcctgtcgctaattcaggttgggctgacctccattggcggcggttacgcagccatgagcgataacaccttcggcgcaccgaaaaatctgctgctggcaggcgtggtcttagccttaattatcctgcttaaccgtcaacgtaacccttacttacgcgtggcctcactggtgattgcgatggcggccggatatgcgctggcgtggtttatgggcatgttgccagaaagcaacgaaccgatgacacaagaactgattatggtgccaacgccgctctattacggtcttggcattgaatggagtctgctgctgccgctgatgctggtctttatgatcacttcgctggaaaccattggcgatatcacggcgacctctgacgtttccgaacagccagtgtccggtccgctgtacatgaaacgcctgaaaggcggcgtactggcaaacggcctgaactcgtttgtctcggcggtatttaataccttcccgaactcctgcttcgggcagaacaacggggtgatccagttaaccggtgttgccagccgctatgtcggttttgtcgtcgcgctgatgttgatcgtgctgggtctgttcccggcagtgagcggttttgtacaacacattccagaaccggttctgggcggcgcaacgcttgtaatgtttggcaccatcgccgcctccggtgtgcgtatcgtttctcgtgagccgctgaaccgccgggcgattctgattatcgcgctgtcgctggcggtcggtctgggcgtgtctcagcagccgctgattttgcagtttgcccctgaatggctgaaaaacctactctcctccgggattgccgcgggcggtattactgccatcgtgctgaatctgattttcccaccagaaaaacagtaa

SEQ ID NO: 8470 - protein, 463 aa, Escherichia coli
MSVSTLESENAQPVAQTQNSELIYRLEDRPPLPQTLFAACQHLLAMFVAVITPALLICQALGLPAQDTQHIISMSLFASGVASIIQIKAWGPVGSGLLSIQGTSFNFVAPLIMGGTALKTGGADVPTMMAALFGTLMLASCTEMVISRVLHLARRIITPLVSGVVVMIIGLSLIQVGLTSIGGGYAAMSDNTFGAPKNLLLAGVVLALIILLNRQRNPYLRVASLVIAMAAGYALAWFMGMLPESNEPMTQELIMVPTPLYYGLGIEWSLLLPLMLVFMITSLETIGDITATSDVSEQPVSGPLYMKRLKGGVLANGLNSFVSAVFNTFPNSCFGQNNGVIQLTGVASRYVGFVVALMLIVLGLFPAVSGFVQHIPEPVLGGATLVMFGTIAASGVRIVSREPLNRRAILIIALSLAVGLGVSQQPLILQFAPEWLKNLLSSGIAAGGITAIVLNLIFPPEKQ

SEQ ID NO: 8471 - DNA, 1734 bp, Escherichia coli
gtgcatttcacgggatggaagaccatgaaatttattgggaagctgcttctctacattctcatcgctctgttagtggtgatcgctggcctctattttcttctgcaaactcgctggggagcagaacatatcagcgcatgggtttccgagaatagcgactatcatctggccttcggggcgatggatcaccgtttttccgcgccatctcatatcgtgctggagaacgtcacgtttggccgtgatggccagcccgcgaccctggtggcaaaaagtgtcgacattgcgctaagcagtcggcaactgaccgaaccacgccatgtcgataccatcctgctggaaaacgggacgctgaatctcaccgaccagaccgcgccgctaccgtttaaagccgatcgtctgcaactgcgtgatatggcgtttaatagcccgaatagcgaatggaaactgagcgcgcagcgggtaaatggcggcgtggttccgtggtcaccagaagccggtaaagtgctgggtacgaaggcacagattcagtttagtgccggatcgctttcgctcaatgatgttcctgccaccaatgtactgattgaaggcagtattgataacgatcgcgttacgctgactaacctgggtgccgacatcgcccgcgggacattaaccggaaacgcgcagcgtaacgctgacggcagctggcaagtggaaaacctgcgcatggcggatatccgtctacaaagcgaaaaatcgctaaccgacttctttgcaccattacgctctgtcccgtcgttgcagattggtcgcctggaagtcatcgacgctcgtttgcaaggtccggactgggcggtggccgacctcgatctcagcttgcgcaacatgaccttcagtaaagatgactggcagacacaggaaggtaaactgtcgatgaacgccagcgagtttatttatggctcgctgcatttatttgatccgattataaacgcggaattttccccgcagggcgtagcactgcgccagttcaccagccgctgggaagggggtatggtcagaacgtcaggaaactggcaacgcgacgggaaaacgctgatcctcgatgatgcggcaattgccggactggaatataccttgcccaaaaactggcaacagttgtggatggaaacgacacccggttggttaaacagcctgcaactgaagagatttagcgccagccgcaatctgatcattgatatcgaccctgacttcccgtggcagctcaccgcgctcgatggttacggtgccaatctgacgctggttaccgatcataaatggggcgtctggagtggctcggcgaatctgaatgccgccgccgcaacgtttaatcgtgttgatgtccgtcgtccgtcgctggcgctaactgccaacagcagcacggtgaatatcagcgaactgagtgcatttactgaaaaaggcattctggaagccaccgccagtgtttcacaaacgccacaacgtcagacccatatcagcctgaatggacgcggtgtgccggtgaatattttgcaacattggggatggcctgaattaccgttgactggcgacggcaatattcagcttaccgccagtggcgatattcaggtcaatgtcccgctgaaacctacggttagcgggcaattgcatgccgtgaatgccgcaaagcagcaagtgactcaaaccatgaatgcgggcgtagtttccagtggtgaagttacgtcgacggagccggtgcagtaa

SEQ ID NO: 8472 - protein, 577 aa, Escherichia coli
MHFTGWKTMKFIGKLLLYILIALLVVIAGLYFLLQTRWGAEHISAWVSENSDYHLAFGAMDHRFSAPSHIVLENVTFGRDGQPATLVAKSVDIALSSRQLTEPRHVDTILLENGTLNLTDQTAPLPFKADRLQLRDMAFNSPNSEWKLSAQRVNGGVVPWSPEAGKVLGTKAQIQFSAGSLSLNDVPATNVLIEGSIDNDRVTLTNLGADIARGTLTGNAQRNADGSWQVENLRMADIRLQSEKSLTDFFAPLRSVPSLQIGRLEVIDARLQGPDWAVADLDLSLRNMTFSKDDWQTQEGKLSMNASEFIYGSLHLFDPIINAEFSPQGVALRQFTSRWEGGMVRTSGNWQRDGKTLILDDAAIAGLEYTLPKNWQQLWMETTPGWLNSLQLKRFSASRNLIIDIDPDFPWQLTALDGYGANLTLVTDHKWGVWSGSANLNAAAATFNRVDVRRPSLALTANSSTVNISELSAFTEKGILEATASVSQTPQRQTHISLNGRGVPVNILQHWGWPELPLTGDGNIQLTASGDIQVNVPLKPTVSGQLHAVNAAKQQVTQTMNAGVVSSGEVTSTEPVQ

SEQ ID NO: 8473 - DNA, 681 bp, Escherichia coli
atgaaacgttcacaaattaattatgttattgataaagcacatgccattgcgcagaccttccgcgtttgtttgccagagttcgcctattttacggtggatgactggctgcagcgggaacgggataactggcaagaagtggtcgacttacagctcggttgggatatcaccgattttggtcgtggtgatttcaaccaaacgggactaacactgctaacgatgcgcaacggcgcgctggggtcggcggcatatccaaaaccgtatgctgagaaaatgttgcagatccaacaagatcagcagactccctggcattttcacacccacaaaatggaagatatcctcaatcggggcggtggagacttatgcatgcggttggcctgggccaacgaagccaatctctgtgatgatcaacgagtcattaccgtgagtgttgatggtcagcggcgtaccatgaaacctggtgaaacgctggtgctaaagccggggcagggcatttgcctgccgccgcgtctgtatcatcgcttctgggcggaaaaagcgtttgttctcggctgggaaatctcgatggtaaatgatgaccaacacgataattattttcttgagccgggaggacgttttccggcgatagaagaagatgaaccggtgaaatggttattgtgcggtgagtatggaattttgcgctaa

SEQ ID NO: 8474 - protein, 226 aa, Escherichia coli
MKRSQINYVIDKAHAIAQTFRVCLPEFAYFTVDDWLQRERDNWQEVVDLQLGWDITDFGRGDFNQTGLTLLTMRNGALGSAAYPKPYAEKMLQIQQDQQTPWHFHTHKMEDILNRGGGDLCMRLAWANEANLCDDQRVITVSVDGQRRTMKPGETLVLKPGQGICLPPRLYHRFWAEKAFVLGWEISMVNDDQHDNYFLEPGGRFPAIEEDEPVKWLLCGEYGILR

SEQ ID NO: 8475 - DNA, 933 bp, Escherichia coli
atgcactatctggggttggatattggtgggaccaaaatcgccgccgttgtcatggatgcgcatggctgggagattcgccgttaccgctgcccgacgcaaaagtcgacatatcaacaatttgtctcatgcgttgtggcgcttatcgagcagattaggcgggacgttcaacgaccgatgctgacagggatcgccttacccggcagtatctcgccactcactggcctgattaaaaacgcgaatattcaggtgattaacggtcatgcgttacaggctgatttgcagcaattgcttgggcaaccggtggtgatagccaatgatggtaactgtttcgcgctatcagaagcttgcgacggtgccgggcaagattatgacgtggtatttggtattacgcttggtacgggctgcggcggtggcattgccatcaagcaacgaccgtttataggggcctggggaaatgctgccgaatgcggtcatatcacgttgccaggctatacggagcaggaagatggtccatcagtcagttgctattgcggcaaacacaactgcgtggagtcgtttgtttccggcagcggttttagtgaacgctatcaacagatgactggtaacttgctcactcctgcggcgattgtcaccctggcacaacgtggtgatgcttgtgccatgcagcaggtggcacgttttcgccaacagcttgcccgcacgctggcaaccatcgttaatgttgttgaccctggcgtgattgtgatcggcggcgggctttcgaatgtggaactgcttatcaccgatctgaacgcagaagtcgctccactggttttcaccgatcaattcaccactcccattgtaaaagcacagcacggcgacagtagcggaatgcgtggcgctgcctggcttgctatgcgcaacggagaagccaatgaaacgttcacaaattaa

SEQ ID NO: 8476 - protein, 310 aa, Escherichia coli
MHYLGLDIGGTKIAAVVMDAHGWEIRRYRCPTQKSTYQQFVSCVVALIEQIRRDVQRPMLTGIALPGSISPLTGLIKNANIQVINGHALQADLQQLLGQPVVIANDGNCFALSEACDGAGQDYDVVFGITLGTGCGGGIAIKQRPFIGAWGNAAECGHITLPGYTEQEDGPSVSCYCGKHNCVESFVSGSGFSERYQQMTGNLLTPAAIVTLAQRGDACAMQQVARFRQQLARTLATIVNVVDPGVIVIGGGLSNVELLITDLNAEVAPLVFTDQFTTPIVKAQHGDSSGMRGAAWLAMRNGEANETFTN

SEQ ID NO: 8477 - DNA, 861 bp, Escherichia coli
atgttagtttcgatgaaagaattactgcaacctacccgccagcacggctttgccattggcgcatttaatgtggcggataactgtttccttcgcgcagtcgtggatgaagcagaagcgacaaatactccggcgattattgccatccatcccagcgaacatgattttgtgggcgatgcctttttcgctcacgttcgcgaaattacccagcgtagtccggtcccgtttgtactgcacctcgatcatggtgcctctgtagagcatgttttgcgtgcgattcgctgcggatttacctcagtaatgatcgacggttcgctgctgccgtatgaagaaaacgtggcgctgaccgcagaagtggttcgcctcgctcacgcggttggcgtgtcggttgagggtgaactgggaaccatcggacaaacaggaacgtcggtagaaggtggtgtttcacaagtgacctacacagatccggcgcaggccgccgattttattgctcgtacaggtgccgacacactggctgtggcgattggtacagcgcatggcatctatccaaaagggatgcagccgaagctgcaaatggacattttgcgcgacattgccggacgtattgatattccgctggtgctacacggtggttcggcaaacccggacgcggagattgctgaatcagttacgctcggcgtcggcaaaatcaatatctccagcgatatgaaatacgcctatttccagaaagtgcgtgaaattctcgctaaagagagctggtgggacccgaacgtcatctatccggatgcgattaacgcggcgcgggaagtcattcgccacaaaatgaaactgttcggttcgctcggtaaagcatcactgtactaa

SEQ ID NO: 8478 - protein, 286 aa, Escherichia coli
MLVSMKELLQPTRQHGFAIGAFNVADNCFLRAVVDEAEATNTPAIIAIHPSEHDFVGDAFFAHVREITQRSPVPFVLHLDHGASVEHVLRAIRCGFTSVMIDGSLLPYEENVALTAEVVRLAHAVGVSVEGELGTIGQTGTSVEGGVSQVTYTDPAQAADFIARTGADTLAVAIGTAHGIYPKGMQPKLQMDILRDIAGRIDIPLVLHGGSANPDAEIAESVTLGVGKINISSDMKYAYFQKVREILAKESWWDPNVIYPDAINAAREVIRHKMKLFGSLGKASLY

SEQ ID NO: 8479 - DNA, 852 bp, Escherichia coli
atgtttgccgatatgaaaagtatggtgatgaaagcctggcatgaacattacgccttgctggcgatcaactgtatgaatctggaaagtgctcacgcagctatccgcgtggcggagaagaatcgcgctccgatcattctcaatctctatcaggggcatctggcgcattttcctgcacccgtcgcggcggcagtggttaaaacgctcgcggaatctgcctcagtaccggtcgctctggcgcttgatcatggcaaaaatccggactgtattcgtcaggcgtttcgtgctggtttcagcggattaatgattgatgcttctgcttttcccctggaggaaaacgtgcgccagaccagggcggtggtggaactcgccgccagcgcgcagctctgcgtggaaggcgaactgggccatctggcagatgcgccgcgttacgaccaggccgccaatgcagacctgatgacgcaacccactgatgtggaaccgtttatcgcgcagacaggcattgatctactggccgtctcggtaggcacggcgcacggcatgtacgcgcctggcgttgtacctgctattgattttcagcgtctggcggagatttcgcgctgctcgagcgtgcctctggcattacatggcggtagcggtacgccgttcgatcagctccagctctgtacgacgctgggggtagcaaaaatcaacgtgggggcggccatttttgaacgggggaaatccgcgctcctgcataccctctgtcacgatatatccattgaactggtggacgcgctgaaagctatggaactggccttcgaagaagcgattacaccgtatttacaggcgagcggctctatcggcaaagcctga

SEQ ID NO: 8480 - protein, 283 aa, Escherichia coli
MFADMKSMVMKAWHEHYALLAINCMNLESAHAAIRVAEKNRAPIILNLYQGHLAHFPAPVAAAVVKTLAESASVPVALALDHGKNPDCIRQAFRAGFSGLMIDASAFPLEENVRQTRAVVELAASAQLCVEGELGHLADAPRYDQAANADLMTQPTDVEPFIAQTGIDLLAVSVGTAHGMYAPGVVPAIDFQRLAEISRCSSVPLALHGGSGTPFDQLQLCTTLGVAKINVGAAIFERGKSALLHTLCHDISIELVDALKAMELAFEEAITPYLQASGSIGKA

SEQ ID NO: 8481 - DNA, 1092 bp, Escherichia coli
atgaaagaaaataaaattccggtttcacaggaaattaaaaaacatttattaaccggcatctcgtggatgataccccttattgtggccgccgggatatgtattgcgttggggcaagttcttggcggtacagatgttggtgaaaaaacaggaacaatcccgtggatgcttaatcagattggcggctggggaatggggctgattgtgccgctgattagcgcggcaattgcctattctattgccgatcgtcccggatttgccccgggcctgattgtcggctttctctgtgggcaaatccataccggatttattggcggtatgttgggtggtttcctggtgggctacaccattttgctacttaaacgctatatccgcctgccgcagtcgatgcaaggactcatgccaatcatggtgttgccggtattaagcaccattatcggtgggctgttaatgatgacgctgattggtaaacccatcgcctggttacaagaagcactgattcatttgctcgagtcgatgcagggcggatcgcgcttcctgatgggggccatacttggcgcgatggcaaccttcgatttcggtggtccggtcaacaaaaccatgtcgctgttttccgatggcttgctggtcagtggcgtctacggaccagaagccgtgaaatttgtcggctcaatcatccctccgtttggcatcacactttcgttcttactgacacgccataaatacacccgtgcggagcgcgaggcgctgaaagccgcgtttccgatggggatctgcatgatcactgaaggagtcattccgatcgccgcgcgtgacctgctgcgagtagtgggatcttgtgtggtggcatcggcggtcgcgggcggcttaatcatggtgtggggcgtggagagtccggttccgcatggcggcatgtttgttgtgcctctgttcacccatcctctgctgttttgcctggcgctgggtataggcacggtgatttgtggcgtgatgctttcactctggaagaaaccggtaacggaacgcgacgaagagtttgacgaactgagcgatcaaaagctgaaagatgaagagatcactttcaccctcgaataa

SEQ ID NO: 8482 - protein, 363 aa, Escherichia coli
MKENKIPVSQEIKKHLLTGISWMIPLIVAAGICIALGQVLGGTDVGEKTGTIPWMLNQIGGWGMGLIVPLISAAIAYSIADRPGFAPGLIVGFLCGQIHTGFIGGMLGGFLVGYTILLLKRYIRLPQSMQGLMPIMVLPVLSTIIGGLLMMTLIGKPIAWLQEALIHLLESMQGGSRFLMGAILGAMATFDFGGPVNKTMSLFSDGLLVSGVYGPEAVKFVGSIIPPFGITLSFLLTRHKYTRAEREALKAAFPMGICMITEGVIPIAARDLLRVVGSCVVASAVAGGLIMVWGVESPVPHGGMFVVPLFTHPLLFCLALGIGTVICGVMLSLWKKPVTERDEEFDELSDQKLKDEEITFTLE

SEQ ID NO: 8483 - DNA, 315 bp, Escherichia coli
atgaatattgtctgtgttgccgcctgtacggcgggtattgctcatacctatattgctcgtgaaaagttaatcaaaggagcaaaagctctgggccataccattaaagttgaaacccagggaaccattggtacagaaaatgaattacaggcggcagatatctctgctgctgacgtcgtgattcttgctgtagatgtgaaaataaaaggagaagaacgcttcaccaataaacgtattgtgcgagtaaagacagagatcgtcattaaatcgcccgttcaatttcttgaaaaggtcgaaaaatcactgggaaacaaatga

SEQ ID NO: 8484 - protein, 104 aa, Escherichia coli
MNIVCVAACTAGIAHTYIAREKLIKGAKALGHTIKVETQGTIGTENELQAADISAADVVILAVDVKIKGEERFTNKRIVRVKTEIVIKSPVQFLEKVEKSLGNK

SEQ ID NO: 8485 - DNA, 471 bp, Escherichia coli
atggacataacaaaaatcctgaatacgaatcgcgttattttagatatgcaagcgacgaataaagcggaggcgattgaagaattaactaatcttctcaaaaaagatggtgcgatcgattgtcgggaaacctttattaaagatgtctggcagcgcgaagcggaaggctcgactggttttgaaaatcatattgcgatcccgcatggtaaatcttcagctgtgattaatactacgctggcaattggccgtacccgccaggatattccctgggaaacgctggatggcagtagcgtgcgctgtattattttatttgcggtacgtcttgaagatcaaaataccacccatatccgtttactttcccaggtcgcgggcgcgctggcggatgatgacatcatagaacaattgttagttgagacgagtccgcaaaaaatcattgatctctttagtcagtatgcacaatccgatgtcttctaa

SEQ ID NO: 8486 - protein, 156 aa, Escherichia coli
MDITKILNTNRVILDMQATNKAEAIEELTNLLKKDGAIDCRETFIKDVWQREAEGSTGFENHIAIPHGKSSAVINTTLAIGRTRQDIPWETLDGSSVRCIILFAVRLEDQNTTHIRLLSQVAGALADDDIIEQLLVETSPQKIIDLFSQYAQSDVF

SEQ ID NO: 8487 - DNA, 1554 bp, Escherichia coli
atgcaaatgattacctcgcgacaaaacagattattacgattccttttacctcgaagggaatatacgactattgttacgattgccggctatttaaatgtttcggaaaaaaccattcaacgtgatttacgtttacttgagcaatggctgggacaatggagaataaatgttgagaagcgtgctggcgcgggtgtgatgttaagtgcggagaatattgctgatttgctgcatcttgatcatttgttggtggcagaatgtgaagagattgatggtgtaatgaataatgccaggcgcgttaaaatagcgtcgcagttattaagtgaaacaccgaatgaaacgtcgatcagtaaattgtcagaacgctactttatcagcggagcctctattgttaatgacctgagagtaattgagtcctggcttgcgccgttggggttatcgttgatccgcagtccaagtggtacgcatattgaaggtagtgaagggcaagtccgacaggcaatggcattactgattaacggcattattaaccataatgagccgcaaggtgtcgtgtattcacgtctggatcccggaagctataaagcattagtccattattttggagaagaagaggtgttatttgtccagtcattgttactggatatggaaaatgaattaagttggtctttgggagaaccttattacgttaacatttttactcacatccttattatgatgtatcgcaacacgcacgggaatgcgttatcaagagaagaagatcaaaccagacaatatgatgaaaatatctttaatgttgccagtcagatgattcataagatagaacaacgaattgcacatacattgcccgatgatgaagtctggtttatttatcaatatatcatttcatcaggtgtggcgattgatggacaaaaagatgttagcattatttcacatatgcaggccagcaatgaagcgcgtctgattacctggcgtttaattacggtattcagtgacatcgtggactgcgattttagtgaagacagcgcattatatgatggcttattggtgcatattaagccgctgattaaccgtctaaattatcgcattcatatccgtaatccattgctggaagatattaaagcagaattagcggatgtctggcggttgacgcaatatgtggtgaatcaggtatttaaaacctggggtgagaatgcagtgagcgaggatgaagtgggttacctgaccgttcattttcaggctgcgatggagcggcaaattgcccgtaaacgtgtattactggtctgttcaaccggaatcggaacttcgcatctactgaaaagccgtattctgcgagcatttcctgaatggacgattgttgatgttatttcagcagcgaatttatcacaggttttgcctgacaatatcgaactgattatttcgaccattaatttgcctacagtcactatgccggtcgcttatgttaccgctttttttaatgatgccgatattaagcgggtcactgaaatggtgattacggaaaaattacatcatgcgacgtctcgggtcgttgaaatttaa

SEQ ID NO: 8488 - protein, 517 aa, Escherichia coli
MQMITSRQNRLLRFLLPRREYTTIVTIAGYLNVSEKTIQRDLRLLEQWLGQWRINVEKRAGAGVMLSAENIADLLHLDHLLVAECEEIDGVMNNARRVKIASQLLSETPNETSISKLSERYFISGASIVNDLRVIESWLAPLGLSLIRSPSGTHIEGSEGQVRQAMALLINGIINHNEPQGVVYSRLDPGSYKALVHYFGEEEVLFVQSLLLDMENELSWSLGEPYYVNIFTHILIMMYRNTHGNALSREEDQTRQYDENIFNVASQMIHKIEQRIAHTLPDDEVWFIYQYIISSGVAIDGQKDVSIISHMQASNEARLITWRLITVFSDIVDCDFSEDSALYDGLLVHIKPLINRLNYRIHIRNPLLEDIKAELADVWRLTQYVVNQVFKTWGENAVSEDEVGYLTVHFQAAMERQIARKRVLLVCSTGIGTSHLLKSRILRAFPEWTIVDVISAANLSQVLPDNIELIISTINLPTVTMPVAYVTAFFNDADIKRVTEMVITEKLHHATSRVVEI

SEQ ID NO: 8489 - DNA, 2319 bp, Escherichia coli
atgaaaattagcgacggaaactggttgattcaacctggcctcaatttgattcacccgcttcaggtgttcgaggttgaacagcaggataatgaaatggtggtctatgctgcccctcgtgatgtgcgtgaacgtacctggcagcttgatacgcctttatttacgctgcgctttttctccccacaggaaggtattgtcggtgtacggattgagcattttcagggggcgctgaataacggtcctcattacccgctcaatattttgcaggacgtgaaggtcactatcgaaaacacagaacgttacgctgagtttaaaagtggcaacttaagtgcgcgtgtcagcaaaggtgagttctggtcactggattttctgcgcaacggcgaacgtattaccggtagtcaggtgaaaaataacggctacgtgcaggacacgaataatcaacggaattatatgtttgaacggcttgatcttggcgttggcgaaacagtttacggcctgggagagcgctttactgccctggtgcgcaatggtcagacggtagaaacctggaaccgggacggcggcacaagtactgaacaggcgtataaaaatatcccgttttatatgactaaccgtggttatggggtactggtcaatcatcctcaatgcgtctcttttgaagtgggatcagagaaagtctccaaagtacagttcagcgttgagagtgaatatctcgaatactttgttatcgacggcccgacgccgaaagcggtacttgatcgttatacccgttttactggccgtccggcgctgccgcccgcgtggtccttcggtctgtggctaaccacttcatttaccaccaactacgacgaagcgacggtaaacagctttatcgatggtatggcggaacgcaatctgccgctgcatgttttccactttgactgtttctggatgaaagccttccagtggtgcgattttgagtgggacccgctgacttttccggacccggaagggatgatccgccgtctgaaagcgaaagggctgaaaatctgcgtctggattaacccctatattgggcaaaaatcccccgtctttaaagagttacaagagaaaggttatttactcaaacgcccggacggttcgctgtggcagtgggataaatggcagccaggtctggcgatttatgactttaccaatccggatgcctgcaaatggtacgccgacaaactgaaaggtctggtcgcgatgggcgttgattgctttaagaccgactttggcgaacgtattccaaccgatgttcagtggtttgatggttccgatccgcagaaaatgcataaccattatgcgtacatctacaacgaactggtgtggaacgtgctcaaggacaccgttggtgaggaagaagccgtcttgtttgcccgctcggcctccgttggtgcgcagaaatttccggtacactggggtggcgactgttacgctaactacgaatcaatggcggaaagcctgcgcggtggtttgtctattggcctttcaggttttggcttctggagccacgatatcggcggctttgaaaataccgctccggcgcacgtttacaaacgctggtgcgcgtttggtttgctttccagccatagccgtttacatggcagcaaatcttatcgtgtgccgtgggcctacgatgatgagtcctgtgatgtggtgcgcttcttcacgcaactgaaatgccgcatgatgccgtatctgtatcgtgaagctgcacgtgcaaacgcccggggtacgccgatgatgcgggccatgatgatggagttcccggacgatccggcttgtgattaccttgaccgtcaatatatgttaggcgacaacgtgatggttgcgcctgtgttcacagaagcgggcgatgtgcagttctacctgccggaaggtcgctggacacacctgtggcacaacgatgaactcgacggtagtcgctggcataaacagcagcacagcttcctgagtctgcccgtttatgtgcgtgatagcaccctactggcgctgggcaacaacgatcaacgtcccgattacgcgtggcacgaaggtacggcattccacctctttaatctgcaagacgggcatgaagccgtctgtgaagtgcccgatgctgacggttcggtgatctttactttaaaagcagcacgtactggcaacacgattactgtgactggtacgggcgaggcgaagaactggacactgtgcttgcgcaatattgtgaaagtaaatggtctgcaaggcggttcgcaggctgaaagtgagcagggactggtggtgactcctcaagggaatgcgctgacaattacgttgtaa

SEQ ID NO: 8490 - protein, 772 aa, Escherichia coli
MKISDGNWLIQPGLNLIHPLQVFEVEQQDNEMVVYAAPRDVRERTWQLDTPLFTLRFFSPQEGIVGVRIEHFQGALNNGPHYPLNILQDVKVTIENTERYAEFKSGNLSARVSKGEFWSLDFLRNGERITGSQVKNNGYVQDTNNQRNYMFERLDLGVGETVYGLGERFTALVRNGQTVETWNRDGGTSTEQAYKNIPFYMTNRGYGVLVNHPQCVSFEVGSEKVSKVQFSVESEYLEYFVIDGPTPKAVLDRYTRFTGRPALPPAWSFGLWLTTSFTTNYDEATVNSFIDGMAERNLPLHVFHFDCFWMKAFQWCDFEWDPLTFPDPEGMIRRLKAKGLKICVWINPYIGQKSPVFKELQEKGYLLKRPDGSLWQWDKWQPGLAIYDFTNPDACKWYADKLKGLVAMGVDCFKTDFGERIPTDVQWFDGSDPQKMHNHYAYIYNELVWNVLKDTVGEEEAVLFARSASVGAQKFPVHWGGDCYANYESMAESLRGGLSIGLSGFGFWSHDIGGFENTAPAHVYKRWCAFGLLSSHSRLHGSKSYRVPWAYDDESCDVVRFFTQLKCRMMPYLYREAARANARGTPMMRAMMMEFPDDPACDYLDRQYMLGDNVMVAPVFTEAGDVQFYLPEGRWTHLWHNDELDGSRWHKQQHSFLSLPVYVRDSTLLALGNNDQRPDYAWHEGTAFHLFNLQDGHEAVCEVPDADGSVIFTLKAARTGNTITVTGTGEAKNWTLCLRNIVKVNGLQGGSQAESEQGLVVTPQGNALTITL

SEQ ID NO: 8491 - DNA, 1383 bp, Escherichia coli
atgaagagtgaagtgttgtccgttaaagagaaaattggttatggcatgggagacgccgccagccacattattttcgataacgtaatgttatatatgatgttcttttataccgatatttttggcattcctgccggatttgtcggaaccatgtttttggtcgctcgtgcactggatgcgatttccgatccttgcatggggttgttggccgatcgaacgcgctctcgctggggtaaatttcggccgtgggtgctgtttggcgcactgccattcgggatcgtctgtgtactggcctatagcacgccagatctcagtatgaacggaaaaatgatttatgcagcaattacttacaccctacttaccttactttataccatcgtcaatatcccttactgcgcattgggtggtgtaatcaccaatgacccgactcagcgtatctcgctgcaatcctggcgttttgtgctggcgaccgcgggaggcatgctctctactgttctgatgatgccactggttaatttaattggtggtgataataaaccactcggtttccagggcggtatcgcggtcctttccgtggtggcatttatgatgctggcattctgtttcttcaccactaaagaacgcgttgaagcaccacctacaacgacgtctatgcgggatgatttacgtgatatctggcaaaacgaccagtggcgtattgtcggtttcctgaccattttcaatatcctggcggtgtgcgtacgcggtggggcgatgatgtattacgtcacatggattttgggcacgccggaagtatttgtcgcttttctcaccacttattgcgtgggtaacctgattggttccgcactggcgaaaccgctgaccgactggaaatgtaaagtcactatcttctggtggacgaacgccctgctggcagtgattagcctcgcgatgttctttgttcctatgcaggccagcatcaccatgtttgtcttcatcttcgtgattggtgtgttgcatcaactggtgacacctatccagtgggtaatgatgtccgataccgtcgactacggcgagtggtgcaatggtaaacgcctgaccgggatcagttttgctggcacgctgtttgtgctcaaactggggttggccttcggtggtgcccttatcggctggatgctggcttatggcggatatgatgcggcagaaaaagcgcagaacagcgtcacaattagcatcattatcgcgctattcacgattgttccggcgatctgttacttgctgagcgcgattatcgctaaacgctactactcgctcacgacgcacaatctgaaaaccgttatggaacagctggcgcagggcaaacgccgttgccagcaacaattcacctctcaagaagtgcagaactaa

SEQ ID NO: 8492 - protein, 460 aa, Escherichia coli
MKSEVLSVKEKIGYGMGDAASHIIFDNVMLYMMFFYTDIFGIPAGFVGTMFLVARALDAISDPCMGLLADRTRSRWGKFRPWVLFGALPFGIVCVLAYSTPDLSMNGKMIYAAITYTLLTLLYTIVNIPYCALGGVITNDPTQRISLQSWRFVLATAGGMLSTVLMMPLVNLIGGDNKPLGFQGGIAVLSVVAFMMLAFCFFTTKERVEAPPTTTSMRDDLRDIWQNDQWRIVGFLTIFNILAVCVRGGAMMYYVTWILGTPEVFVAFLTTYCVGNLIGSALAKPLTDWKCKVTIFWWTNALLAVISLAMFFVPMQASITMFVFIFVIGVLHQLVTPIQWVMMSDTVDYGEWCNGKRLTGISFAGTLFVLKLGLAFGGALIGWMLAYGGYDAAEKAQNSVTISIIIALFTIVPAICYLLSAIIAKRYYSLTTHNLKTVMEQLAQGKRRCQQQFTSQEVQN

SEQ ID NO: 8493 - DNA, 1167 bp, Escherichia coli
gtgaggcggctggacttcaaatccagttggggccgccagcggtcccgggcaggttcgactcctgtgatcttccgccaaaatgcctctcctgaactctcccgacgtcaacaacactccttcggaggcgacatgtcagacaaagacttaacccagcccccagcaggcgagtttattatgtttgccagcggtgacggaagagtgcgtgttgaatgtcgctttgagtcagacacaatctggttatcccaggcggcaatggctgaactgtacgataaagatgttcgcactattaacgaacatttaatcaatatattttccgaaggtgaacttgttcaaaactcaaccatccggaaattccggatagttcgccaggaaggaaaacgtcaggtttccagagagatagaccattacaacctcgaagccattctcgctgtcggctatcgcgttcgctcgcctcgaggcacgcaattccgccagtgggcaacgcagacgcttcaggaatacctgatcaaaggttttgtgatggacgatgagcggctgaagaatccgcctgtcggttcatcggttgtgcccgactattttgatgagatgcttgaacgcatccgcgatattcgcgccagcgagcgtcgggtatatttgcgggtgcgggagatctttgctttagctgccgactatcagccatcgcttaaagaaaccacgcaattttttcaaaccatccagaataaactgcattttgcctgtaccgggcataccgctgcggaactcatccacaaacgagcagatgccagccagccgcacatgggcttgaccagttataaaggtgaagaggtacgtaagggcgacgtgacggtggcaaaaaattatctcacccaggatgaggtcagcgaacttaatcgcgtggttaatatgtggctggactttgccgaggatcaggcccgtcgtcgtcagcaagtctttttgcgcgactggcaggataagctggatcagttcctgcaatttaacgaccgagaggttctacagggcgctggtaaaatcagcaagaaaatggccgatgaaaaagcgcaggcggagtatgttcagtttgccgaacaacaacggcgcttaaaagaagccgaaggcgagaaggatatcgctggtttgctacagtggaataaagagtcgaaaaagtag

SEQ ID NO: 8494 - protein, 388 aa, Escherichia coli
MRRLDFKSSWGRQRSRAGSTPVIFRQNASPELSRRQQHSFGGDMSDKDLTQPPAGEFIMFASGDGRVRVECRFESDTIWLSQAAMAELYDKDVRTINEHLINIFSEGELVQNSTIRKFRIVRQEGKRQVSREIDHYNLEAILAVGYRVRSPRGTQFRQWATQTLQEYLIKGFVMDDERLKNPPVGSSVVPDYFDEMLERIRDIRASERRVYLRVREIFALAADYQPSLKETTQFFQTIQNKLHFACTGHTAAELIHKRADASQPHMGLTSYKGEEVRKGDVTVAKNYLTQDEVSELNRVVNMWLDFAEDQARRRQQVFLRDWQDKLDQFLQFNDREVLQGAGKISKKMADEKAQAEYVQFAEQQRRLKEAEGEKDIAGLLQWNKESKK

SEQ ID NO: 8495 - DNA, 903 bp, Escherichia coli
atgctgaacgttctgattgccgccgtgttgtggggaagttcaggggtctgcgcgcaatacatcatggagcaaagccagatgtcgtcgcagtttttgactatgacgcgtttgatattcgccggtttgattctgctgacgctatcatttattcatggtgataaaatcttttctattattaacaatcacaaagatgccattagcctactgattttttccgtggttggcgcgctaaccgtacagctcacttttttgctaaccatcgaaaaatcgaacgcagccacggcaacggtgctgcaattcctctcaccgactattatcgtcgcctggttctcactggtgcgtaaatcccgcccgggcattctggttttctgcgctattttgacatcgctgatcgggacttttttattggtgacacacggtaatccgacgtcattatcgatctctcctgccgcgttattctgggggattgcctcggcatttgctgctgcattctataccacctatccctcaacgctgattgcccgctatggcacgttaccggtcgtcggctggagtatgctgattggcggtctgatcctgctgcccttttatgccagacaagggacaaactttgtcgttaacggcagtttgattctggcgtttttttatttggtggtcattggtacgtccctgacatttagtctgtacctgaaaggagcacaattaattggcggtccaaaagccagcattttaagctgtgcagaaccattaagtagcgcgctgctctctttgttgttgctggggatcaccttcacattgccggactggctgggaacgctgctgattctgtcatcggtgattttgatttcaatggattcccgccgccgcgccagaaaaataaatcgtccggcgcggcatgagtga

SEQ ID NO: 8496 - protein, 300 aa, Escherichia coli
MLNVLIAAVLWGSSGVCAQYIMEQSQMSSQFLTMTRLIFAGLILLTLSFIHGDKIFSIINNHKDAISLLIFSVVGALTVQLTFLLTIEKSNAATATVLQFLSPTIIVAWFSLVRKSRPGILVFCAILTSLIGTFLLVTHGNPTSLSISPAALFWGIASAFAAAFYTTYPSTLIARYGTLPVVGWSMLIGGLILLPFYARQGTNFVVNGSLILAFFYLVVIGTSLTFSLYLKGAQLIGGPKASILSCAEPLSSALLSLLLLGITFTLPDWLGTLLILSSVILISMDSRRRARKINRPARHE

SEQ ID NO: 8497 - DNA, 819 bp, Escherichia coli
atgaaactgacaacacatcatctacgggcgggggccgcattattactggcaggagttctgctggcaggttgcgaccagagcagcagcgatgaaaagcatattaaagttggcgttattaatggcgcagaacaagatgtcgcggaagtcgctaaaaaggtagcaaaagagaaatatggtctcgatgttgaactggtaggatttagcggttcgttgctaccgaacgatgcgacaaatcatggcgagcttgatgcgaacgtcttccagcatcgaccctttcttgaacaagataatcaggcgcatggttataaactggtagcggtgggaaatacgtttgtcttccccatggcgggctattccaaaaaaatcaaaacagtggcgcaaataaaagaaggtgcgacagtggcgatccccaacgacccgactaaccttggtcgcgcgcttttactgctgcaaaaagagaagctaattactctgaaagaaggaaaagggttattacctaccgcgttggatataaccgataatccacgccatttgcagataatggagctggaaggggcacagttgccacgtgtactggacgacccgaaagtggatgtagcgattatcagcaccacttacatccagcaaacaggactttctccggttaacgacagcgtatttattgaagataaaaattcgccgtatgtgaatattctggtggcacgggaagataataagaatgcagaaaacgtgaaggaatttctgcaatcttatcaatcacccgaagtcgctaaagcggcagaaaccatctttaacggaggcgcggtgcctggctggtaa

SEQ ID NO: 8498 - protein, 272 aa, Escherichia coli
MKLTTHHLRAGAALLLAGVLLAGCDQSSSDEKHIKVGVINGAEQDVAEVAKKVAKEKYGLDVELVGFSGSLLPNDATNHGELDANVFQHRPFLEQDNQAHGYKLVAVGNTFVFPMAGYSKKIKTVAQIKEGATVAIPNDPTNLGRALLLLQKEKLITLKEGKGLLPTALDITDNPRHLQIMELEGAQLPRVLDDPKVDVAIISTTYIQQTGLSPVNDSVFIEDKNSPYVNILVAREDNKNAENVKEFLQSYQSPEVAKAAETIFNGGAVPGW

SEQ ID NO: 8499 - DNA, 363 bp, Escherichia coli
atgatgagagcggcaaaagcaaactacacttatgcttcattcgatgcacatttgcagaaggttgccgctatgaagccaacgatgctactcatgattaccgtattcctgatttttccagccatttctcaggccgagtcgccattcagttctctacagtcggcaaaagagaaaaccacggtattgcaagatttacgtaaaatttgcacgccacaggcgtcattatcagatgaagcgtgggaaaagttaatgttgtcagatgaaaacaataaacaacatatacgcgaggccatcgtggcgatggaacgtaataatcagagcaattattgggaagcgttgggtaaggtagaatgcccggatatgtaa

SEQ ID NO: 8500 - protein, 120 aa, Escherichia coli
MMRAAKANYTYASFDAHLQKVAAMKPTMLLMITVFLIFPAISQAESPFSSLQSAKEKTTVLQDLRKICTPQASLSDEAWEKLMLSDENNKQHIREAIVAMERNNQSNYWEALGKVECPDM

SEQ ID NO: 8501 - DNA, 1356 bp, Escherichia coli
gtggataagacgttcacaccgcatccggtaatctttgccctgttccgtttcgatcttaactccagctcaagcaacaccgtaaaagttgcaaaaacgttaaatacgtcacacatttcaatgttaaagtggtcggctttccctctgaaacatgccacgggtaacaccatgagtgaatttattgctgaaaaccgcggcgcggatgccatcacccgaccgaactggtcagccgttttctcggtggcgttttgcgtcgcctgtctgattatcgttgagtttttgcctgtcagtttgttgacgccaatggcccaggatttaggcatttcggaaggggttgccggccaatcggtgaccgtgaccgcctttgtggcgatgtttgccagtttgtttattacccagaccattcaggccactgaccgccgctacgttgtcattctgttcgccgttttgctgacgctttcctgtttgctggtttcctttgccaactcattcagtctgctgttaatcggccgcgcctgtctgggtctggcgctgggcgggttctgggcgatgtcggcgtcgctgaccatgcgtctggtaccgccgcgtacggtgccgaaggcgctgtcggtgatcttcggcgcggtttctattgcgctggtgattgccgcgccgttgggcagttttttaggcgagcttatcggttggcgcaatgtctttaatgcggcggcggcgatgggcgtgctgtgtattttctggattatcaaatcactgccttcgctgccaggtgaaccttcgcatcagaaacaaaatactttccgcttattacaacgtccgggagtgatggccgggatgatcgccatctttatgtcctttgccggacagtttgcttttttcacttatattcgcccagtgtatatgaatctggcgggattcggtgttgatggcttaaccctggtgctgctgagttttggtatcgccagctttgtcgggacatcgctttcgtcgtttattctcaaacgttcggtgaaactggccttagcgggcgcaccgtttgtgctcgccctgagcgcgctggtactgacactgtggggaagcgataaaattgttgctactggtgtggcgattatctgggggctgacctttgctttaattcccgttggttggtcaacgtggatcactcgctcattggccgatcaggcagaaaaggctggatctattcaggtggccgttattcagcttgctaacacctgcggtgcggcaatcggcggttatgcgttggataacattggtctgacttcgccgctgatgttgtccggcacattgatgttgctgactgcattgttggtgactgcaaaggtgaaaatgaagaaatcctga

SEQ ID NO: 8502 - protein, 451 aa, Escherichia coli
MDKTFTPHPVIFALFRFDLNSSSSNTVKVAKTLNTSHISMLKWSAFPLKHATGNTMSEFIAENRGADAITRPNWSAVFSVAFCVACLIIVEFLPVSLLTPMAQDLGISEGVAGQSVTVTAFVAMFASLFITQTIQATDRRYVVILFAVLLTLSCLLVSFANSFSLLLIGRACLGLALGGFWAMSASLTMRLVPPRTVPKALSVIFGAVSIALVIAAPLGSFLGELIGWRNVFNAAAAMGVLCIFWIIKSLPSLPGEPSHQKQNTFRLLQRPGVMAGMIAIFMSFAGQFAFFTYIRPVYMNLAGFGVDGLTLVLLSFGIASFVGTSLSSFILKRSVKLALAGAPFVLALSALVLTLWGSDKIVATGVAIIWGLTFALIPVGWSTWITRSLADQAEKAGSIQVAVIQLANTCGAAIGGYALDNIGLTSPLMLSGTLMLLTALLVTAKVKMKKS

SEQ ID NO: 8503 - DNA, 453 bp, Escherichia coli
atgatctggataatgctcgccacgctggcggtagtgtttgtggttggttttcgggtgctgacatccggggccagaaaagcgattcgccgtctcagcgatcggctgaacatcgatgtcgtacccgtggagtcgatggtcgatcaaatgggaaagtcagccggtgacgaatttttacgttatttgcatcgcccggatgagtcgcacctgcaaaacgccgcgcaggtgttgctcatctggcaaattgtcattgtcgatggtagcgaacagaacctgctgcaatggcatcggattttacaaaaagcccgccttgccgcgccgattactgatgctcaggtcaggctggcgctgggttttctgcgcgaaaccgaacctgaaatgcaggatatcaatgcttttcagatgcgctataacgcgttctttcagcctgccgagggcgttcactggctgcattaa

SEQ ID NO: 8504 - protein, 150 aa, Escherichia coli
MIWIMLATLAVVFVVGFRVLTSGARKAIRRLSDRLNIDVVPVESMVDQMGKSAGDEFLRYLHRPDESHLQNAAQVLLIWQIVIVDGSEQNLLQWHRILQKARLAAPITDAQVRLALGFLRETEPEMQDINAFQMRYNAFFQPAEGVHWLH

SEQ ID NO: 8505 - DNA, 1413 bp, Escherichia coli
gtgataattatcactgaaccgttgttgtcatttgttttacaaaagcaagggattaaatctcctccaatggacaaaaaaatgaataatgacaataccgattacgtgagtaatgaatcagggacgctttcgcgattatttaaactatctcagcatgggaccaccgtccgcacagaattgattgcggggatgaccacttttttaaccatggtgtacatcgtttttgtgaacccgcaaatcctcggcgcggcacaaatggacccgaaagtggtgtttgttaccacctgtttgattgccggtatcggcagtattgcgatgggggtatttgctaacttacccgtggcactggctccggcaatgggcctgaacgccttctttgccttcgtggtcgtgggggcgatgggtatctcctggcagaccgggatgggcgcgatattctggggcacagttgggctatttttgctcacgctgtttcgtatccggtactggatgatctccaacattccattaagtttacgtattggtatcaccagcggaatcggattatttatcgccttaatgggattaaaaaatactggcgttattgtcgccaataaagacaccctggtgatgattggcgatttaagttctcacggcgtgttgttaggtattttagggttttttattataaccgtgttgtcatcacgtcattttcatgccgcggtgcttgtttctattgtggtgacgtcttgctgtggattgtttttcggtgatgttcattttagcggcgtctattccattccgcctgatattagcggcgtcattggtgaagtggatttgagcggtgcgttatcacttgaactcgccggtatcattttctcctttatgctgatcaacttatttgattcatcagggacattaattggtgtgactgataaagctggcttaatagatagtaacggtaaattccccaatatgaataaggcgctgtatgttgatagcgtcagttcggtggcgggtgcgtttatcggtacctcgtctgttaccgcctatattgaaagtacttcaggtgtggctgtcggtggtcgcacggggctgacggctgtcgtagtcggcgttatgttcctgttagttatgttcttctcaccgctggtggcgatggttcctccttacgcaaccgccggagcgttaatctttgttggcgtgctgatgacttcaagcctggcgcgcgttaactgggatgattttaccgaatcggtgcctgcgtttattaccacggtgatgatgccctttactttctcgatcaccgaagggattgcactaggctttatgtcgtactgcatcatgaaagtgtgcaccgggcgctggcgcgatctgaacctgtgtgtggtggtggtcgcaactctgtttgcactgaagattattctggtggattag

SEQ ID NO: 8506 - protein, 470 aa, Escherichia coli
MIIITEPLLSFVLQKQGIKSPPMDKKMNNDNTDYVSNESGTLSRLFKLSQHGTTVRTELIAGMTTFLTMVYIVFVNPQILGAAQMDPKVVFVTTCLIAGIGSIAMGVFANLPVALAPAMGLNAFFAFVVVGAMGISWQTGMGAIFWGTVGLFLLTLFRIRYWMISNIPLSLRIGITSGIGLFIALMGLKNTGVIVANKDTLVMIGDLSSHGVLLGILGFFIITVLSSRHFHAAVLVSIVVTSCCGLFFGDVHFSGVYSIPPDISGVIGEVDLSGALSLELAGIIFSFMLINLFDSSGTLIGVTDKAGLIDSNGKFPNMNKALYVDSVSSVAGAFIGTSSVTAYIESTSGVAVGGRTGLTAVVVGVMFLLVMFFSPLVAMVPPYATAGALIFVGVLMTSSLARVNWDDFTESVPAFITTVMMPFTFSITEGIALGFMSYCIMKVCTGRWRDLNLCVVVVATLFALKIILVD

SEQ ID NO: 8507 - DNA, 1767 bp, Escherichia coli
atgaataattctattaaccataaatttcatcacattagccggactgaataccaggaattgttagccgtttcccgtggagacgctgttgccgattatattattgataatgtctctattctcgacctgatcaatggcggagaaatttccggcccaattgtgattaaaggacgttacattgccggtgttggcgcagaatacgctgatgctccggctttgcagcggattgatgcccgcggcgcaacggcggtgccagggtttattgatgctcacctgcatattgaatccagcatgatgacgccagtcacttttgaaaccgcgaccctgccgcgcggcctgacgaccgttatttgcgaccctcatgaaatcgtcaacgtgatgggcgaagccggattcgcctggtttgcccgctgtgccgaacaggcaaggcaaaaccagtacttacaggtcagctcttgcgtacccgcactggaaggctgcgatgttaatggtgccagttttacccttgaacagatgctcgcctggcgggaccatccgcaggttaccggccttgcagaaatgatggactaccctggcgtaattagcgggcagaatgcgctgctcgataaactggacgcatttcgccacctgacgctggacggtcactgcccgggtttgggtggtaaagaacttaacgcctatattgctgcgggtattgaaaactgccacgaaagttatcagttggaagaaggacgccggaaattgcaactcggcatgtcattgatgatccgtgaagggtccgcagcccgcaatctcaacgcgctggcaccgttgatcaacgaatttaacagcccgcaatgcatgctctgtaccgatgaccgtaacccgtgggagatcgcccatgaaggacacatcgatgccttaattcgccgcctgatcgaacaacacaatgtaccgctgcatgtggcatatcgcgtagccagctggtcgacggcgcgccattttggtctgaatcacctcggcttactggcacccggcaagcaggccgatatcgtcctgttgagcgatgcgcgtaaggtcacggtgcagcaggtactggtgaaaggcgagccgatcgatgcacaaaccttacaggcggaagagtcggcgagactggcacaatccgccccgccatatggcaataccattgatcgccagccagtttccgccagcgactttgccctgcaatttacccccggaaaacgctatcgcgttattgaggtaatccataacgaactgatcacgcactcccgctccagcgtctacagcgaaaacggttttgatcgcgatgatgtgtgctttattgccgttcttgagcgttacggacaacgactggctccggcctgtggtttgctcggcggctttggcctgaatgaaggtgcgctggctgcgacggtcagccatgacagccataatattgtagtgatcggtcgtagcgcagaagagatggcgctggcggtcaatcaggtgattcaggatggcggcgggctgtgcgtggtccgtaacggccaggtacaaagtcatctaccgttgcccattgccgggctaatgagcaccgacacggcgcagtcactggcggagcaaattgacgccttgaaagccgccgcccgtgaatgcggtccgttacccgatgagccgtttattcagatggcgtttctttccctgccagtgatccccgcgctgaaactaaccagtcaggggctgtttgatggcgagaagtttgccttcactacgctggaattcacggaataa

SEQ ID NO: 8508 - protein, 588 aa, Escherichia coli
MNNSINHKFHHISRTEYQELLAVSRGDAVADYIIDNVSILDLINGGEISGPIVIKGRYIAGVGAEYADAPALQRIDARGATAVPGFIDAHLHIESSMMTPVTFETATLPRGLTTVICDPHEIVNVMGEAGFAWFARCAEQARQNQYLQVSSCVPALEGCDVNGASFTLEQMLAWRDHPQVTGLAEMMDYPGVISGQNALLDKLDAFRHLTLDGHCPGLGGKELNAYIAAGIENCHESYQLEEGRRKLQLGMSLMIREGSAARNLNALAPLINEFNSPQCMLCTDDRNPWEIAHEGHIDALIRRLIEQHNVPLHVAYRVASWSTARHFGLNHLGLLAPGKQADIVLLSDARKVTVQQVLVKGEPIDAQTLQAEESARLAQSAPPYGNTIDRQPVSASDFALQFTPGKRYRVIEVIHNELITHSRSSVYSENGFDRDDVCFIAVLERYGQRLAPACGLLGGFGLNEGALAATVSHDSHNIVVIGRSAEEMALAVNQVIQDGGGLCVVRNGQVQSHLPLPIAGLMSTDTAQSLAEQIDALKAAARECGPLPDEPFIQMAFLSLPVIPALKLTSQGLFDGEKFAFTTLEFTE

SEQ ID NO: 8509 - DNA, 1392 bp, Escherichia coli
atgctggctttcttaaaccaggttcgcaagccgaccctggaccttccgctcgaagtgcggcgcaaaatgtggttcaaaccgttcatgcaatcctacctggtggtctttatcggctaccttacgatgtacctgattcgcaagaactttaacatcgcgcagaacgacatgatctcgacctacgggttgagcatgacgcagctggggatgatcggcctgggcttctccatcacttatggcgtgggtaaaacgctggtttcttactacgccgacggcaaaaacaccaaacaattcctgccgttcatgctgatcctgtctgccatttgtatgctgggcttcagtgccagtatgggcagcggctcggttagcctgttcctgatgattgccttctacgccttgagcggctttttccagagtaccggcggttcgtgcagttactccaccatcaccaaatggacgccgcgtcgtaaacgcgggacattcctcggtttctggaacatttctcacaaccttggtggtgcaggcgcagcaggtgtggcgctgttcggcgcaaattacctgttcgatggtcatgtcatcggcatgtttattttcccgtcgattatcgcgctgattgttggttttattggtctgcgttacggcagcgactccccggaatcttatggcctcggcaaagctgaagagctgtttggcgaggagatcagtgaagaggataaagagacagaatctaccgatatgaccaagtggcagatctttgttgagtatgtgctgaaaaacaaagtgatctggctgctgtgctttgccaacattttcctctatgtggtgcgtattggtatcgaccagtggtcaaccgtgtatgcgttccaggaactgaaactctctaaagcggtggcgattcagggctttacgctgtttgaagctggtgcgctggtcggtacgctgctgtggggctggctctctgacctggcgaacggtcgccgtggcctggtggcctgtatcgcgctggcgctgattatcgccacgctcggtgtgtatcaacacgccagcaacgaatatatctacctggcttctctctttgcgttgggtttcctggtctttggcccgcaattgttgattggtgtggcggctgttggctttgtacctaaaaaagcgattggcgctgccgatggtattaaaggcaccttcgcttacctgattggtgacagctttgccaagttaggtctgggaatgattgccgatgggacgccggtatttggccttaccggctgggcaggcaccttcgccgcgctggatatcgccgcgattggttgtatctgcctgatggcgatagtggcggtgatggaagaacgcaaaatccgccgcgagaaaaaaattcagcagttgacagtggcataa

SEQ ID NO: 8510 - protein, 463 aa, Escherichia coli
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 8511 - DNA, 1323 bp, Escherichia coli
atgatgttgccgtttctgaaagcgcccgccgatgcgccattaatgactgataaacatgaaattgatgcccgctatcgctactggcgtcggcatattctgctgaccatctggctgggttacgcgctgttttacttcacgcgtaaaagttttaacgccgccgtaccagaaatccttgctaacggcgtgctcagccgtagcgatattggcctgttagcgaccctgttttacattacctacggcgtgtcgaagtttgtctccggcattgtcagcgatcgctcaaatgcccgttattttatggggatagggcttattgccacgggcattatcaacattctgtttggcttctcgacgtcgctatgggcgtttgccgtgctttgggtgttgaacgcctttttccagggctggggttcaccggtgtgtgcgcgtctgttaaccgcctggtattctcgtaccgagcgcggcggttggtgggcattatggaacacggcgcataacgtcggcggcgcactcattcccattgtgatggcagcgagcgcgctgcattacggctggcgtgccgggatgatgattgcgggttgtatggcgatagtcgtggggatttttctctgctggcggctgcgcgatcgcccgcaggcgttaggtttaccggcggttggtgaatggcggcacgacgcactggagattgctcaacaacaagaaggggcagggctgacgcgtaaagagatcctcaccaaatatgtgttgctgaatccgtatatctggctgctttcgttttgctatgtgctggtctatgtggttcgggcggcgatcaacgactggggcaatttgtatatgtccgagatgctgggcgtcgatctggtcacggcgaatacggcagtgacaatgtttgaactgggcggatttatcggtgcgctggtagcgggttggggttcggacaaactgtttaacggcaaccgcgggccgatgaatttgattttcgccgccggaattttgctttcagtcggctcgctgtggctgatgccatttgccagctacgtgatgcaggcaacctgcttcttcaccattggtttttttgtctttggcccgcagatgttaatcggcatggcggcggcagagtgttcccacaaagaggcggcaggggcggcgacgggatttgtcggcttgtttgcttatcttggtgcgtcgcttgctggttggccgctggcgaaagtactcgatacctggcactggagcggattttttgtggttatcgccatcgccgccgggatttccgcactgctattactgccctttttgaacgcccagacaccgcgagaagcgtga

SEQ ID NO: 8512 - protein, 440 aa, Escherichia coli
MMLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAASALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSEMLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVIAIAAGISALLLLPFLNAQTPREA

SEQ ID NO: 8513 - DNA, 1392 bp, Escherichia coli
atggcggtgctgttatttccgtttggcctgcggctagggctaatgctgcaatgcccgcgcggatactggccggtgctactgggtgcggagtggctgctgatttactggctaatgcaggcggtcggtttaacccatttctccttattgatgatcggtagtttactgacgttattgcccgtggcgctgatctcgcgctatcgccatcaacgtgactggcgcaccttgctgttacagggtgcggcgttaactgcggcggcgttgttgcagtcgctgccctggctttggcacggcaaagagtcgtggaatgcgctgctgctgactttaactggcggcctgacgctggccccgatatgtctggtgttctggcactatctggcgaataacacctggctgccgctcggcccgtcactggtttctcagccaatcaactggcgcgggcgacatctggtctggtacttgctgctgtttgttatcagtctctggctccagttgggattgccagacgaactgtcgcgctttacgccattctgtctggcgctgccgattatcgcgctggcctggcactatggttggcaaggagcgctgattgcgacattgatgaacgccatcgcgctgatcgccagtcaaacctggcgcgatcatccggtggatttattgctctcgctgttggtgcaaagtctgacagggttgttactgggcgcaggcatccagcggttgcgtgaacttaaccagtcgctgcaaaaggaactggcgcgcaatcagcatctcgctgaacggttgctggaaaccgaagagagcgtgcgccgtgatgtggcacgtgagctgcacgatgatatcggtcagaccattactgctattcgaactcaagcgggcattgttcagcggctggcggcagataacgccagcgtgaaacagagcgggcagctcatcgaacaactatcgctgggcgtttacgacgcggtgcgccgtttgttaggtcggttacgtccgcgccagttggatgatctcaccctggagcaggccatccgctcactgatgcgggaaatggagctggaagggcgcggcattgtcagccatctcgaatggcgaatcgatgaatcagcgttaagcgaaaaccagcgagtgacgctgtttcgtgtctgccaggaagggctgaacaacattgtgaaacatgctgatgccagcgcggtcaccctgcaaggctggcagcaggatgaacggttgatgctggtgattgaagacgatggcagcggtttaccgccagattccgggcaacacggttttggccttaccggaatgcgcgagcgcgtaacggcgctgggtggcacattgaccatttcctgtctgcacggcacgcgtgtcagcgtttctctacctcaacgttatgtctaa

SEQ ID NO: 8514 - protein, 463 aa, Escherichia coli
MAVLLFPFGLRLGLMLQCPRGYWPVLLGAEWLLIYWLMQAVGLTHFSLLMIGSLLTLLPVALISRYRHQRDWRTLLLQGAALTAAALLQSLPWLWHGKESWNALLLTLTGGLTLAPICLVFWHYLANNTWLPLGPSLVSQPINWRGRHLVWYLLLFVISLWLQLGLPDELSRFTPFCLALPIIALAWHYGWQGALIATLMNAIALIASQTWRDHPVDLLLSLLVQSLTGLLLGAGIQRLRELNQSLQKELARNQHLAERLLETEESVRRDVARELHDDIGQTITAIRTQAGIVQRLAADNASVKQSGQLIEQLSLGVYDAVRRLLGRLRPRQLDDLTLEQAIRSLMREMELEGRGIVSHLEWRIDESALSENQRVTLFRVCQEGLNNIVKHADASAVTLQGWQQDERLMLVIEDDGSGLPPDSGQHGFGLTGMRERVTALGGTLTISCLHGTRVSVSLPQRYV

SEQ ID NO: 8515 - DNA, 114 bp, Escherichia coli
ttgatggctggtgatgaagacgttgttctcccgcttaattaccgttattgcctgcttttttatcttctctgccgcatggttttgcctgtggagtatcagcctgcacctggttga

SEQ ID NO: 8516 - protein, 37 aa, Escherichia coli
MMAGDEDVVLPLNYRYCLLFYLLCRMVLPVEYQPAPG

SEQ ID NO: 8517 - DNA, 591 bp, Escherichia coli
atgatcaccgttgcccttatagacgatcaccttatcgtccgctccggctttgcgcagctgctggggctggaacctgatttgcaggtagttgccgagtttggttcggggcgcgaggcgctggcggggctgccggggtgcggtgtgcaggtgtgtatttgcgatatctccatgcctgatatctccggtctggagcttctaagccagctgccgaaaggcatggcgacaattatgctctccgttcacgacagtccggcgctggttgagcaggcgcttaacgccggggcgcgcggctttctctccaaacgctgtagcccggatgaactcattgctgcggtgcatacggttgccactggcggctgttatctgacgccggatattgccattaaactggcatccggtcgccaggacccgctaaccaaacgcgaacgccaggtggcagaaaaactggcgcaaggaatggcggtgaaagagattgccgccgaactgggcttgtcgccgaaaacggtacacgtccatcgcgccaatctgatggaaaaactgggcgtcagtaacgacgttgaactggcgcgccgcatgtttgatggctggtga

SEQ ID NO: 8518 - protein, 196 aa, Escherichia coli
MITVALIDDHLIVRSGFAQLLGLEPDLQVVAEFGSGREALAGLPGCGVQVCICDISMPDISGLELLSQLPKGMATIMLSVHDSPALVEQALNAGARGFLSKRCSPDELIAAVHTVATGGCYLTPDIAIKLASGRQDPLTKRERQVAEKLAQGMAVKEIAAELGLSPKTVHVHRANLMEKLGVSNDVELARRMFDGW

SEQ ID NO: 8519 - DNA, 291 bp, Escherichia coli
atgcaaaacacaactcatgataacgtgattctggaactcaccgttcgcaaccatccgggtgtaatgacccacgtttgtggcctttttgcccgtcgcgcttttaacgttgaaggcattctctgcctgccgattcaggacagcgacaaaagccacatctggctactggtcaatgacgaccagcgtctggagcagatgataagccaaatcgacaagctggaagatgtggtgaaagtgcagcgtaatcagtccgatccgaccatgtttaacaagattgcggtgttttttcagtaa

SEQ ID NO: 8520 - protein, 96 aa, Escherichia coli
MQNTTHDNVILELTVRNHPGVMTHVCGLFARRAFNVEGILCLPIQDSDKSHIWLLVNDDQRLEQMISQIDKLEDVVKVQRNQSDPTMFNKIAVFFQ

SEQ ID NO: 8521 - DNA, 1689 bp, Escherichia coli
atggcaagttcgggcacaacatcgacgcgtaagcgctttaccggcgcagaatttatcgttcatttcctggaacagcagggcattaagattgtgacgggtattccgggcggttctatcctgcctgtttacgatgccttaagccaaagcacgcaaatccgccatattctggctcgccatgaacagggcgcggggtttatcgctcagggaatggcgcgcaccgacggtaaaccggcggtctgtatggcctgtagtggaccgggtgcgactaacctggtgaccgccattgccgatgcgaggctggactccatcccgctgatttgcatcactggtcaggttcccgcctcgatgatcggcaccgacgccttccaggaagtcgacacctacggcatctctatccccatcaccaaacacaactatctggtcagacatatcgaagaactcccgcaggtcatgagcgatgccttccgtattgcgcaatcaggccgccctggcccggtgtggatagacattcctaaggatgtgcaaacggcagtttttgagattgaaacacagcccgctatggcagaaaaagccgccgcacccgcctttagcgaagaaagtattcgtgacgcggcggcgatgattaacgccgccaaacacccggtgctttatctgggtggtggtgtgatcaacgcgcctgcgcgagtgcgtgaactggcggagaaagcacaactgcctaccaccatgactttaatggcgctgggtatgttgccaaaagcgcatccgctgtcgctgggtatgctggggatgcacggtgtgcgcagcaccaactatattttgcaggaggcggatctgctgattgtactcggtgcgcgttttgatgaccgggcgattggcaaaaccgagcagttctgtccgaatgccaaaattattcatgtcgatatcgaccgcgcagagctgggcaaaatcaagcaaccgcatgtggcaattcaggcggatgttgatgacgtgctggcgcagttgatcccgctggtggaagcgcaaccgcgtgcagagtggcaccagttggtggcggatttgcagcgtgaattcccgtgtccaatcccgaaagcgtgcgatccattaagccattacggcctgatcaacgccgttgccgcctgtgtcgatgacaatgcgattatcaccaccgacgtgggtcagcatcagatgtggaccgcgcaagcctatccgctcaatcgcccacgccagtggctgacctccggcgggctgggcacgatgggttttggcctgcctgcggcgattggcgcggcgctggcgaacccggaccgcaaagtgttgtgcttctccggcgacggcagcctgatgatgaatattcaggagatggcgaccgccagtgaaaatcagctggatgttaaaatcattttgatgaacaacgaagcgctggggctggtgcatcagcaacagagtctgttctacaagcagggcgtttttgccgctacctatccgggcaaaatcaactttatgcagattgccgccggattcggcctcgaaacctgtgatttgaataacgaagccgatccgcaggctgcattgcaggaaatcatcaatcgccctggcccggcgctgatccatgtgcgcattgatgccgaagaaaaagtgtacccgatggtgccgccaggtgcggcgaatactgaaatggtgggggaataa

SEQ ID NO: 8522 - protein, 562 aa, Escherichia coli
MASSGTTSTRKRFTGAEFIVHFLEQQGIKIVTGIPGGSILPVYDALSQSTQIRHILARHEQGAGFIAQGMARTDGKPAVCMACSGPGATNLVTAIADARLDSIPLICITGQVPASMIGTDAFQEVDTYGISIPITKHNYLVRHIEELPQVMSDAFRIAQSGRPGPVWIDIPKDVQTAVFEIETQPAMAEKAAAPAFSEESIRDAAAMINAAKHPVLYLGGGVINAPARVRELAEKAQLPTTMTLMALGMLPKAHPLSLGMLGMHGVRSTNYILQEADLLIVLGARFDDRAIGKTEQFCPNAKIIHVDIDRAELGKIKQPHVAIQADVDDVLAQLIPLVEAQPRAEWHQLVADLQREFPCPIPKACDPLSHYGLINAVAACVDDNAIITTDVGQHQMWTAQAYPLNRPRQWLTSGGLGTMGFGLPAAIGAALANPDRKVLCFSGDGSLMMNIQEMATASENQLDVKIILMNNEALGLVHQQQSLFYKQGVFAATYPGKINFMQIAAGFGLETCDLNNEADPQAALQEIINRPGPALIHVRIDAEEKVYPMVPPGAANTEMVGE

SEQ ID NO: 8523 - DNA, 1191 bp, Escherichia coli
gtgataatgaaaaggcatagaaacgtcaatttgttattgatgttggtattactcgtggccgtcggtcagatggcgcaaaccatttatattccagctattgccgatatggcgcgcgatctcaatgtccgtgaaggggcggtgcagagcgtaatgggcgcttatctgctgacttacggtgtctcacagctgttttatggcccaatatccgatcgcgtgggtcgccgaccggtgatcctcgtcggaatgtccatttttatgctggcaacgctggtcgcggtcacgacctccagtttgatggtattgattgccgccagcgcgatgcaggggatgggcaccggcgttggcggcgtaatggcgcgtactttgccgcgcgatttatatgaacggacacagttgcgccacgctaacagcctgttaaacatggggattcttgtcagtccactgctcgcaccactaatcggcggtctgctggatacgatgtggaactggcgcgcctgttatctctttttgttggtactttgtgccggtgtgactttcagtatggcccgctggatgccggaaacgcgtccggtcgacgcaccgcgcacgcgcctgcttaccagttataaaacgcttttcggtaacagcggttttaactgttatttgctgatgctgattggcggtctggccgggattgccgcctttgaagcctgctccggcgtgctgatgggcgcggtgttagggctgagcagtatgacggtcagtattttgtttattctgccgattccggcggcattttttggcgcatggtttgccggacgtcccaataaacgcttctcaacgttgatgtggcagtcggttatctgttgcctgctggctggcttgctgatgtggatccccgactggtttggcgtgatgaatgtctggacgctgctcattcccgccgcgctgttctttttcggtgccgggatgctgtttccactggctaccagcggcgcgatggagccgttccccttcctggcgggcaccgctggcgcgctggtcggcggtctgcaaaacattggttccggcgtgctggcgtcgctctctgcgatgttgccgcaaaccggtcagggcagcctgggattgttgatgaccttaatgggattgttgatcgtgctgtgctggctaccgctggcgacgcggatgtcgcatcaggggcagcctgtttaa

SEQ ID NO: 8524 - protein, 396 aa, Escherichia coli
MIMKRHRNVNLLLMLVLLVAVGQMAQTIYIPAIADMARDLNVREGAVQSVMGAYLLTYGVSQLFYGPISDRVGRRPVILVGMSIFMLATLVAVTTSSLMVLIAASAMQGMGTGVGGVMARTLPRDLYERTQLRHANSLLNMGILVSPLLAPLIGGLLDTMWNWRACYLFLLVLCAGVTFSMARWMPETRPVDAPRTRLLTSYKTLFGNSGFNCYLLMLIGGLAGIAAFEACSGVLMGAVLGLSSMTVSILFILPIPAAFFGAWFAGRPNKRFSTLMWQSVICCLLAGLLMWIPDWFGVMNVWTLLIPAALFFFGAGMLFPLATSGAMEPFPFLAGTAGALVGGLQNIGSGVLASLSAMLPQTGQGSLGLLMTLMGLLIVLCWLPLATRMSHQGQPV

SEQ ID NO: 8525 - DNA, 498 bp, Escherichia coli
atgacaggaagtcaggtcattgatgctgaagaggacaggcataaactggttgtagagtataaggatgctctgcaacctgccgatttttatcacaatttcaaacagctgggcatccgctcagtacagcttattccccatcttgaatttgatgaccggggcgatctgacggccgcttcggtgacagcagagctgtgggggaaatttttaattgccctgttcgagtgttgggtgcgggcagatatcagtcgtatttcgattgaactttttgacaccaccttacaaaaatggtgtggcagcgaaaagtcgcaaccgcgccgtgactgccaggcgtgcgactggcatcggctgtgcccgcacgctcgggaagataaaccagacaacgtgctttgtgcgggctatcaggcgttttattcttactccgcgccgcatatgcgggtgatgcgtgatctgataaagcagcatcgttctcccatggagctgatgacgatgctgcggtga

SEQ ID NO: 8526 - protein, 165 aa, Escherichia coli
MTGSQVIDAEEDRHKLVVEYKDALQPADFYHNFKQLGIRSVQLIPHLEFDDRGDLTAASVTAELWGKFLIALFECWVRADISRISIELFDTTLQKWCGSEKSQPRRDCQACDWHRLCPHAREDKPDNVLCAGYQAFYSYSAPHMRVMRDLIKQHRSPMELMTMLR

SEQ ID NO: 8527 - DNA, 363 bp, Escherichia coli
atgccggatagccgcaaagccagacgcattgccgacccagggctgcagccggaacgcacatcactggcgtggtttcgtactatgctgggctacggcgcgttgatggcgttggctgtcaaacacaactggcaccaggcgggcatgttattctggatttcgattggcatcctcgccatcgtggcgctgatcctctggcactacacccgtaatcgcaatttaatggatgtcacgaatagcgatttttcccaatttcacgtagtccgtgacaaatttttgatctccctcgcggtgttatctctcgcaatactgtttgctgtaacgcatatacatcaacttatcgtatttattgagagagtcgcatga

SEQ ID NO: 8528 - protein, 120 aa, Escherichia coli
MPDSRKARRIADPGLQPERTSLAWFRTMLGYGALMALAVKHNWHQAGMLFWISIGILAIVALILWHYTRNRNLMDVTNSDFSQFHVVRDKFLISLAVLSLAILFAVTHIHQLIVFIERVA

SEQ ID NO: 8529 - DNA, 348 bp, Escherichia coli
atgaaaatttcccgcctcggagaagcgcccgattaccgcttctcgctggctaatgagcgtacttttctggcgtggatccgtactgcactaggatttctggcggcgggggttgggcttgatcaacttgcgccagatttcgccacgcccgtcatccgcgaactgctggcgttgttgttgtgtctgttttccggcgggttagcgatgtatggctacttgcgctggttacgcaatgaaaaagcgatgcgcctgaaagaggacctgccctataccaacagcttattaatcatcagtttaatattgatggtcgtggcagtgatcgtcatgggactggtgttgtatgccggatag

SEQ ID NO: 8530 - protein, 115 aa, Escherichia coli
MKISRLGEAPDYRFSLANERTFLAWIRTALGFLAAGVGLDQLAPDFATPVIRELLALLLCLFSGGLAMYGYLRWLRNEKAMRLKEDLPYTNSLLIISLILMVVAVIVMGLVLYAG

SEQ ID NO: 8531 - DNA, 408 bp, Escherichia coli
gtggaatttaatcgctacgagattgagcatgacagctttggcggttttattccggtgcgttgctgggtaacggatgactttaaactggtgctcaacctcttcaccagtgatgaactttacgatcgccgtaatgacccaaatgaaatgcataacctgatcgatgatatccattttgccgacgttcgcagcaaaatgcatgacgccttattggattacatggacaaaattcgcgatccgttccgcagttatcaatggaacctgcgtccgtggcgcaaagatgcacaaccgcgctggatgggggcgtttcgtccacgcccacaggatggttattctccagtggtacgcgactatgacaccggtttaccgacacaaggggtgaaggtggaagagaaaaaacagaagttctga

SEQ ID NO: 8532 - protein, 135 aa, Escherichia coli
MEFNRYEIEHDSFGGFIPVRCWVTDDFKLVLNLFTSDELYDRRNDPNEMHNLIDDIHFADVRSKMHDALLDYMDKIRDPFRSYQWNLRPWRKDAQPRWMGAFRPRPQDGYSPVVRDYDTGLPTQGVKVEEKKQKF

SEQ ID NO: 8533 - DNA, 1065 bp, Escherichia coli
atgaaacgccccaattttctgttcatcatgaccgatacccaggccaccaatatggtcggttgctatagcggtaagccgctgaatacgcaaaatattgatagtctggcggcagaaggtattcgctttaattctgcctacacctgttcaccggtttgtacacctgcacgggccggactattcaccggtatctacgctaaccagtccggcccgtggaccaacaacgtcgcgccgggcaaaaacatttccaccatggggcgctactttaaggatgcgggctatcacacctgctacatcggcaaatggcatctcgatggacatgactatttcggcactggcgagtgtccgccggagtgggacgctgattactggttcgatggcgcgaactatcttagtgaactgacggagaaagagattagcctgtggcgcaatggcctaaacagcgttgaggatttacaggcgaaccatattgacgaaaccttcacctgggcgcaccgcatcagcaatcgggcggtggattttctgcaacagcccgcgcgcgccgacgaacctttcctgatggtgatttcgtatgatgagccgcatcacccgttcacctgtccggtggagtatttagagaaatacactgatttttactacgaactgggtgagaaagcagaggatgacctggcgaacaaaccggaacatcaccgcttatgggcgcaggcgatgccatcgccagtcggtgatgacgggctttatcaccatccgctctattttgcctgcaatgactttgttgatgaccaaatcggacgggtcatcaacgccttaacgccagagcaacgtgaaaatacgtgggttatttatacctccgatcacggcgaaatgatgggcgcacataagctgatcagtaaaggagcggcgatgtatgacgacatcacccgcattccgctgatcatccgttcgccgcaaggggagcggcgacaggtcgatacgccagtcagtcatattgacttactgccgacaatgatggcgctggcagatattgaaaaaccagagattctgccgggggaaatatccttgccgtaa

SEQ ID NO: 8534 - protein, 354 aa, Escherichia coli
MKRPNFLFIMTDTQATNMVGCYSGKPLNTQNIDSLAAEGIRFNSAYTCSPVCTPARAGLFTGIYANQSGPWTNNVAPGKNISTMGRYFKDAGYHTCYIGKWHLDGHDYFGTGECPPEWDADYWFDGANYLSELTEKEISLWRNGLNSVEDLQANHIDETFTWAHRISNRAVDFLQQPARADEPFLMVISYDEPHHPFTCPVEYLEKYTDFYYELGEKAEDDLANKPEHHRLWAQAMPSPVGDDGLYHHPLYFACNDFVDDQIGRVINALTPEQRENTWVIYTSDHGEMMGAHKLISKGAAMYDDITRIPLIIRSPQGERRQVDTPVSHIDLLPTMMALADIEKPEILPGEISLP

SEQ ID NO: 8535 - DNA, 1716 bp, Escherichia coli
atgaattcgttacaaatcttgagttttgtcggttttacgctgctggtagcggtcatcacctggtggaaggtccgtaaaacagataccggatcgcaacaaggctattttcttgccggacgttcactaaaagcgccggttattgccgcttcgttaatgctaaccaacctttccacggagcaactggtcggcctttccgggcaggcctacaaaagtggcatgtcggtgatgggctgggaagtcacctctgcagtgacgctgatcttcctcgcgctaatctttttaccgcgctatctgaagcgcggcattgccaccatccccgattttctggaggaacgttatgataaaacgacgcgtattatcatcgacttctgcttcctcattgccaccggcgtctgctttctgccgattgttctctattccggcgcgttggcgctcaacagcctgtttcatgtgggtgagtcgctacaactttccgatggtgcggctatctggttactggtgattttgcttggtctggcgggaattttgtatgcggtgatcggcggactgcgcgcaatggcagtggcggactccattaacggtattgggctggttattggcgggttgatggtgccggtatttggcctgatcgcgatgggcaagggcagctttatgcagggcattgagcaactcaccaccgttcacgccgagaaattaaactcagtcggcggcccgaccgatcccttgccgattggcgcggcatttaccggtttgattctggtgaacaccttttactggtgtacaaatcagggcatcgtgcaacgcacgctggcgtcaaaaagcctggcggaagggcaaaagggggcgctgttaacggcggtgctgaaaatgctcgacccgctggtactggtgctgccagggttgattgcgtttcatctgtatcaggatttaccgaaagccgacatggcctacccgacgctggtcaataacgttctgccggtgccactggtgggcttcttcggtgcggtgttatgtggtgcggtgatcagtaccttcaacggctttctgaatagcgccagtacgttattcagtatgggtatttaccggcgcatcattaaccagaatgccgagccgcaacagctggtcaccgtcgggcgcaaatttggtttctttatcgccgtcgtttcggtgatggtcgcgccgtggatcgccaacgcgccgcaggggctgtatagctggatgaaacagctcaacggtatttacaacgtgccgctggttaccatcatcattatgggctttttcttcccgcgcattccggcgctggcggcaaaagtggcgatggggattggcataatcagctacatcaccatcaactatctggtgaagttcgacttccatttcctctatgtgctggcctgtacgttctgcatcaacgtggtcgtgatgctggtgatcggttttatcaaaccgcgcgccacgccgttcaccttcaaagatgcgtttgcggtggacatgaaaccgtggaaaaacgtcaagattgcgtcaattggtatcctgttcgcgatgattggcgtctatgccgggctggctgaattcggtggctacggtacgcgctggttagcgatgatcagttatttcatcgccgccgtagtgattgtctacctgatttttgacagctggcggcatcgtcacgacccagccgtcacctttactcccgatgcgaaggatagcctatga

SEQ ID NO: 8536 - protein, 571 aa, Escherichia coli
MNSLQILSFVGFTLLVAVITWWKVRKTDTGSQQGYFLAGRSLKAPVIAASLMLTNLSTEQLVGLSGQAYKSGMSVMGWEVTSAVTLIFLALIFLPRYLKRGIATIPDFLEERYDKTTRIIIDFCFLIATGVCFLPIVLYSGALALNSLFHVGESLQLSDGAAIWLLVILLGLAGILYAVIGGLRAMAVADSINGIGLVIGGLMVPVFGLIAMGKGSFMQGIEQLTTVHAEKLNSVGGPTDPLPIGAAFTGLILVNTFYWCTNQGIVQRTLASKSLAEGQKGALLTAVLKMLDPLVLVLPGLIAFHLYQDLPKADMAYPTLVNNVLPVPLVGFFGAVLCGAVISTFNGFLNSASTLFSMGIYRRIINQNAEPQQLVTVGRKFGFFIAVVSVMVAPWIANAPQGLYSWMKQLNGIYNVPLVTIIIMGFFFPRIPALAAKVAMGIGIISYITINYLVKFDFHFLYVLACTFCINVVVMLVIGFIKPRATPFTFKDAFAVDMKPWKNVKIASIGILFAMIGVYAGLAEFGGYGTRWLAMISYFIAAVVIVYLIFDSWRHRHDPAVTFTPDAKDSL

SEQ ID NO: 8537 - DNA, 867 bp, Escherichia coli
atgaatggaaaattgcaaagttcggatgtaaaaaacgaaactccgtacaatattcccttattgattaacgaaaatgtgatctccagcggaatttctctgatatcgctctggcatacctacgccgacgagcattatcgggtgatctggccgcgggacaagaagaaaccgcttatcgccaactcatgggttgcggtgtataccgtacaaggatgtgggaaaattcttttaaagaatgacgaacaaataactctgcatggcaactgtattatatttttaaagccaatggatattcactcttatcactgtgaaggtttggtctgggaacagtactggatggaatttacccccaccagtatgatggatattcccgtcggtcagcaaagcgttatttataatggcgaagtttataatcaggaactcaccgaagttgctgagttaattacttcaccagaagcaataaaaaataatctggcagtcgcttttctgacgaaaattatttatcagtggatttgtcttatgcacacagtcggtaaaaaagatccacaacggcggcaaattgaaaaattaattgccactttacatgccaatctacaacaacgctggagcgtagctgatatggctgccacgatcccctgtagcgaggcctggttgcgtcgtctgtttttacgctataccggcaagacgccgaaagaatattacctcgatgcgcgtctggatctggcgctatcgctattaaagcaacaagggaactcggttggcgaagtcgctgatacgctcaacttcttcgactcctttcatttcagcaaagcctttaagcataaatttggttatgcgccgtcagctgtgctgaagaatacggacaggtaa

SEQ ID NO: 8538 - protein, 288 aa, Escherichia coli
MNGKLQSSDVKNETPYNIPLLINENVISSGISLISLWHTYADEHYRVIWPRDKKKPLIANSWVAVYTVQGCGKILLKNDEQITLHGNCIIFLKPMDIHSYHCEGLVWEQYWMEFTPTSMMDIPVGQQSVIYNGEVYNQELTEVAELITSPEAIKNNLAVAFLTKIIYQWICLMHTVGKKDPQRRQIEKLIATLHANLQQRWSVADMAATIPCSEAWLRRLFLRYTGKTPKEYYLDARLDLALSLLKQQGNSVGEVADTLNFFDSFHFSKAFKHKFGYAPSAVLKNTDR

SEQ ID NO: 8539 - DNA, 1662 bp, Escherichia coli
atgagtgatatagcattaacggtcagtattctggctttggtggcggtcgtcgggttgtttatcggcaacgtcaagtttcgcggtgttggattgggcattggcggcgtgctgttcggtgggatcatcgtcggccattttgtttctcaggcggggatgacattaagtagcgatatgctgcatgttattcaggagtttggcctgatcctgttcgtttataccatcgggattcaggtagggccgggcttctttgcctcattgcgcgtctccggattacgcctcaacctgtttgctgttctgatcgtcatcatcggtggtctggttaccgccatcctgcataaactgtttgatattccactgccggtagtgctggggattttttccggcgcggtcaccaatacgccagcgctgggggcagggcagcagatcttgcgcgacctggggacaccgatggcgatggtcgatcaaatggggatgagctatgcgatggcgtatccatttgggatttgcggcattttgttcactatgtggatgctgcgggttattttccgcgtcaatgttgagactgaggcccagcagcacgagtccacgcgaaccaacggcggtgcgctaatcaggacgattaacatccgagttgagaatcctaatttgcataatttagccattaaagatgtgccgattctcaatggcgataaagttatttgctcacgattgaaacgagaagaaaccctaaaagtgccttcgccagaaaccgttattcaactgggcgatttgctgcatctggtggggcagcctgcggatttacataatgcgcaactggtgattggtcaggaggtcgatacctcgctgtctacgaaaggcactgatttgcgcgtcgcgcgtgtggtggtcaccaatgaaaacgtgctcggtaaacgtattcgcgacctgcactttaaagaacgctatgacgttgttatctcgcgcctgaaccgtgctggtgttgaattagttgcaagtagcgatatcagcctgcagttcggcgatatcctcaacctggtggggcgtccgtccgcaattgatgccgttgccaatgtgctggggaatgcgcagcaaaaactgcaacaggttcagatgctgccagtgtttattggtatcgggcttggcgtattgttaggttctattcccgtctttgtgcctgggttcccggcggcgttgaaactcgggctggcgggcggtccgctgattatggcgttgatcctcgggcgtatcggcagtatcggcaagctgtactggtttatgccaccaagcgctaacctggcgctacgcgagttaggcattgtgctctttctctcggtggttggcctgaaatccggcggcgattttatccatacactggtggatggcgaagggctaagctggattggttatggtgccctgatcaccgccgttccgctgattactgttggcattctggcgcggatgttagccaaaatgaattacctgaccatgtgcgggatgctggcaggttccatgaccgatcctccggcgctggcgtttgctaataatcttcatccaaccagcggtgcggcggcgctctcttacgccactgtctatccgttagtgatgttcctgcgcattatcacaccccaattactggcggtgctcttctggagtatcggttaa

SEQ ID NO: 8540 - protein, 553 aa, Escherichia coli
MSDIALTVSILALVAVVGLFIGNVKFRGVGLGIGGVLFGGIIVGHFVSQAGMTLSSDMLHVIQEFGLILFVYTIGIQVGPGFFASLRVSGLRLNLFAVLIVIIGGLVTAILHKLFDIPLPVVLGIFSGAVTNTPALGAGQQILRDLGTPMAMVDQMGMSYAMAYPFGICGILFTMWMLRVIFRVNVETEAQQHESTRTNGGALIRTINIRVENPNLHNLAIKDVPILNGDKVICSRLKREETLKVPSPETVIQLGDLLHLVGQPADLHNAQLVIGQEVDTSLSTKGTDLRVARVVVTNENVLGKRIRDLHFKERYDVVISRLNRAGVELVASSDISLQFGDILNLVGRPSAIDAVANVLGNAQQKLQQVQMLPVFIGIGLGVLLGSIPVFVPGFPAALKLGLAGGPLIMALILGRIGSIGKLYWFMPPSANLALRELGIVLFLSVVGLKSGGDFIHTLVDGEGLSWIGYGALITAVPLITVGILARMLAKMNYLTMCGMLAGSMTDPPALAFANNLHPTSGAAALSYATVYPLVMFLRIITPQLLAVLFWSIG

SEQ ID NO: 8541 - DNA, 429 bp, Escherichia coli
atgcgtaacttcgatttatccccactgatgcgtcaatggatcggttttgacaaactggccaacgcactgcaaaacgccggtgaaagccagagcttcccgccgtacaacattgagaaaagcgacgataaccactaccgcattacccttgcgctggcaggtttccgtcaggaagatttagagattcaactggaaggtacgcgcctgagcgtaaaaggcacgccagagcagccaaaagaagagaaaaaatggctgcatcaagggcttatgaatcagccttttagcctgagctttacgctggctgaaaatatggaagtctctggcgcaaccttcgtaaacggtttactgcatattgatttaattcgtaatgagcctgaacccatcgcagcgcagcgtatcgctatcagcgaacgtcccgcgttaaatagctaa

SEQ ID NO: 8542 - protein, 142 aa, Escherichia coli
MRNFDLSPLMRQWIGFDKLANALQNAGESQSFPPYNIEKSDDNHYRITLALAGFRQEDLEIQLEGTRLSVKGTPEQPKEEKKWLHQGLMNQPFSLSFTLAENMEVSGATFVNGLLHIDLIRNEPEPIAAQRIAISERPALNS

SEQ ID NO: 8543 - DNA, 414 bp, Escherichia coli
atgcgtaactttgatttatccccgctttaccgttctgctattggatttgaccgtttgtttaaccacttagaaaacaaccagagccagagtaatggcggctaccctccgtataacgttgaactggtagacgaaaaccattatcgcattgctatcgctgtggctggttttgctgagagcgaactggaaattaccgcccaggataatctgctggtggtgaaaggtgctcacgccgacgaacaaaaagagcgcacctatctgtaccagggcatcgctgaacgcaactttgaacgtaaattccagttagctgagaacattcatgttcgtggtgctaacctggtgaatggtctgctgtatatcgatctcgaacgcgtgattccggaagcgaaaaaaccgcgccgtatcgaaatcaactaa

SEQ ID NO: 8544 - protein, 137 aa, Escherichia coli
MRNFDLSPLYRSAIGFDRLFNHLENNQSQSNGGYPPYNVELVDENHYRIAIAVAGFAESELEITAQDNLLVVKGAHADEQKERTYLYQGIAERNFERKFQLAENIHVRGANLVNGLLYIDLERVIPEAKKPRRIEIN

SEQ ID NO: 8545 - DNA, 93 bp, Escherichia coli
ttgatcgtgggtgttggcctgatgagttatagcgatcccttgctgaaaataacatcatcattacgtcgcactgtggcggctatcgcactttaa

SEQ ID NO: 8546 - protein, 30 aa, Escherichia coli
MIVGVGLMSYSDPLLKITSSLRRTVAAIAL

SEQ ID NO: 8547 - DNA, 408 bp, Escherichia coli
atgatgatgttattttcagcaagggatcgctataactcatcaggccaacacccacgatcaacagatgaatttattatgataagaaatgtgttgttagcgttcatgatatgcagcggaatgacattactcggaggatgctccagcgtgatgtcccataccggggggaaagaaggaacgtatcctggcacccgcgccagcgcaaccatgattggcgacgatgaaaccaactggggcacaaaatcgctggcgatactcgacatgccatttaccgcagtactggacacaatattactaccgtgggatgtgttccgcaaagacagctcagtgcgctcgcgcgttgaaaaaagcgaagccaacgcgcaagaaaccaataacgtcattccccccgccaaaatgcctgcaaactga

SEQ ID NO: 8548 - protein, 135 aa, Escherichia coli
MMMLFSARDRYNSSGQHPRSTDEFIMIRNVLLAFMICSGMTLLGGCSSVMSHTGGKEGTYPGTRASATMIGDDETNWGTKSLAILDMPFTAVLDTILLPWDVFRKDSSVRSRVEKSEANAQETNNVIPPAKMPAN

SEQ ID NO: 8549 - DNA, 1215 bp, Escherichia coli
atgaaacagataacctttgctcctcgtaatcacctgctcaccaataccaatacctggacgcccgacagccagtggctggtgtttgacgtgcggccttctggggcgtcgtttaccggcgagaccattgagcgtgtgaatatccataccggcgaggtcgaggttatctatcgcgcgtcacagggcgcatacgtcggcgtggtgaccgttcatccgaagtcagagaagtatgtcttcatccacggcccggaaaatcctgatgaaacatggtattacgactttcatcatcggcgcggagtgattgttgaaagcggcaaggtgagcaatctcgatgcaatggatattaccgcgccatatacgccaggagcgctacgtggcggcagccatgtacatgtctttagcccgaacggtgaaagggtgagctttacctacaacgaccatgtaatgcatgaactcgatccggcgctggatttgcgaaacgtcggtgttgctgcaccgtttggcccggtcaacgtacaaaagcagcatccgcgtgaatacagcggtagccactggtgcgtgctggtaagtaaaaccacgcccacgccacagcctggcagtgatgaaatcaatcgtgcttatgaagaaggatgggtaggaaatcacgcgctggcgtttattggcgacacactttcgccaaagggcgagaaagtgccggagctgtttattgtcgagttgccgaaagatgaagctggctggaaagcggcaggtgatgtgccgttaagtggaacggaaacaaccctgcctgcgccaccgcgtggtgtcgtgcagcgacgtttaacctttacgcaccatcgtatttacccgggcctggttaacattccgcgccactgggtgcgttgtaatcctcaaggaacacaaattgcgtttttaatgcgtgatgataacggcattgtgcaactgtggcttatctcgccacagggcggtgaaccacgccagttaacccataataaaacggatattcagtctgcatttaactggcatccatcaggcgaatggctgggatttgtgctggataatcggattgcttgtgcccatgcgcaaagcggcgaggttgagtatttaaccgaaaaccacgccaatccaccttctgcggacgccgtggttttctcgccggatggtcaatggttggcgtggatggaggacggtcagttgtggatcaccgaaactgaccgctag

SEQ ID NO: 8550 - protein, 404 aa, Escherichia coli
MKQITFAPRNHLLTNTNTWTPDSQWLVFDVRPSGASFTGETIERVNIHTGEVEVIYRASQGAYVGVVTVHPKSEKYVFIHGPENPDETWYYDFHHRRGVIVESGKVSNLDAMDITAPYTPGALRGGSHVHVFSPNGERVSFTYNDHVMHELDPALDLRNVGVAAPFGPVNVQKQHPREYSGSHWCVLVSKTTPTPQPGSDEINRAYEEGWVGNHALAFIGDTLSPKGEKVPELFIVELPKDEAGWKAAGDVPLSGTETTLPAPPRGVVQRRLTFTHHRIYPGLVNIPRHWVRCNPQGTQIAFLMRDDNGIVQLWLISPQGGEPRQLTHNKTDIQSAFNWHPSGEWLGFVLDNRIACAHAQSGEVEYLTENHANPPSADAVVFSPDGQWLAWMEDGQLWITETDR

SEQ ID NO: 8551 - DNA, 1293 bp, Escherichia coli
atggatattcccgttaatgcagcaaagccggggcgtcggcgttatctgacgctggtgatgatctttattacggtggtcatttgttatgttgaccgcgctaacctggccgtggcttctgcccatattcaggaagagtttggtattactaaagcgcaaatgggctatgtattttcggccttcgcctggctttatacgctatgtcagatccccggtggttggtttttagatcgcgtaggttcacgcgtgacttattttattgcgatatttggctggtcagtggcgacgttattccagggctttgccacgggcttaatgtcattaattggtctgcgcgcgataaccggtattttcgaagcgcccgcgttcccgaccaataaccggatggtaaccagttggttcccggaacatgaacgtgcttctgccgttggtttttatacgtctggtcagtttgtcggtctggcgtttctgactccgctgctgatctggattcaggagatgttgagctggcactgggtgttcattgtcaccggtggtatcggcattatctggtcgctgatttggtttaaggtttatcagccgccgcgtctgaccaaaggcatcagcaaagctgaactggattacattcgtgatggcggcggtctggtggatggcgatgcgccggtgaagaaagaggcgcgtcagccgttaacagccaaagactggaaactggtgttccatcgtaaactgatcggtgtctatcttgggcaatttgcggtggcttctacactgtggtttttcttaacctggttcccgaactatttaacccaggaaaaaggaatcacagcgctgaaagcaggctttatgaccacggtgccattcctcgcggcgtttattggcgtcctgctctctggctgggtcgcggatctgctggtacgtaagggcttttcactgggctttgcgcgtaaaacgccgattatctgcggcttgctgatctccacctgcattatgggtgcgaactacaccaacgatccgatgatgattatgtgcctgatggcgctggcattcttcggcaacggttttgcttcgataacctggtcgctggtctcttctctggcaccgatgcgcctgattggtttaaccggcggtgtgtttaactttgccggtggtctgggcggcatcaccgttccgctggtggtggggtacctggcgcagggttacggtttcgcgcctgcactggtttatatctccgccgtcgcgttgattggcgcgctctcttacatcctgctggtgggcgatgtgaagcgcgttggataa

SEQ ID NO: 8552 - protein, 430 aa, Escherichia coli
MDIPVNAAKPGRRRYLTLVMIFITVVICYVDRANLAVASAHIQEEFGITKAQMGYVFSAFAWLYTLCQIPGGWFLDRVGSRVTYFIAIFGWSVATLFQGFATGLMSLIGLRAITGIFEAPAFPTNNRMVTSWFPEHERASAVGFYTSGQFVGLAFLTPLLIWIQEMLSWHWVFIVTGGIGIIWSLIWFKVYQPPRLTKGISKAELDYIRDGGGLVDGDAPVKKEARQPLTAKDWKLVFHRKLIGVYLGQFAVASTLWFFLTWFPNYLTQEKGITALKAGFMTTVPFLAAFIGVLLSGWVADLLVRKGFSLGFARKTPIICGLLISTCIMGANYTNDPMMIMCLMALAFFGNGFASITWSLVSSLAPMRLIGLTGGVFNFAGGLGGITVPLVVGYLAQGYGFAPALVYISAVALIGALSYILLVGDVKRVG

SEQ ID NO: 8553 - DNA, 1026 bp, Escherichia coli
atgcaggtgatcgcgctggataaaaagcaccagcatggtactgaaggtttcagcaaaccttgtggcggtctgctggcaccggacgcgcagcgatcttttattcgcgatggattgacgcttcctgtcgatgtcatcgccaacccgcagattttcagcgtcaaaaccgtcgacgtcgccgcatcgctcacgcgtaactaccagcgaagctatatcaatattaatcgccatgctttcgacttgtggatgaaatcgctgatccccgccagcgttgaggtttaccacgacagcctgtgtcgaaaaatctggcgtgaggatgataaatggcatgtcatttttcgcgcagacggctgggagcagcatattaccgcccgctatctggtcggtgccgatggtgccaactcgatggtgcggcgacatctctacccggatcatcagattcgtaaatatgtcgccatccagcagtggttcgcagagaaacatccggtgccgttctactcctgcatctttgataatgcgataactgactgttactcatggagtatcagcaaagacggttattttatctttggcggtgcctatccgatgaaagacggtcagacgcgtttcacgacgctaaaagagaaaatgagcgcctttcagttccagtttggtaaggcggtgaaaagcgaaaaatgcacggtgctgtttccctcacgctggcaggattttgtctgcggcaaggacaacgcctttctgattggcgaagcggcgggatttatcagcgccagctcgctggaggggattagctatgcgctggatagcgcagagattctgcgttcggtattactgaagctgccagagaagctcaataccgcttactggcgcgccactcgcaaactgcgtttaaaactcttcggcaagatagtaaaaagccgatgcctgaccgcaccggctttaagaaagtggattatgcgcagtggagtggcgcatattccacagttgaaagattatccaacgcgcttcacatcgcccaccagcaggatgtaa

SEQ ID NO: 8554 - protein, 341 aa, Escherichia coli
MQVIALDKKHQHGTEGFSKPCGGLLAPDAQRSFIRDGLTLPVDVIANPQIFSVKTVDVAASLTRNYQRSYININRHAFDLWMKSLIPASVEVYHDSLCRKIWREDDKWHVIFRADGWEQHITARYLVGADGANSMVRRHLYPDHQIRKYVAIQQWFAEKHPVPFYSCIFDNAITDCYSWSISKDGYFIFGGAYPMKDGQTRFTTLKEKMSAFQFQFGKAVKSEKCTVLFPSRWQDFVCGKDNAFLIGEAAGFISASSLEGISYALDSAEILRSVLLKLPEKLNTAYWRATRKLRLKLFGKIVKSRCLTAPALRKWIMRSGVAHIPQLKDYPTRFTSPTSRM

SEQ ID NO: 8555 - DNA, 1149 bp, Escherichia coli
atgaaaatcaccaaaattaccacgtatcgtttacctccccgctggatgttcctgaaaattgaaaccgatgaaggcgtggtcggttggggcgagcccgtgattgaaggccgcgctcgcacggtggaagcggcagtccacgagctgagtgactatttgattggtcaggacccgtcacgcatcaacgacttatggcaagtgatgtatcgcgccggattttatcgtggcggtccaatcctgatgagcgccatcgccgggatcgaccaggcgttatgggatatcaaaggcaaagtgctgaatgcgccggtctggcaactgatgggcggcctggttcgcgacaaaattaaagcctacagttgggtcggcggcgatcgtccggcggatgttatcgacggcattaaaacgctacgcgaaatcggcttcgataccttcaaactgaatggttgtgaagaactggggctaattgataactcccgcgcggtagatgcggcagtcaacaccgtggcgcaaattcgtgaagcctttggtaatcagattgagtttggtctggacttccatggtcgcgtcagcgcgccgatggcgaaagtgctgattaaagagctggaaccgtatcgtccgctgtttattgaagagccggtgctggcggaacaggccgaatactacccgaaactggcggcacaaacgcatattccactggcggcgggtgagcgcatgttctcacgcttcgattttaaacgtgtgctggaggcaggcggtatttcgattctgcaaccggatctctcccacgcaggcggtattaccgaatgctacaaaattgccggaatggcagaagcctatgacgtgacccttgcgccgcactgtccgctcggaccgattgcactggcggcttgcctgcatatcgactttgtttcctataacgccgtccttcaggaacaaagtatgggcattcattacaacaaaggcgcggagttactcgactttgtgaaaaacaaagaggacttcagcatggtcggcggtttctttaaaccattaacgaaaccgggcttaggcgtggaaatcgacgaagctaaagttattgagttcagtaaaaatgccccggactggcgtaatccgctctggcgtcatgaagataacagcgtagcagagtggtaa

SEQ ID NO: 8556 - protein, 382 aa, Escherichia coli
MKITKITTYRLPPRWMFLKIETDEGVVGWGEPVIEGRARTVEAAVHELSDYLIGQDPSRINDLWQVMYRAGFYRGGPILMSAIAGIDQALWDIKGKVLNAPVWQLMGGLVRDKIKAYSWVGGDRPADVIDGIKTLREIGFDTFKLNGCEELGLIDNSRAVDAAVNTVAQIREAFGNQIEFGLDFHGRVSAPMAKVLIKELEPYRPLFIEEPVLAEQAEYYPKLAAQTHIPLAAGERMFSRFDFKRVLEAGGISILQPDLSHAGGITECYKIAGMAEAYDVTLAPHCPLGPIALAACLHIDFVSYNAVLQEQSMGIHYNKGAELLDFVKNKEDFSMVGGFFKPLTKPGLGVEIDEAKVIEFSKNAPDWRNPLWRHEDNSVAEW

SEQ ID NO: 8557 - DNA, 618 bp, Escherichia coli
atgcagtggcaaactaaactcccgctgatcgccattttgcgcggcattacgcccgacgaggcactggcacatgttggcgcggtgattgacgccgggttcgacgcggttgaaatcccgctgaattctccacaatgggagcagagcattcccgccatcgttgatgcgtacggcgataaggcgttgattggcgcaggtacggtactgaaacctgaacaggtcgatgcgctcgccagaatgggctgtcagctcatcgttacgcccaatatccatagtgaagtgatccgccgtgcggtgggctacggcatgaccgtctgccccggctgtgcgacggcgaccgaagcctttaccgcgctcgaagcgggcgcgcaggcgctgaaaatattcccgtcatcggcttttggtccgcaatacatcaaagcattaaaagcggtattaccaccggacatcgcggtctttgccgttggcggtgtgacgccagaaaacctggcgcagtggatagatgcaggctgtgccggagcgggcttaggtagcgatctctatcgcgccgggcagtccgtagaacggactgcgcagcaggcagcagcatttgttaaggcgtatcgagaggcagtgcaatga

SEQ ID NO: 8558 - protein, 205 aa, Escherichia coli
MQWQTKLPLIAILRGITPDEALAHVGAVIDAGFDAVEIPLNSPQWEQSIPAIVDAYGDKALIGAGTVLKPEQVDALARMGCQLIVTPNIHSEVIRRAVGYGMTVCPGCATATEAFTALEAGAQALKIFPSSAFGPQYIKALKAVLPPDIAVFAVGGVTPENLAQWIDAGCAGAGLGSDLYRAGQSVERTAQQAAAFVKAYREAVQ

SEQ ID NO: 8559 - DNA, 879 bp, Escherichia coli
atgacagctcgctacatcgcaattgactggggatcgaccaatctgcgcgcctggctttatcagggcgaccactgcctggacagcaggcaatcagaagcaggcgtcacgcgcctgaacggaaaatctccggctgcggtgttagcagaagtgacgaccgactggcgtgaagagaatacgccagtggtaatggcaggaatggtcggcagcaatgtcggctggaaagttgcgccatatttatccgttccagcccgtttctcgtctattggcgaacaattaacatctgctggcgacaatatctggattattcccggattatgcgtctctcatgacgataaccacaatgtgatgcgcggcgaagaaacacaattgatcggcgcgcgcactctcgctccttcctctctttatgtcatgcccggtacgcattgcaaatgggtgcaggccgatagccagcaaattaacgattttcgcaccgtgatgaccggtgaattacatcatttactgttaaatcactcattgattggcgcaggtttgccgccgcaggaaaacgctgccgatgctttcgcggctggtcttgagcgtggccttaatgctcccgacatattgccgcagctttttgaagttcgcgcctcgcatgtgctgggaacacttccccgcgaacaggtcagcgaatttctctctggtttgttgattggcgcagaggtcgccagtatgcgcgactatgtgacccatcaacaagtcatcacccttgtcgccggaacatcgctgaccgtgcgctaccagcaagcctttcaggcgatgggttgcgacgtgacggcggtggcaggcgacacggcatttcaggctggtataaggagcatcgctcatgcagtggcaaactaa

SEQ ID NO: 8560 - protein, 292 aa, Escherichia coli
MTARYIAIDWGSTNLRAWLYQGDHCLDSRQSEAGVTRLNGKSPAAVLAEVTTDWREENTPVVMAGMVGSNVGWKVAPYLSVPARFSSIGEQLTSAGDNIWIIPGLCVSHDDNHNVMRGEETQLIGARTLAPSSLYVMPGTHCKWVQADSQQINDFRTVMTGELHHLLLNHSLIGAGLPPQENAADAFAAGLERGLNAPDILPQLFEVRASHVLGTLPREQVSEFLSGLLIGAEVASMRDYVTHQQVITLVAGTSLTVRYQQAFQAMGCDVTAVAGDTAFQAGIRSIAHAVAN

SEQ ID NO: 8561 - DNA, 690 bp, Escherichia coli
atgactctcaataaaaccgatcgcatcgttattacgctgggtaaacagatcgttcacggcaaatacgtgccaggctcgccgcttccggctgaggcagaactctgtgaggagtttgcaacctcgcgcaacatcatccgtgaggtatttcgttcgctgatggcgaagcggctgattgaaatgaaacgttatcgcggggcgtttgtggctccgcgtaaccagtggaattacctcgacactgacgtactgcaatgggtgctggaaaacgactacgacccacggcttatcagtgcaatgagcgaagtgcgaaatctggtggaaccggcgattgcccgttgggcagcagaacgcgcgacctccagcgatctggcgcagattgaatcggcgctgaacgagatgattgctaacaatcaggaccgcgaagcgtttaacgaagcggatattcgctaccacgaggcggtgctgcagtcggtgcataacccggtgttacagcaactgagcattgcgatcagttcgctgcagcgggcggtttttgaacgaacctggatgggcgatgaggccaacatgccgcaaacgctccaggaacataaggcgctgttcgatgcgataaggcatcaggacggcgatgcggcagagcaggcggcgcttaccatgatcgccagctcgacacgaaggttaaaggaaatcacatga

SEQ ID NO: 8562 - protein, 229 aa, Escherichia coli
MTLNKTDRIVITLGKQIVHGKYVPGSPLPAEAELCEEFATSRNIIREVFRSLMAKRLIEMKRYRGAFVAPRNQWNYLDTDVLQWVLENDYDPRLISAMSEVRNLVEPAIARWAAERATSSDLAQIESALNEMIANNQDREAFNEADIRYHEAVLQSVHNPVLQQLSIAISSLQRAVFERTWMGDEANMPQTLQEHKALFDAIRHQDGDAAEQAALTMIASSTRRLKEIT

SEQ ID NO: 8563 - DNA, 657 bp, Escherichia coli
atgaagttgaatcttaagggatttttcaaggctgccagtttgtgttctttggcatttgcgttgaccggatgtatcacctggggattggtttccaatactgcaagccgtccacatgccgagcaatggcggtcagacacgattaagggtttatcgctggcagaagatagtaacggtacgaaaggctatgtttttgttggtgaatcgttggactatctgttgaccaccggcggcgatgaggtggttaaaatgctgaacgatccggcaatccatggtgaaagaatcaccgtttctgataacgcgaaatttattttaagcagcagtaataagaatttctctggtgctattacgctctattacgactggaacaacgaagaagataaggcactggcaacacaatatggttttatttgtgatacccggcgttgtacatggatgctggacggtttgaaaggctcaatccaccagaaaaataaaaaagcggattactcaaacgtgatggttttccatcaaccctttacggtgggattttatgagtacaaagcaacagatggcgtcccgcacggcctcgttaatgcgctgctgccagtcactcttacgctggatatagtaacgtcaccactccagttcctgattttatgcacgaccagaaattgttaa

SEQ ID NO: 8564 - protein, 218 aa, Escherichia coli
MKLNLKGFFKAASLCSLAFALTGCITWGLVSNTASRPHAEQWRSDTIKGLSLAEDSNGTKGYVFVGESLDYLLTTGGDEVVKMLNDPAIHGERITVSDNAKFILSSSNKNFSGAITLYYDWNNEEDKALATQYGFICDTRRCTWMLDGLKGSIHQKNKKADYSNVMVFHQPFTVGFYEYKATDGVPHGLVNALLPVTLTLDIVTSPLQFLILCTTRNC

SEQ ID NO: 8565 - DNA, 813 bp, Escherichia coli
atggctatcaaactcattgctatcgatatggatggcacccttctgctgcccgatcacaccatttcacctgccgttaaaaatgcgattgccgcagctcgcgcccgtggcgtgaatgtcgtgctaacgacgggtcgcccttatgcaggtgttcacaattacctgaaagagctgcatatggaacagccgggcgactactgcattacttataacggcgcgctggtacagaaggccgctgatggtagcaccgtggcgcaaaccgctctcagctatgacgactaccgtttcctggaaaaactctctcgcgaagtcggttctcatttccacgcgctggaccgcaccacgctgtacaccgccaatcgtgatatcagctactacacggtgcatgaatctttcgttgccaccattccgctggtgttctgcgaagcggagaaaatggaccccaatacccagttcctgaaagtgatgatgattgatgaacccgccatcctcgaccaggccattgcgcgtattccgcaggaagtgaaagaaaaatacaccgtgctgaaaagtgcgccgtacttcctcgaaatcctcgataaacgcgttaacaaaggtacgggtgtgaaatcactggccgacgtgttaggtattaaaccggaagaaatcatggcgattggcgatcaggaaaacgacatcgcaatgattgaatatgcaggcgtcggtgtggcgatggataacgctattccttcggtgaaagaagtggcgaactttgtcaccaaatctaaccttgaagatggcgtggcatttgctattgagaagtatgtgctgaattaa

SEQ ID NO: 8566 - protein, 270 aa, Escherichia coli
MAIKLIAIDMDGTLLLPDHTISPAVKNAIAAARARGVNVVLTTGRPYAGVHNYLKELHMEQPGDYCITYNGALVQKAADGSTVAQTALSYDDYRFLEKLSREVGSHFHALDRTTLYTANRDISYYTVHESFVATIPLVFCEAEKMDPNTQFLKVMMIDEPAILDQAIARIPQEVKEKYTVLKSAPYFLEILDKRVNKGTGVKSLADVLGIKPEEIMAIGDQENDIAMIEYAGVGVAMDNAIPSVKEVANFVTKSNLEDGVAFAIEKYVLN

SEQ ID NO: 8567 - DNA, 399 bp, Escherichia coli
atggggctttttgatgacgttgtcggtgcctttctgaaaggcgatgcggggaaatatcaggccattttgagctgggttgaggaacagggcggcattcaagtgctgttggaaaaactgcaaagtggcggcttaggggccattctctcaacctggctgagtaatcaacagagcaatcaatcagttagcggcgagcaagtggaatcggcgctcggcacaaatgcggtgtccgatctcgggcaaaaacttggcgtggataccagtacagcttccagtttactggcagaacaattgccgaagattattgatgcgctctcaccgcaaggtgaagtgtcaccacaagcccataacgatctgctttccgcaggcatggaactgctgaaagggaaacttttccgctaa

SEQ ID NO: 8568 - protein, 132 aa, Escherichia coli
MGLFDDVVGAFLKGDAGKYQAILSWVEEQGGIQVLLEKLQSGGLGAILSTWLSNQQSNQSVSGEQVESALGTNAVSDLGQKLGVDTSTASSLLAEQLPKIIDALSPQGEVSPQAHNDLLSAGMELLKGKLFR

SEQ ID NO: 8569 - DNA, 2415 bp, Escherichia coli
atgtcgaattcttatgactcctccagtatcaaagtcctgaaagggctggatgcggtgcgtaagcgcccgggtatgtatatcggcgacacggatgacggcaccggtctgcaccacatggtattcgaggtggtagataacgctatcgacgaagcgctcgcgggtcactgtaaagaaattatcgtcaccattcacgccgataactctgtctccgtacaggatgatgggcgcggcattccgaccggtattcacccggaagagggcgtatcggcggcggaagtgatcatgaccgttctgcacgcaggcggtaaatttgacgataactcctataaagtgtccggcggtctgcacggcgttggtgtttcggtagtaaacgccctgtcgcaaaaactggagctggttatccagcgcgagggtaaaattcaccgtcagatctacgaacacggtgtaccgcaggccccgctggcggttaccggcgagactgaaaaaaccggcactatggtgcgtttctggccaagccttgaaaccttcaccaatgtgaccgagttcgaatatgacattctggcgaaacgtctgcgtgagttgtcgttcctcaactccggcgtttccattcgtctgcgcgacaagcgcgacggcaaagaagaccacttccactatgaaggcggcatcaaggcgttcgttgaatatctgaacaagaacaaaacgccgatccacccgaatatcttctacttctccaccgaaaaagacggtattggcgtcgaagtggcgttgcagtggaacgatggcttccaggaaaacatctactgctttaccaacaacattccgcagcgtgacggcggtactcacctggcaggtttccgtgcggcgatgacccgtactctgaacgcctacatggacaaagaaggctacagcaaaaaagccaaagtcagcgccaccggtgacgatgcgcgtgaaggcctgattgcggtcgtttccgtgaaagtgccggacccgaaattctcctcacagaccaaagacaaactggtttcttctgaggtgaaatcggcggttgaacagcagatgaacgaactgctggcggaatacctgctggaaaacccaaccgacgcgaaaatcgtggtcggcaaaattatcgatgctgcccgtgcccgtgaagctgcgcgtcgcgcgcgtgaaatgacccgccgtaaaggtgcgctcgacttagctggcctgccgggcaaactggcagactgccaggaacgcgatccggcgctttccgaactgtaccttgtggaaggggactccgcgggcggctctgcgaagcaggggcgtaaccgcaagaaccaggcgattctgccgctgaagggtaaaatcctcaacgtcgagaaagcgcgcttcgataagatgctctcttctcaggaagtggcgacgcttatcaccgcgcttggttgtggtatcggtcgtgacgagtacaacccggacaaactgcgttatcacagcatcatcatcatgaccgatgcggacgtcgacggctcgcacattcgtacgctgctgttgaccttcttctatcgtcagatgccggaaatcgttgaacgtggtcacgtctacatcgctcagccgccgctgtacaaagtgaagaaaggtaagcaggaacagtacattaaagacgacgaagcgatggatcagtaccagatctctatcgcgctggatggcgcaacgctgcacaccaacgccagtgcaccggcgctggctggcgaagcgttagagaaactggtgtctgagtacaacgcgacgcagaaaatgatcaaccgcatggagcgtcgttatccgaaagcaatgctgaaagagcttatctatcagccgacgctgacggaagccgatctctctgatgagcagaccgttacccgctgggtgaacgcgctggtcagcgaactgaacgacaaagaacagcacggcagccagtggaagtttgatgtccataccaatgccgaacaaaacctgttcgagccgattgttcgcgtgcgtacccacggtgtggatactgactatccgctggatcacgaatttatcactggcggcgaatatcgtcgtatctgcacgctgggtgagaaactgcgtggcttgctggaagaagatgcatttatcgaacgtggcgaacgtcgtcagccggtagccagcttcgagcaggcgctggactggctggtgaaagagtcccgtcgcggcctctccatccagcgttataaaggtctgggcgagatgaacccggaacagctgtgggaaaccaccatggacccggaaagccgtcgtatgctgcgcgttaccgttaaagatgcgattgctgccgaccagttgttcactacgcttatgggcgacgccgttgaaccgcgccgtgcgtttattgaagagaacgctctgaaagcggcgaatatcgatatttaa

SEQ ID NO: 8570 - protein, 804 aa, Escherichia coli
MSNSYDSSSIKVLKGLDAVRKRPGMYIGDTDDGTGLHHMVFEVVDNAIDEALAGHCKEIIVTIHADNSVSVQDDGRGIPTGIHPEEGVSAAEVIMTVLHAGGKFDDNSYKVSGGLHGVGVSVVNALSQKLELVIQREGKIHRQIYEHGVPQAPLAVTGETEKTGTMVRFWPSLETFTNVTEFEYDILAKRLRELSFLNSGVSIRLRDKRDGKEDHFHYEGGIKAFVEYLNKNKTPIHPNIFYFSTEKDGIGVEVALQWNDGFQENIYCFTNNIPQRDGGTHLAGFRAAMTRTLNAYMDKEGYSKKAKVSATGDDAREGLIAVVSVKVPDPKFSSQTKDKLVSSEVKSAVEQQMNELLAEYLLENPTDAKIVVGKIIDAARAREAARRAREMTRRKGALDLAGLPGKLADCQERDPALSELYLVEGDSAGGSAKQGRNRKNQAILPLKGKILNVEKARFDKMLSSQEVATLITALGCGIGRDEYNPDKLRYHSIIIMTDADVDGSHIRTLLLTFFYRQMPEIVERGHVYIAQPPLYKVKKGKQEQYIKDDEAMDQYQISIALDGATLHTNASAPALAGEALEKLVSEYNATQKMINRMERRYPKAMLKELIYQPTLTEADLSDEQTVTRWVNALVSELNDKEQHGSQWKFDVHTNAEQNLFEPIVRVRTHGVDTDYPLDHEFITGGEYRRICTLGEKLRGLLEEDAFIERGERRQPVASFEQALDWLVKESRRGLSIQRYKGLGEMNPEQLWETTMDPESRRMLRVTVKDAIAADQLFTTLMGDAVEPRRAFIEENALKAANIDI

SEQ ID NO: 8571 - DNA, 1074 bp, Escherichia coli
atgtccctcacccgcttgttgatccgcgatttccgcaacattgaaaccgcggatctcgccttatctcccggctttaactttctggtaggtgccaacggcagtggcaaaaccagcgtgctggaagccatctatacgctcggccacggtcgggcgtttcgcagtttgcagattggtcgcgtcattcgccacgagcaggaggcgtttgttctccacgggcgattacagggcgaagagcgcgagacggcgattggtttaaccaaagacaaacaaggcgacagcaaagtccgtattgacggtacagacgggcataaagtcgcggagctggcgcacctgatgccaatgcagctgataacgccagaagggtttactttactcaacggcggccccaaatacagaagagcattcctcgactggggatgctttcacaacgaacccggatttttcaccgcctggagcaatctcaagcgattgctcaagcagcgcaatgcggcgctgcgccaggtgactcgttacgaacagctacgcccgtgggataaagaactgatcccgctggcggagcaaatcagcacctggcgcgcggagtatagcgccggtatcgcggctgatatggccgatacctgtaagcaatttctccctgagttttctctgactttctctttccagcgcggctgggagaaagagacagaatatgctgaggtgctggaacgtaattttgaacgcgatcgccagctaacctacaccgcgcatggcccgcataaagcggacttacgcattcgcgccgacggtgcgccggtggaagataccttatcgcgtgggcagcttaagctgctgatgtgcgccttacgtctggcgcaaggagagttcctcacccgtgaaagcgggcggcggtgtctctacctgatagatgattttgcctctgagcttgatgatgagcgtcgcgggctgcttgccagccgcttaaaagcgacgcaatcacaggtctttgtcagcgcgatcagtgctgaacacgttatagacatgtcggacgaaaattcgaagatgtttaccgtggaaaagggtaaaataacggattaa

SEQ ID NO: 8572 - protein, 357 aa, Escherichia coli
MSLTRLLIRDFRNIETADLALSPGFNFLVGANGSGKTSVLEAIYTLGHGRAFRSLQIGRVIRHEQEAFVLHGRLQGEERETAIGLTKDKQGDSKVRIDGTDGHKVAELAHLMPMQLITPEGFTLLNGGPKYRRAFLDWGCFHNEPGFFTAWSNLKRLLKQRNAALRQVTRYEQLRPWDKELIPLAEQISTWRAEYSAGIAADMADTCKQFLPEFSLTFSFQRGWEKETEYAEVLERNFERDRQLTYTAHGPHKADLRIRADGAPVEDTLSRGQLKLLMCALRLAQGEFLTRESGRRCLYLIDDFASELDDERRGLLASRLKATQSQVFVSAISAEHVIDMSDENSKMFTVEKGKITD

SEQ ID NO: 8573 - DNA, 966 bp, Escherichia coli
  n 948, 949, 950, 951, 952: n is any nucleotide
atgaaatttaccgtagaacgtgagcatttattaaaaccgctacaacaggtgagcggtccgttaggtggtcgtcctacgctaccgattctcggtaatctgctgttacaggttgctgacggtacgttgtcgctgaccggtactgatctcgagatggaaatggtggcacgcgttgcgctggttcagccgcacgaaccaggggcgacgaccgttccggcgcgcaaattctttgatatctgccgtggtctgcctgaaggcgcggaaattgccgtgcagctggaaggtgagcggatgctggtgcgctccgggcgtagccgtttttcgctgtctaccctgccagcggcagatttcccgaacctcgatgactggcagagcgaagtcgaatttaccctgccgcaggcgacgatgaagcgtctgattgaagcgacccagttttctatggcgcatcaggacgttcgctattacttaaacggtatgctgtttgaaaccgaaggtgaagaactgcgcaccgtggcgaccgacggccaccgtctggcagtctgttcaatgccaattggtcaatctttgccaagccattcggtgatcgtgccgcgtaaaggcgtgattgaactgatgcgtatgctcgacggcggcgacaatccgctgcgcgtgcagattggcagcaacaacattcgcgcccacgttggcgactttattttcacctcgaaactggtggatggtcgcttcccggattaccgtcgcgttctgccgaagaacccggacaaacatctggaagctggctgtgatctgctcaagcaggcgtttgctcgtgcggcaattctctctaacgagaaattccgcggcgtgcgtctgtatgtcagcgaaaaccagctgaaaatcaccgccaacaacccagaacaggaagaagcggaagagatcctcgacgttacctatagcggtgcggagatggannnnncattcattcattaa

SEQ ID NO: 8574 - protein, 321 aa, Escherichia coli
  Xaa 316, 317, 318: Xaa is any amino acid
MKFTVEREHLLKPLQQVSGPLGGRPTLPILGNLLLQVADGTLSLTGTDLEMEMVARVALVQPHEPGATTVPARKFFDICRGLPEGAEIAVQLEGERMLVRSGRSRFSLSTLPAADFPNLDDWQSEVEFTLPQATMKRLIEATQFSMAHQDVRYYLNGMLFETEGEELRTVATDGHRLAVCSMPIGQSLPSHSVIVPRKGVIELMRMLDGGDNPLRVQIGSNNIRAHVGDFIFTSKLVDGRFPDYRRVLPKNPDKHLEAGCDLLKQAFARAAILSNEKFRGVRLYVSENQLKITANNPEQEEAEEILDVTYSGAEMXXXFIH

SEQ ID NO: 8575 - DNA, 1404 bp, Escherichia coli
gtgtcactttcgctttggcagcagtgtcttgcccgattgcaggatgagttaccagccacagaattcagtatgtggatacgcccattgcaggcggaactgagcgataacacgctggccctgtacgcgccaaaccgttttgtcctcgattgggtacgggacaagtaccttaataatatcaatggactgctaaccagtttctgcggagcggatgccccacagctgcgttttgaagtcggcaccaaaccggtgacgcaaacgccacaagcggcagtgacgagcaacgtcgcggcccctgcacaggtggcgcaaacgcagccgcaacgtgctgcgccttctacgcgctcgggttgggataacgtcccggctccggcagaaccgacctatcgttctaacgtaaacgtcaaacacacgtttgataacttcgttgaaggtaaatctaaccaactggcgcgcgcggcggctcgccaggtggcagataaccctggcggtgcttataacccgttgttcctttatggcggcacgggtttgggtaaaactcacctgctgcatgcggtgggtaacggcattatggcgcgcaagccgaatgccaaagtggtttatatgcactccgagcgctttgttcaggacatggttaaagccctgcaaaacaacgcgatcgaagagtttaaacgctactaccgttccgtagatgcactgctgatcgacgatattcagttttttgctaataaagaacgatctcaggaagagtttttccacaccttcaacgccctgctggaaggtaatcaacagatcattctcacctccgatcgctatccgaaagagatcaacggcgttgaggatcgtttgaaatcccgcttcggctggggactgactgtggcgatcgaaccgccagagctggaaacccgcgtggcgatcctgatgaaaaaggccgacgaaaacgacattcgtttgccgggcgaagtggcgttctttatcgccaagcgtctacgatctaacgtacgtgagttggaaggcgcgctgaaccgcgtcattgccaacgccaactttaccggacgggcgatcaccatcgacttcgtgcgtgaggcgctgcgtgacttgctggcattgcaggaaaaactggtcaccatcgacaatattcagaagacggtggcggagtactacaagatcaaagtcgcggatctcctttccaagcgtcgatcccgctcggtggcccgtccgcgccagatggcgatggcgctggcgaaagagctgactaaccacagtcttccggagattggcgatgcctttggtggtcgtgaccacacgacggtgcttcatgcctgccggaagatcgagcagttgcgtgaagagagccacgatatcaaagaagatttttctaatttaatcagaacattgtcatcgtaa

SEQ ID NO: 8576 - protein, 467 aa, Escherichia coli
MSLSLWQQCLARLQDELPATEFSMWIRPLQAELSDNTLALYAPNRFVLDWVRDKYLNNINGLLTSFCGADAPQLRFEVGTKPVTQTPQAAVTSNVAAPAQVAQTQPQRAAPSTRSGWDNVPAPAEPTYRSNVNVKHTFDNFVEGKSNQLARAAARQVADNPGGAYNPLFLYGGTGLGKTHLLHAVGNGIMARKPNAKVVYMHSERFVQDMVKALQNNAIEEFKRYYRSVDALLIDDIQFFANKERSQEEFFHTFNALLEGNQQIILTSDRYPKEINGVEDRLKSRFGWGLTVAIEPPELETRVAILMKKADENDIRLPGEVAFFIAKRLRSNVRELEGALNRVIANANFTGRAITIDFVREALRDLLALQEKLVTIDNIQKTVAEYYKIKVADLLSKRRSRSVARPRQMAMALAKELTNHSLPEIGDAFGGRDHTTVLHACRKIEQLREESHDIKEDFSNLIRTLSS

SEQ ID NO: 8577 - DNA, 141 bp, Escherichia coli
atgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaa

SEQ ID NO: 8578 - protein, 46 aa, Escherichia coli [sequence omitted]

SEQ ID NO: 8579 - DNA, 327 bp, Escherichia coli
ttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctga

SEQ ID NO: 8580 - protein, 108 aa, Escherichia coli
MLTPSQFTFVFQQPQRAGTPQITILGRLNSLGHPRIGLTVAKKNVRRAHERNRIKRLTRESFRLRQHELPAMDFVVVAKKGVADLDNRALSEALEKLWRRHCRLARGS

SEQ ID NO: 8581 - DNA, 237 bp, Escherichia coli
ggctcgcgggtcctgatagccctcattcgggtctatcaacgcctgattagtccgctactcgggccgcattgtcgtttcactccaacctgttcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaa

SEQ ID NO: 8582 - protein, 78 aa, Escherichia coli
GSRVLIALIRVYQRLISPLLGPHCRFTPTCSSYGIEALRRFGVIKGSWLTVKRVLKCHPLHPGGDDPVPPGPFDTREH

SEQ ID NO: 8583 - DNA, 1647 bp, Escherichia coli
atggattcgcaacgcaatcttttagtcatcgctttgctgttcgtgtctttcatgatctggcaagcctgggagcaggataaaaacccgcaacctcaggcccaacagaccacgcagacaacgaccaccgcagcgggtagcgccgccgaccagggcgtaccggccagtggccaggggaaactgatctcggttaagaccgacgtgcttgatctgaccatcaacacccgcggtggtgatgttgagcaagccctgctgcctgcttacccgaaagagctgaactctacccagccgttccagctgctggaaacttcaccgcagtttatttatcaggcacagagcggtctgaccggtcgtgatggcccggataacccggctaacggcccgcgtccgctgtataacgttgaaaaagacgcttatgtgctggctgaaggtcaaaacgaactgcaggtgccgatgacgtataccgacgcggcaggcaacacgtttaccaaaacgtttgtcctgaaacgtggtgattacgctgtcaacgtcaactacaacgtgcagaacgctggcgagaaaccgctggaaatctccacctttggtcagttgaagcaatccatcactctgccaccgcatctcgataccggaagcagcaacttcgcactgcacaccttccgtggtgcggcgtactccacgcctgacgagaagtacgagaaatacaagttcgataccattgccgataacgaaaacctgaacatctcttcgaaaggtggttgggtggcaatgctgcaacagtatttcgcgacggcgtggatcccgcataacgacggtaccaacaacttctataccgctaatctgggtaacggcatcgccgctatcggctataaatctcagccggtactggttcagcctggtcagactggcgcgatgaacagcaccctgtgggttggcccggaaattcaggacaaaatggcagctgttgctccgcacctggatctgaccgttgattacggttggttgtggttcatttctcagccgctgttcaaactgctgaaatggatccatagctttgtgggtaactggggcttctccattatcatcatcacctttatcgttcgtggcatcatgtacccgctgaccaaagcgcagtacacctccatggcgaagatgcgtatgctgcagccgaagattcaggcaatgcgtgagcgtctgggcgatgacaaacagcgcataagccaggaaatgatggcgctgtacaaagctgagaaggttaacccgctgggcggctgcttcccgctgctgatccagatgccaatcttcctggcgttgtactacatgctgatgggttccgttgaactacgtcaggcaccgtttgcactgtggatccacgacctgtctgcacaggacccgtactacatcctgccgatcctgatgggcgtaacgatgttcttcattcagaagatgtcgccgaccactgtgaccgacccgatgcagcagaagatcatgacctttatgccggtcatcttcactgtgttcttcctgtggttcccgtcaggtctggtgctgtactatatcgtcagcaacctggtaaccattattcagcagcagctgatttaccgtggtctggaaaaacgtggcctgcatagccgcgagaagaaaaaatcctga

SEQ ID NO: 8584 - protein, 548 aa, Escherichia coli
MDSQRNLLVIALLFVSFMIWQAWEQDKNPQPQAQQTTQTTTTAAGSAADQGVPASGQGKLISVKTDVLDLTINTRGGDVEQALLPAYPKELNSTQPFQLLETSPQFIYQAQSGLTGRDGPDNPANGPRPLYNVEKDAYVLAEGQNELQVPMTYTDAAGNTFTKTFVLKRGDYAVNVNYNVQNAGEKPLEISTFGQLKQSITLPPHLDTGSSNFALHTFRGAAYSTPDEKYEKYKFDTIADNENLNISSKGGWVAMLQQYFATAWIPHNDGTNNFYTANLGNGIAAIGYKSQPVLVQPGQTGAMNSTLWVGPEIQDKMAAVAPHLDLTVDYGWLWFISQPLFKLLKWIHSFVGNWGFSIIIITFIVRGIMYPLTKAQYTSMAKMRMLQPKIQAMRERLGDDKQRISQEMMALYKAEKVNPLGGCFPLLIQMPIFLALYYMLMGSVELRQAPFALWIHDLSAQDPYYILPILMGVTMFFIQKMSPTTVTDPMQQKIMTFMPVIFTVFFLWFPSGLVLYYIVSNLVTIIQQQLIYRGLEKRGLHSREKKKS

SEQ ID NO: 8585 - DNA, 1365 bp, Escherichia coli
atgagcgataatgacactatcgtagcccaggccacgcctccgggacgtggcggcgttggcatcctgcgcatctccggcctcaaagcccgtgaagttgccgaaaccgtgctgggtaaactgcctaagccacgctacgccgattatcttccgtttaaagacgccgatggcagcgtgctcgatcaggggattgcgctatggttccctggcccgaactcgttcaccggcgaagatgtgctggaactgcaaggtcatggcggtccggtgatcctcgacctgctgttaaaacgcattctgaccattcccggcctgcggattgcccgccctggtgagttttccgaacgcgcatttctgaacgataaactcgacttagcccaggccgaggcgattgcggatcttatcgacgccagctcggaacaggcggcccgttcggcgctaaactcgctgcaaggcgcgttctccgcacgggtcaaccatctggtggaagccctcacccacttgcgcatttacgtcgaagcggcaattgatttcccggatgaagagatcgatttcctctccgacggcaaaattgaagcccagctcaataacgtaattgccgatctcgacgcggtacgcgccgaagctcgtcagggtagtttgttgcgcgaagggatgaaagtggtgattgccggacgtcctaacgccggtaaatcgagcctgctgaacgcgctggcgggccgtgaagcagcaatcgtaaccgatatcgccggaaccacgcgtgacgtgctgcgtgagcatatccacattgacggaatgccgttgcatatcatcgataccgccgggctacgtgaagccagtgacgaagttgaacgtattggtatcgagcgcgcatggcaggaaattgaacaggcagaccgcgtgctgtttatggtcgatggcaccacgacagacgccgttgatccggcagagatctggccggaattcatcgcccgtctgccagcgaaactgccgatcaccgtggtgcgcaataaagccgatatcaccggcgaaacgttggggatgagcgaagtgaacggtcatgcgttaattcgtctttcggcgcggactggcgaaggcgtggatgtactgcgtaaccatctcaaacagagcatgggctttgacaccaatatggaaggcggcttcctggcgcgtcgtcgtcacctacaggcgctggaacaggcggcagagcatttgcagcaaggtaaagcgcaactgttaggtgcctgggcgggtgaactgctggcggaagagttgcgcctggcgcagcagaacttaagcgagatcaccggggaatttacttcagacgacctactggggcggattttctccagcttctgtatcggtaagtaa

SEQ ID NO: 8586 - protein, 454 aa, Escherichia coli [sequence omitted]

SEQ ID NO: 8587 - DNA, 1416 bp, Escherichia coli
atggaaaactttaaacatctccctgaaccgttccgcattcgtgttattgagccagtaaaacgtaccactcgcgcttatcgtgaagaggcaattattaaatccggtatgaacccgttcttgctggatagcgaagatgtgtttatcgatttactgaccgacagcggcaccggggcggtgacgcagagtatgcaggccgcgatgatgcgtggcgacgaagcctacagcggcagccgcagctactacgcgttagccgagtcagtgaaaaatatctttggttatcaatacactattccgactcaccagggccgtggtgcagagcaaatctatattccggtactgattaaaaaacgcgagcaggaaaaaggcctggatcgcagcaaaatggtggcgttctctaactatttctttgataccacgcagggccatagccagattaacggctgtaccgtgcgtaacgtctatatcaaagaagccttcgatactggcgtgcgttacgactttaaaggcaactttgaccttgagggattagaacgcggtattgaagaagttggcccgaataacgtgccgtatatcgttgcaaccatcaccagtaactccgcaggtggtcagccggtttcactggcaaacttaaaagcgatgtacagcatcgcgaagaaatacgatattccggtggtcatggactccgcacgctttgccgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcggcctgctgtgcatgaaagacgacagcttctttgatgtgtataccgaatgcagaaccctttgcgtggtgcaggaaggcttcccgacatatggcggcctggaaggcggcgctatggagcgtctggcggtaggtctgtatgacggcatgaatctggactggctggcttatcgtatcgcgcaggtgcagtatctggtcgatggtctggaagagattggcgttgtctgtcagcaggcgggcggtcacgcggcattcgttgatgcaggtaaactgttgccgcatatcccggcagatcagttcccggcacaggcgctggcctgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaagggttaacctttacctacgaaccgaaagtattgcgtcacttcaccgcaaaactgaaagaagtttaa

SEQ ID NO: 8588 - protein, 471 aa, Escherichia coli
MENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKAMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 8589 - DNA, 1248 bp, Escherichia coli
atgactgatcaatcagaaaaaaaacactctgcattttggggtgttatggttatagccggtacagtaattggcggtgggatgtttgctttacctgttgaccttgccggagcctggtttttttggggcgcttttattcttattatcgcctggttttcaatgttacattcagggctattattattagaagcaaacttaaattatcccgtcggatccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggctatcacgctaatccacgtattgtcgggatctgcactgccattttcgttgccagcgtattgtggataagttcgttagccgccagtcgtattacctcattgttccttgggctgaagattatctcctttgtaattgtttttggttctttcttcttccaggtcgattactccattctgcgcgattccaccagcaccactgcggggacgtcttacttcccgtatatctttatggctttgccggtgtgtctggcgtcatttggtttccacggcaatattcccagcctgattatttgctatggaaaacgcaaagacaaactaatcaaaagcgtggttttcggttcgctgctggcgctggtgatttatctcttctggctctattgcacgatggggaatatcccgcgagaaagctttaaggcgataatctcctcaggcggcaacgttgattcgctggtgaaatcgttcctcggcaccaaacagcacgggattatcgagttttgcctgctggtgttctccaacttagctgttgccagctcgttttttggtgtcacgctgggattgttcgattatctggcggatctgtttaagattgataactcccacgccgggcgtttcaaaaccgtgctgttaaccttcctgccacctgctttgttgtatctgatcttcccgaacggcttcatttacgggatcggcggtgccggactgtgtgccaccatctgggcggtaataattcctgctgtactggcaatcaaagcccgcaagaagtttcccaatcagatgttcacggtctggggcggcaatcttattccggcgattgtcattctctttggcataaccgtaattttatgctggttcggtaacgtctttaacgtgttacctaaatttggctaa

SEQ ID NO: 8590 - protein, 415 aa, Escherichia coli
MTDQSEKKHSAFWGVMVIAGTVIGGGMFALPVDLAGAWFFWGAFILIIAWFSMLHSGLLLLEANLNYPVGSSFNTITKDLIGNTWNIISGITVAFVLYILTYAYISANGAIISETISMNLGYHANPRIVGICTAIFVASVLWISSLAASRITSLFLGLKIISFVIVFGSFFFQVDYSILRDSTSTTAGTSYFPYIFMALPVCLASFGFHGNIPSLIICYGKRKDKLIKSVVFGSLLALVIYLFWLYCTMGNIPRESFKAIISSGGNVDSLVKSFLGTKQHGIIEFCLLVFSNLAVASSFFGVTLGLFDYLADLFKIDNSHAGRFKTVLLTFLPPALLYLIFPNGFIYGIGGAGLCATIWAVIIPAVLAIKARKKFPNQMFTVWGGNLIPAIVILFGITVILCWFGNVFNVLPKFG

SEQ ID NO: 8591 - DNA, 1176 bp, Escherichia coli
atgtcccgctttttgatttgtagttttgccctggttttactttatcccgcagggattgatatgtacctcgttggtttaccgcgcatcgccgccgatctcaatgccagcgaagcgcagttgcatattgcgttctccgtttatctggcggggatggcggctgcgatgttatttgccggtaaagtggccgatcgttcagggagaaagcctgtcgccatacccggcgcggcgctatttattatcgcctcggtgttctgttcactggctgaaaccagcgcgttatttcttgcagggcgatttctacagggactgggcgcgggctgttgttacgtagtggcgttcgccattttgcgcgacacgctggatgatcgacgtcgggctaaagtgctgtcgttactcaacggcattacctgcatcattccggtgttagcgccggtgctcggacacctgattatgcttaaattcccttggcagagtctgttctggacgatggcaacgatgggcatcgcgttactgatgttgtctttgtttattttaaaagaaacgcgccctgcggcccccacaacttcggacaaaccacgagaaaatagcgagtcactgcttaatcggtttttcctcagccgtgttgttatcaccaccctcagcgtttcggtgatcctcaccttcgtcaacacgtcgccagtattgctgatggaaatcatgggttttgagcgcggagaatacgccaccattatggcgttgaccgctggcgtcagcatgaccgtttcattctccacgccgtttgcgctgggaatttttaagccacgtacgttgatgatcacctcacaggtgttattcctggcggcggggatcacccttgccgtttcaccttcccatgcggtttcgctgtttggtatcacgctgatttgcgccggtttctcggtaggttttggtgtggcgatgagtcaggcgttagggccgttttcattacgcgcgggcgtagccagctcgaccttaggtattgcgcaagtttgcggttcgtcactgtggatttggctggcggcggtggttggtatcggcgcatggaatatgctgatcgggattctgattgcctgtagcatagtgagcctgttgctgattatgttcgtcgcgcctggacgccccgttgccgctcatgaagaaatccatcaccacgcttga

SEQ ID NO: 8592 - protein, 391 aa, Escherichia coli
MSRFLICSFALVLLYPAGIDMYLVGLPRIAADLNASEAQLHIAFSVYLAGMAAAMLFAGKVADRSGRKPVAIPGAALFIIASVFCSLAETSALFLAGRFLQGLGAGCCYVVAFAILRDTLDDRRRAKVLSLLNGITCIIPVLAPVLGHLIMLKFPWQSLFWTMATMGIALLMLSLFILKETRPAAPTTSDKPRENSESLLNRFFLSRVVITTLSVSVILTFVNTSPVLLMEIMGFERGEYATIMALTAGVSMTVSFSTPFALGIFKPRTLMITSQVLFLAAGITLAVSPSHAVSLFGITLICAGFSVGFGVAMSQALGPFSLRAGVASSTLGIAQVCGSSLWIWLAAVVGIGAWNMLIGILIACSIVSLLLIMFVAPGRPVAAHEEIHHHA

SEQ ID NO: 8593 - DNA, 867 bp, Escherichia coli
atgaacgtgaccccttcggcggtgagtaagtcgctggcaaagttaagagcgtggtttgacgacccgctctttgtgaactcaccgctgggcctgtctcccacaccgctaatggtcagcatggagcaaaatctggcggaatggatgcaaatgagcaatcagttgctggacaaaccactccacgaaacgccgcgcggtcttaagttcgaactggcggcggaatcgccgctgatgatgatcatgcttaatgcgctgtcgaaacggatctaccaacgatacccgcaggcgaccatcaaattacgtaactgggattacgattccttagatgccattactcgtggtgaagtggatattggtttttccggtcgcgaaagtcatccccgttcgcgggagctgttaagctcgctaccgttagccattgattatgaagtgctgtttagtgatgtgccctgcgtctggttacgcaaagatcatccggcactgcatgaagcatggaatctggacacctttttacgttatccgcatatcagcatttgctgggaacagagcgatacctgggcgctggacaatgtgttacaggagctggggcgcgaacgcacgattgctatgagcctgccggaattcgagcagtcactgtttatggcagcacagcccgacaatctgctactggcgaccgcgccgcgctactgccagtactacaatcaactccaccaactgccgttggttgctcttcctctcccgtttgatgaaagccagcaaaaaaagctggaagtcccttttacccttctgtggcataaacggaacagccgtaatccgaagatcgtctggttacgggaaaccattaaaaatctttacgcgtcgatggcataa

SEQ ID NO: 8594 - protein, 288 aa, Escherichia coli
MNVTPSAVSKSLAKLRAWFDDPLFVNSPLGLSPTPLMVSMEQNLAEWMQMSNQLLDKPLHETPRGLKFELAAESPLMMIMLNALSKRIYQRYPQATIKLRNWDYDSLDAITRGEVDIGFSGRESHPRSRELLSSLPLAIDYEVLFSDVPCVWLRKDHPALHEAWNLDTFLRYPHISICWEQSDTWALDNVLQELGRERTIAMSLPEFEQSLFMAAQPDNLLLATAPRYCQYYNQLHQLPLVALPLPFDESQQKKLEVPFTLLWHKRNSRNPKIVWLRETIKNLYASMA

SEQ ID NO: 8595 - DNA, 105 bp, Escherichia coli
atgatgactcctgtggttgtctatcaatttggcgaaaaagccttcacggtagagagctgggcaaaacgcatcatccggctggtaggattgttggcgcggctgtga

SEQ ID NO: 8596 - protein, 34 aa, Escherichia coli
MMTPVVVYQFGEKAFTVESWAKRIIRLVGLLARL

SEQ ID NO: 8597 - DNA, 750 bp, Escherichia coli
atggcgactcactttgcccgagggattttaacggaaggacatctgatttctgttcgtctcccctccctgtgtcatcaagaagcccgaaacattccccctcatcgtcaaagccgttttctggcgtccagaggtttactcgcagaactgatgttcatgctgtatggcattggcgaattgccggaaatcgtcaccctgccgaaaggaaaaccggttttcagcgataaaaatttgccttcgttttctgtttcctatgccgggaatatggtcggcgtggcgttaacaaccgaaggtgaatgtggcctcgatatggaactacagcgtgcgacacgcgggtttcatagcccacacgcgcccgataaccacaccttttccagcaatgaatcgctatggatcagtaaacaaaacgatcctaacgaagcgcgggcgcagctcatcacgctgcgccgaagcgtgctaaaactaaccggtgatgttttgaatgacgatccgcgcgatctgcaactactgcccattgccggacgcctgaaatgtgctcatgtaaatcatgtagaagcgttatgcgacgcggaggacgtgctggtgtggtccgtggcggtcacgcccacgattgaaaagctcagtgtctgggagttagatggcaaacatggctggaaaagcctgcccgatattcacagccgcgccaacaatcctaccagccggatgatgcgttttgcccagctctctaccgtgaaggctttttcgccaaattga

SEQ ID NO: 8598 - protein, 249 aa, Escherichia coli
MATHFARGILTEGHLISVRLPSLCHQEARNIPPHRQSRFLASRGLLAELMFMLYGIGELPEIVTLPKGKPVFSDKNLPSFSVSYAGNMVGVALTTEGECGLDMELQRATRGFHSPHAPDNHTFSSNESLWISKQNDPNEARAQLITLRRSVLKLTGDVLNDDPRDLQLLPIAGRLKCAHVNHVEALCDAEDVLVWSVAVTPTIEKLSVWELDGKHGWKSLPDIHSRANNPTSRMMRFAQLSTVKAFSPN

SEQ ID NO: 8599 - DNA, 567 bp, Escherichia coli
atgtctgaaaaattgcaggtggttacgttactggggagcctgcgcaaaggctcatttaatggcatggttgcacgtaccctgccgaaaattgctccggcgagcatggaaatcaatgcgttaccttccattgccgacattcccctgtatgacgctgacgtacagcaggaagacggttttccagcaacagttgaagctctggcggaacagatccgtcaggctgacggtgtggtaatcgtcacgccggaatataactactcggtaccgggtgggctgaaaaatgccatcgactggctttcccgcctgccggatcaaccgctggcaggtaaaccggtattgattcagaccagctcaatgggcgtgattggcggcgcgcgctgtcagtatcacctgcgccagattctggttttcctcgatacaatggtgatgaacaagccagaatttatgggcggcgtgattcagaacaaagttgatccgcaaaccggggaagtgattgatcagggtacgctggaccacctgaccgggcaattgaccgcatttggtgagtttattcagcgagttaagatctaa

SEQ ID NO: 8600 - protein, 188 aa, Escherichia coli
MSEKLQVVTLLGSLRKGSFNGMVARTLPKIAPASMEINALPSIADIPLYDADVQQEDGFPATVEALAEQIRQADGVVIVTPEYNYSVPGGLKNAIDWLSRLPDQPLAGKPVLIQTSSMGVIGGARCQYHLRQILVFLDTMVMNKPEFMGGVIQNKVDPQTGEVIDQGTLDHLTGQLTAFGEFIQRVKI

SEQ ID NO: 8601 - DNA, 1299 bp, Escherichia coli
atgctggaacgcgtgtttaaactgcgcgaacatggcacgacggcacggaccgaagtgatcgccggttttaccaccttcctgacgatggtttacatcgtttttgttaacccgcaaattcttggcgttgctggcatggataccagcgccgtcttcgtcacgacctgtctgattgctgcattcggcagtattatgatggggctgtttgctaacctgccagttgcactggcaccggcaatgggcctgaatgcgttcttcgcttttgtggttgtgcaggcgatgggcttgccgtggcaggtcgggatgggcgcaatcttctggggcgcgattggtctgctgttactgacgattttccgcgttcgctactggatgatagccaacattccggtgagtctgcgtgtgggcattaccagcggtatcggcctgtttattggcatgatgggactgaagaatgcaggtgtgattgtcgctaacccggaaacgctggtgagcatcggtaatctgacttctcacagcgtactgctggggatcctcggcttcttcatcattgctattctggcctcacgcaacattcacgcggcggtgctggtttccatcgtggtgacgacgctgctgggctggatgctgggtgatgtccactacaatggcatcgtttctgcgccgccgagcgtaatgactgtcgtgggtcatgtagatttagccgggtcgtttaacctcgggctggcaggggtgattttctctttcatgctggtcaacctgtttgactcctccggtacactgattggcgtgaccgataaagcaggactggcggatgaaaaaggtaaattcccgcgcatgaagcaggcactgtatgtcgacagcatctcttccgtgaccggttcgtttatcgggacttcttctgttacggcgtatatcgagtcttcttccggcgtttccgttggcggtcgtaccggtctgacggcagtggttgttggtctgctgttcctgctggttatcttcctgtcgccgctggcggggatggtgccaggctacgctgcagctggtgcgctgatttacgttggcgtgttgatgacctcaagtcttgctcgcgtgaactggcaggatcttactgaatctgttccggcgtttattaccgctgtgatgatgccgttcagcttctcgattactgaaggtatcgcgctgggctttatctcctactgcgtgatgaagattggtaccggacgtctgcgtgaccttagcccgtgcgtaatcatcgttgcgctgctgtttatcctgaagattgtctttatcgacgctcactaa

SEQ ID NO: 8602 - protein, 432 aa, Escherichia coli
MLERVFKLREHGTTARTEVIAGFTTFLTMVYIVFVNPQILGVAGMDTSAVFVTTCLIAAFGSIMMGLFANLPVALAPAMGLNAFFAFVVVQAMGLPWQVGMGAIFWGAIGLLLLTIFRVRYWMIANIPVSLRVGITSGIGLFIGMMGLKNAGVIVANPETLVSIGNLTSHSVLLGILGFFIIAILASRNIHAAVLVSIVVTTLLGWMLGDVHYNGIVSAPPSVMTVVGHVDLAGSFNLGLAGVIFSFMLVNLFDSSGTLIGVTDKAGLADEKGKFPRMKQALYVDSISSVTGSFIGTSSVTAYIESSSGVSVGGRTGLTAVVVGLLFLLVIFLSPLAGMVPGYAAAGALIYVGVLMTSSLARVNWQDLTESVPAFITAVMMPFSFSITEGIALGFISYCVMKIGTGRLRDLSPCVIIVALLFILKIVFIDAH

SEQ ID NO: 8603 - DNA, 666 bp, Escherichia coli
atgtcccagatagaagcggtatttttcgactgcgacggtacgctggtcgatagcgaggtcatttgctctcgcgcctatgtcacgatgttcagggaatttggcattcacgttgacctggaagagatttttacccgttttaaaggcgtaaaactctacgaaatcatcgacatcatcagtaaagaacagggcgtgacgatggtccaggccgatgccgagcacgtttaccgcgcagaagtagcacgtctgtttgataccgaacttgaggacatcgcaggagcgaacgaattgctggcaagcattaacgtgccgatgtgcgtcgtctctaacggtccggtcagcaaaatgcagcattcgcttggtaagctcaacatgctgcactacttcccggaaaaactgttcagcggctatgatatccagcgttggaagcccgatccggcattaatgttccatgcggcaaaagcgatgaatgtgaacgttgaaaactgcattctggtcgatgactccagcgcaggtgcgcaatcagggatagatgccggaatggaagtgttttacttctgcgctgacccgcacaataaaccgatcgttcacccgaaagtcaccacctttacccatctttcgcaattaccggaactgtggaaggcgcgtggttgggatattacggcatag

SEQ ID NO: 8604 - protein, 221 aa, Escherichia coli
MSQIEAVFFDCDGTLVDSEVICSRAYVTMFREFGIHVDLEEIFTRFKGVKLYEIIDIISKEQGVTMVQADAEHVYRAEVARLFDTELEDIAGANELLASINVPMCVVSNGPVSKMQHSLGKLNMLHYFPEKLFSGYDIQRWKPDPALMFHAAKAMNVNVENCILVDDSSAGAQSGIDAGMEVFYFCADPHNKPIVHPKVTTFTHLSQLPELWKARGWDITA

SEQ ID NO: 8605 - DNA, 474 bp, Escherichia coli
atgtctgtttcacgtcgggtaattcatcacggactgtattttgcggttttagggccgttaattggtgttctgtttcttgtcctctacatattcttcgcaaaagaaccgctgattcttttggtaataatacaggtacttccattgtttctcttaatgtcgataactacgggagctattcctgcaatgttaactggcgtaatggtcgcctgtctgccggaaaagatcgggtcacagaaacgttatcgttgtctggttggcggcataggtggagtcgttatcaccgagatctattgcgctgttatcgtacatattaaggacatggcttcctcagcgttgtttgaaaacattctttctggtgaaaatctcgttgtccgcatcatcccagcattgctggcaggcgtagtgatgagcagaatcattacacatctacccggattggatatttcatgtcctgaaacagactctttaagctaa

SEQ ID NO: 8606 - protein, 157 aa, Escherichia coli
MSVSRRVIHHGLYFAVLGPLIGVLFLVLYIFFAKEPLILLVIIQVLPLFLLMSITTGAIPAMLTGVMVACLPEKIGSQKRYRCLVGGIGGVVITEIYCAVIVHIKDMASSALFENILSGENLVVRIIPALLAGVVMSRIITHLPGLDISCPETDSLS

SEQ ID NO: 8607 - DNA, 723 bp, Escherichia coli
atgaaattaatcattaccgaagattaccaggaaatgagccgtgtcgcggcacaccatctgcttggttatatgtcgaagacgcgtcgtgttaacctggcaattaccgccgggagcacgcccaaaggcatgtacgaatatctcatcactctggttaaaggtaagccctggtacgataactgctatttctataatttcgatgaaattccatttcgcggcaaagagggagaaggcgtaacgattaccaatctgcgtaatctgtttttcacccctgcggggatcaaagaagagaatatccagaagctcactattgataactaccgcgagcatgatcagaaactggcgcgtgaaggcggcctggatttggtggtgttgggattaggtgtagatggtcatttttgtggcaatctgccaaatacgacccatttccatgagcaaaccgtggagttcccgatccagggagagatggttgatattgtggcgcatggcgagttgggcggcgacttttcattagtgcctgacagctacgtgacgatggggccgaaaagcatcatggcggcgaaaaacttgctgataattgtcagtggcgcaggtaaagcgcaggcactgaaaaatgttctgcaaggtccggttaccgaagatgttccagcttccgtgttgcagctgcatccttcgctgatggtaatcgctgataaagccgctgccgcagaattagcgctcggttaa

SEQ ID NO: 8608 - protein, 240 aa, Escherichia coli
MKLIITEDYQEMSRVAAHHLLGYMSKTRRVNLAITAGSTPKGMYEYLITLVKGKPWYDNCYFYNFDEIPFRGKEGEGVTITNLRNLFFTPAGIKEENIQKLTIDNYREHDQKLAREGGLDLVVLGLGVDGHFCGNLPNTTHFHEQTVEFPIQGEMVDIVAHGELGGDFSLVPDSYVTMGPKSIMAAKNLLIIVSGAGKAQALKNVLQGPVTEDVPASVLQLHPSLMVIADKAAAAELALG

SEQ ID NO: 8609 - DNA, 798 bp, Escherichia coli
atgattctggtgccaggcagttatctggatacgcgttctgttgcgcatggtgatttgatcaccataacttaccactccagcgcattgcaatccgaacgtcagatgtatgtctggaccccgccaggatactccggcatgggcgagcctttgccagtgctctatttctatcacggttttggtgataccggacgttccgctatcgatcaggggcgtatcccgcaaatcatggataacctgctggctgaagggaaaattaaaccgatgctggtggtgatccctgataccgaaaccgatgcgaagggcattattcccgaagatttcgtgcctcaggaaagacgtaaagtcttttatccactgaatgctaaagcggcagatcgcgaactgatgaacgatattatcccgctgattagcaagcgttttaatgtccgtaaagatgccgatggccgcgcgctggcggggctttcacaaggcgggtaccaggcgctggtttccggaatgaatcatctggaaagctttggctggctggccacattcagtggtgttaccacgacaaccgtaccggatgaaggtgtcgctgcccggctgaacgagccggcagctattaaccagcaactacgtaattttactgtggttgttggggataaagatgttgtaaccggcaaggatatcgtcgggctgaaaactgagcttgagcagaaaaaaattaagtttgattaccaggaatatcccggtctgaaccatgaaatggatgtctggcggcctgcctatgcagccttcgtacagaaattattcaaataa

SEQ ID NO: 8610 - protein, 265 aa, Escherichia coli
MILVPGSYLDTRSVAHGDLITITYHSSALQSERQMYVWTPPGYSGMGEPLPVLYFYHGFGDTGRSAIDQGRIPQIMDNLLAEGKIKPMLVVIPDTETDAKGIIPEDFVPQERRKVFYPLNAKAADRELMNDIIPLISKRFNVRKDADGRALAGLSQGGYQALVSGMNHLESFGWLATFSGVTTTTVPDEGVAARLNEPAAINQQLRNFTVVVGDKDVVTGKDIVGLKTELEQKKIKFDYQEYPGLNHEMDVWRPAYAAFVQKLFK

SEQ ID NO: 8611 - DNA, 375 bp, Escherichia coli
atgaatataaaaattgctgctttaacgctggctattgccagcggtatttctgctcagtgggccatagcagcggatatgccagccagcccggcacccactattccggttaaacagtatgtgactcaggtcaatgccgataacagcgtgacctttcgctactttgcccctggggcaaaaaatgtctccgtagtggtgggtgttccggttccggataatattcacccgatgaccaaagacgaagcgggagtctggtcgtggcgcacacctgtcctgaaaggcaacctgtacgaatattttttcaatgttgatggtgtacgcagcattgatacaggtacagcaatgactaaacctcagcgcaggttaactccagtatga

SEQ ID NO: 8612 - protein, 124 aa, Escherichia coli
MNIKIAALTLAIASGISAQWAIAADMPASPAPTIPVKQYVTQVNADNSVTFRYFAPGAKNVSVVVGVPVPDNIHPMTKDEAGVWSWRTPVLKGNLYEYFFNVDGVRSIDTGTAMTKPQRRLTPV

SEQ ID NO: 8613 - DNA, 1617 bp, Escherichia coli
atgtttagacgaaatattattacctctgccatcttattaatggcaccgttagccttttccgcacaatcattggctgaatcattaacagtggaacaacgccttgagctattagaaaaggcgttaagagaaacgcaaagcgaactgaaaaaatataaagatgaagagaagaaaaagtatacgccagcgacggtgaatcgtagcgtaagtacgaatgatcaagggtatgccgccaatccattcccgaccagtcgtgccgcaaagcctgatgctgtactggttaaaaatgaagagaaaaatgccagtgagacaggctcgatttattcttccatgactctgaaagatttcagtaaatttgtgaaagatgaaatcggctttagttacaacggctactaccgttctggttggggaacagcctctcatggttcacctaaatcatgggcaattggttctctgggccgctttggtaacgaatactccggctggtttgatttgcagttaaaacaacgtgtctacaacgaaaacggcaaacgggttgatgccatcgtgatgatggatggtaacgtgggtcagcagtactctactggctggtttggcgataacgccggtggtgagaactttatgcagttctctgatatgtacgttaccaccaaaggtttcctgccctttgcgccagaggctgatttctgggtgggtaaacacggtgcgccgaaaattgaaatccagatgcttgactggaaaacgcagcgtaccgatgctgccgcaggtgtaggtctggaaaactggaaagtcggtccgggtaaaattgatatcgcgctggttcgcgaagatgtcgatgattacgatcgcagcctgcaaaacaaacagcagattaataccaataccattgatttacgctataaagatatcccgttatgggataaagtcaccttaatggtgagtggtcgttatgtcacggcaaacgaaagcgcatcggaaaaagataatcaggataataacgggtattatgactggaaagatacctggatgtttggcacatctttaacgcagaaatttgataaaggtggcttcaacgaattctccttcctggtcgcgaataactctatcgccagtaactttggccgttatgctggcgcaagtccatttaccacctttaatggtcgttattatggttatcacaccggcggaacagcagttcgtctgacttcgcagggcgaagcctatatcggcgatcattttattgtggctaacgcgattgtttactccttcggtaacgatatttatagctacgaaacaggcgcacactctgatttcgaatctattcgtgcggttgttcgcccggcctatatttgggaccaatataaccagacaggtgttgagttgggctatttcacccagcaaaacaaagatgcgaatagtaataaatttaatgagtctggttataaaaccacgctcttccatacctttaaagtcaataccagtatgttgacctcgcgcccggaaattcgtttctacgccacgtatatcaaagccctggaaaacgaactggatggcttcacctttgaagacaataaagacgaccagtttgctgtcggtgcccaggctgaaatctggtggtaa

SEQ ID NO: 8614 - protein, 538 aa, Escherichia coli
MFRRNIITSAILLMAPLAFSAQSLAESLTVEQRLELLEKALRETQSELKKYKDEEKKKYTPATVNRSVSTNDQGYAANPFPTSRAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAIVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKVTLMVSGRYVTANESASEKDNQDNNGYYDWKDTWMFGTSLTQKFDKGGFNEFSFLVANNSIASNFGRYAGASPFTTFNGRYYGYHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 8615 - DNA, 1395 bp, Escherichia coli
atgaaagcatttccagaaacatttctttggggtggtgcaacagctgccaatcaggtggaaggcgcctggcaggaagatggcaaagggatcacgacctcagatttacagcctcatggcgtaatgggaaaaatggaaccgcgcatcctggggaaagagaatatcaaagatgtcgccatcgatttttatcaccgttacccggaagatatcgcgttatttgccgagatgggcttcacctgtctgcgtatttccattgcctgggcgcgaatttttcctcagggcgatgaagccgaaccgaatgaagcggggttagcgttttacgagcggctgtttgatgaaatggcgcaggcggggatcaagccgctggtaacgttatcccattacgaaatgccatatgggctggtgaaaaactacggcggttgggctaatcgggcggtcatcgatcacttcgagcattacgcacgcacggtctttacccgctaccaacataaagttgcgttatggctgacatttaatgaaatcaacatgtcattacacgcgccattcacgggcgtggggctggcagaagagagtggcgaggcggaagtttatcaggcgatccatcatcaactggttgccagtgcgcgggcagttaaagcctgtcatagcctgatccccgaagcgaaaattggcaatatgcttctcggtgggctggtttaccccctcacctgccagccacaggatatgttgcaggccatggaagagaaccggcgctggatgttctttggtgatgttcaggcgcgtggtcagtatcccggctatatgcagcgtttcttccgcgaccacaatatcaccattgagatgactgaaagtgacgcagaagatttaaaacataccgtagatttcatctcttttagttattacatgaccggttgtgtttcccacgacgaaagcattaataaaaatgcgcagggcaacatactgaatatgatcccaaatccgcatctgaaaagttcagagtgggggtggcaaattgatccggttggattacggattctgttaaatacgctttgggatcgttatcaaaaaccgttatttattgtcgagaacggattaggcgcaaaagacagcgttgaagtggatggttcgatacaggacgattatcgaattgcctatttaaacgatcacctggtacaggtaaatgaagcgattgccgatggtgtggatattatggggtacaccagttgggggccaattgatttagtcagtgcatctcattcacaaatgtctaagcgctacggctttatttatgtggatcgtgatgataatggtgaaggaagcctcacaagaacgcgcaagaaaagcttcggatggtatgcagaagtgatcaaaactcgggggctatcattaaaaaaataa

SEQ ID NO: 8616 - protein, 464 aa, Escherichia coli
MKAFPETFLWGGATAANQVEGAWQEDGKGITTSDLQPHGVMGKMEPRILGKENIKDVAIDFYHRYPEDIALFAEMGFTCLRISIAWARIFPQGDEAEPNEAGLAFYERLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLIPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRILLNTLWDRYQKPLFIVENGLGAKDSVEVDGSIQDDYRIAYLNDHLVQVNEAIADGVDIMGYTSWGPIDLVSASHSQMSKRYGFIYVDRDDNGEGSLTRTRKKSFGWYAEVIKTRGLSLKK

SEQ ID NO: 8617 - DNA, 1950 bp, Escherichia coli
ttgcttgattcacgtcaggccgtttttttcaggtttttttttggagttttgccgcaaagcggtagagggcaagttatgacggagttagccagaacaatagtcgcaggagtcgggggcgcagataacattgtgagtctgatgcattgtgcaacgcgattacgttttaagttaaaggatgaaagcaaagcgcaagctgaggtactgaaaaagacccccggtattattatggtggtggaaagcggtggccagtttcaggttgtcataggtaaccatgtggccgatgtcttcctggcggttaacagcgtggcaggccttggcgaaaaagcgcaacaggcaccggaaaatgatgataaagataatctgttaaaccgctttttttatgttatttcaggtatttttacgcctctgatcggtttgatggcggcaaccgggatcctgaaaggtatgttggctctggcactcacttttcagtgggcgaccgaacaaagtggtacttatttaattttatttagcgccagtgatgccttgttttggttcttcccgataatcctgggctacaccgcagggaaacgcttcagcggcaatccatttactgccatggtgattggcggagcgttagtgcatccattaattctgactgccttcgagaacgggcaaaaagtggatgcgctgggcctggatttcctgggtattccggtcacattgttgaattactcgtcatcggttattcccattattttttctgcctggttgtgcagcattctggaacgccgacttaatacatggttaccttcggcaatcaaaaatttcttcacacccttgctatgtctgatggtcatcacgcccatcacatttctgctggtggggccgctatcaacctggataagtgaactgattgctgccggttatctctggctttatcaggcggttcctgcatttgcaggcgcggtaatgggcggtttctggcaaatctttgtgatgttcggtctgcattggggtttgatacctttaattatcaataacttcaccgtgctgggctacgacaccatgatcccgctgttaatgcccgccattatggcgcaagtcggggcggcgctcggcgtcttcctctgcgaacgcgatgcgcagaaaaaagtggtggcgggatcagcggcgttgacaggtttgtttggtatcaccgaaccagcggtatatggcgtcaatctgccgcgtaagtaccccttcgttatcgcctgcataagtggggcattgggggccaccatcattggctacgcgcaaacgaaagtttactcctttggtttgccaggtattttcaccttcatgcaaaccatcccgtcaacggggattgatttcaccgtatgggccagcgttattggcggtgtcattgccatcggttgcgcatttgtcggtacggtgatgtttcatttcatcaccgctaaacgtcagccagcgcaagttgcccagcaagagaaaacaccagaggttattacacctgagcagggcggtatctgttcaccgatgacgggagagattgtgccgctcattcacgtcgctgataccacgtttgccagcggcctgttgggtaaaggtattgccattctgccctctgttggtgaagtgcgttctccggtggcggggcaaattgcttcgttgttcgccacattacacgccattggcattgagtcagatgatggcgtggagatcctgattcatgtcggtatcgacaccgtaaaactggacggcaaattcttttccgctcacgtcaacgtgggtgacaaggtcaatacaggcgatcggctgatttcttttgatatccctgctattcgcgaggccggatttgatctgacgacgccggtattaatcagtaatagcgatgattttacggacgtattaccccacggcacggcgcagataaacgctggtgagccgctgttatccatcattcgctaa

SEQ ID NO: 8618 - protein, 649 aa, Escherichia coli
MLDSRQAVFFRFFFGVLPQSGRGQVMTELARTIVAGVGGADNIVSLMHCATRLRFKLKDESKAQAEVLKKTPGIIMVVESGGQFQVVIGNHVADVFLAVNSVAGLGEKAQQAPENDDKDNLLNRFFYVISGIFTPLIGLMAATGILKGMLALALTFQWATEQSGTYLILFSASDALFWFFPIILGYTAGKRFSGNPFTAMVIGGALVHPLILTAFENGQKVDALGLDFLGIPVTLLNYSSSVIPIIFSAWLCSILERRLNTWLPSAIKNFFTPLLCLMVITPITFLLVGPLSTWISELIAAGYLWLYQAVPAFAGAVMGGFWQIFVMFGLHWGLIPLIINNFTVLGYDTMIPLLMPAIMAQVGAALGVFLCERDAQKKVVAGSAALTGLFGITEPAVYGVNLPRKYPFVIACISGALGATIIGYAQTKVYSFGLPGIFTFMQTIPSTGIDFTVWASVIGGVIAIGCAFVGTVMFHFITAKRQPAQVAQQEKTPEVITPEQGGICSPMTGEIVPLIHVADTTFASGLLGKGIAILPSVGEVRSPVAGQIASLFATLHAIGIESDDGVEILIHVGIDTVKLDGKFFSAHVNVGDKVNTGDRLISFDIPAIREAGFDLTTPVLISNSDDFTDVLPHGTAQINAGEPLLSIIR

SEQ ID NO: 8619 - DNA, 837 bp, Escherichia coli
atgaacatgcaaatcaccaaaattctcaacaataatgttgtggtggttattgatgatcaacagcgggaaaaagtcgtcatggggcgcggaattggctttcaaaaacgcccaggcgaaagaattaactcaagtggaatagaaaaagagtatgccttgagcagtcatgaactgaacgggcgattaagcgaactcttaagtcatatgcctcttgaggtgatggcaacctgtgatcgtattatctctctggcgcaggagcgtctgggaaagttgcaggacagtatttatatctcgctaactgaccattgccagtttgcgattaaacgctttcagcaaaacgtgctactgcccaacccgctgctgtgggatatccagcgactttacccgaaagagttccagctaggggaagaagcgttaaccattattgataaacggttgggcgtgcagttaccgaaagatgaagtgggctttattgccatgcatctggtcagtgcccaaatgagcggaaatatggaggatgttgcaggtgtcacgcaattaatgcgagaaatgctgcaattaataaaatttcagttcagccttaattaccaggaagaaagcttgagttatcagcgactggttacgcatctgaaatttttatcctggcgtattcttgaacatgcatcgattaacgatagtgatgaatcattacaacaagcagtaaagcaaaattacccgcaagcatggcaatgtgcggagcggatcgccatttttattggtttgcagtatcaacgtaaaatctcacctgcagagattatgtttttagccataaatatagagcgcgtgcgcaaagaacactga

SEQ ID NO: 8620 - protein, 278 aa, Escherichia coli
MNMQITKILNNNVVVVIDDQQREKVVMGRGIGFQKRPGERINSSGIEKEYALSSHELNGRLSELLSHMPLEVMATCDRIISLAQERLGKLQDSIYISLTDHCQFAIKRFQQNVLLPNPLLWDIQRLYPKEFQLGEEALTIIDKRLGVQLPKDEVGFIAMHLVSAQMSGNMEDVAGVTQLMREMLQLIKFQFSLNYQEESLSYQRLVTHLKFLSWRILEHASINDSDESLQQAVKQNYPQAWQCAERIAIFIGLQYQRKISPAEIMFLAINIERVRKEH

SEQ ID NO: 8621 - DNA, 726 bp, Escherichia coli
atggacagtctcaatcttaataaacatatttccggccagttcaacgccgaactggaaagcatccgcacgcaggtgatgaccatgggcggcatggtggagcagcagctttctgatgcaatcaccgcgatgcataaccaggacagcgatctggcgaagcgcgtcatcgaaggcgacaagaacgtcaacatgatggaagtggcgatcgatgaagcctgcgtgcgcattatcgccaaacgtcagccgacggcgagcgacctgcgtctggttatggtgatcagtaaaaccattgccgagctggagcgtattggcgacgtggcggacaaaatctgccgtactgcactggagaaattctcccagcagcatcagccattgctggtaagtctggagtcgctgggccgtcataccatccagatgctgcacgacgtgctggacgcgttcgcgcggatggacattgacgaagcggtacgtatttatcgtgaagataaaaaagtcgatcaggagtacgaaggtattgttcgtcaactgatgacctacatgatggaagattcgcgtaccattccgagcgtacttaccgcgttattctgtgcgcgttctatcgaacgtattggcgaccgctgccagaatatttgtgagtttatcttctactacgtgaaggggcaggatttccgtcacgtcggtggtgacgagctcgataaactgctggcagaaaaagatagcgataaataa

SEQ ID NO: 8622 - protein, 241 aa, Escherichia coli
MDSLNLNKHISGQFNAELESIRTQVMTMGGMVEQQLSDAITAMHNQDSDLAKRVIEGDKNVNMMEVAIDEACVRIIAKRQPTASDLRLVMVISKTIAELERIGDVADKICRTALEKFSQQHQPLLVSLESLGRHTIQMLHDVLDAFARMDIDEAVRIYREDKKVDQEYEGIVRQLMTYMMEDSRTIPSVLTALFCARSIERIGDRCQNICEFIFYYVKGQDFRHVGGDELDKLLAEKDSDK

SEQ ID NO: 8623 - DNA, 774 bp, Escherichia coli
atgagtatggttgaaactgccccgagtaaaattcaggttcgtaatttgaacttctactacggcaaattccatgccctgaaaaacatcaacctggatatcgccaaaaaccaggttacggcgtttatcgggccgtccggctgcggtaaatcaacgctgctgcgtaccttcaacaaaatgtttgaactgtacccggaacagcgtgcggaaggtgaaattctgctcgatggcgacaacatcctgaccaactctcaggatatcgccctgctgcgtgcgaaagtgggtatggtgttccagaaaccgacgccgttcccgatgtccatctacgacaacatcgcttttggcgtgcgtctgtttgagaagctctcccgtgctgacatggacgagcgcgtgcagtgggcattgaccaaagccgcattgtggaacgaaaccaaagataaattgcaccagagcggttactctctctctggtggtcagcaacagcgtctgtgcattgcgcgtggtatcgccattcgcccggaagtactgctgctcgacgaaccgtgttcggcgctcgaccccatctccaccgggcgtattgaagagctgatcaccgaactgaagcaggattacaccgtggtgatcgtcacccacaacatgcagcaggctgcgcgttgttccgaccacacggcgtttatgtacctgggcgaattgattgagttcagcaacacggacgatctgttcaccaagccagcgaagaaacaaacagaagactacatcaccggtcgttacggttga

SEQ ID NO: 8624 - protein, 257 aa, Escherichia coli
MSMVETAPSKIQVRNLNFYYGKFHALKNINLDIAKNQVTAFIGPSGCGKSTLLRTFNKMFELYPEQRAEGEILLDGDNILTNSQDIALLRAKVGMVFQKPTPFPMSIYDNIAFGVRLFEKLSRADMDERVQWALTKAALWNETKDKLHQSGYSLSGGQQQRLCIARGIAIRPEVLLLDEPCSALDPISTGRIEELITELKQDYTVVIVTHNMQQAARCSDHTAFMYLGELIEFSNTDDLFTKPAKKQTEDYITGRYG

SEQ ID NO: 8625 - DNA, 891 bp, Escherichia coli
atggctatggttgaaatgcaaaccactgcggcactggctgaatcccgccgcaaaatgcaggcgcgtcgccgcctcaaaaaccgtattgcgctgacgctctcaatggcgacgatggccttcggtctgttctggctgatctggattttaatgtccaccatcactcgcggtatcgacggtatgtcgctggcgctgttcaccgaaatgacgccaccacccaatacggaaggcggtggtctggcgaacgccctggcgggtagcggcctgttaattttgtgggctaccgtattcggtacgccgctgggcattatggcggggatttacctggctgaatatggtcgtaaatcttggctggcagaagtgattcgcttcattaacgacattctgctctctgcgccgtcgattgtggttggtctgtttgtttacaccattgtggtggcgcagatggagcacttctccggctgggcgggcgtgattgcgctggcgctgttgcaggtgccgattgttatccgcaccaccgagaacatgctgaaactggtgccggacagcctgcgtgaagcggcttatgcgctgggtacgccgaagtggaagatgatcgccgcgatcacgctgaaagcgtcggtgtccgggatcatgaccggtatcctgctggcgattgcccgtattgctggtgaaaccgcgccgctgctgtttactgcgctctccaaccagttctggagcacggacatgatgcagccgatcgccaacctgccggtgacgatctttaagtttgcgatgagcccgtttgcggaatggcagcaactggcctgggccggggtgttgatcattaccctgtgcgtactgctgctgaacattctggcgcgcgttgtttttgcgaagaataaacacggttaa

SEQ ID NO: 8626 - protein, 296 aa, Escherichia coli
MAMVEMQTTAALAESRRKMQARRRLKNRIALTLSMATMAFGLFWLIWILMSTITRGIDGMSLALFTEMTPPPNTEGGGLANALAGSGLLILWATVFGTPLGIMAGIYLAEYGRKSWLAEVIRFINDILLSAPSIVVGLFVYTIVVAQMEHFSGWAGVIALALLQVPIVIRTTENMLKLVPDSLREAAYALGTPKWKMIAAITLKASVSGIMTGILLAIARIAGETAPLLFTALSNQFWSTDMMQPIANLPVTIFKFAMSPFAEWQQLAWAGVLIITLCVLLLNILARVVFAKNKHG

SEQ ID NO: 8627 - DNA, 960 bp, Escherichia coli
atggctgcaaccaagcctgcttttaacccaccgggtaaaaagggcgacataattttcagcgtgctggtaaaactggcggcgctgattgtgctattgatgttgggtggcattattgtctctctgatcatctcatcctggccgagcattcagaaatttggtctggctttcctgtggaccaaagagtgggatgcgccgaacgatatctacggggcgctggtgccgatctacggtacgctggtgacctcgtttatcgcgctgctgatcgccgtcccggtgagttttggtatcgccctgttcctgaccgagcttgcgcctggctggctgaaacgcccgctgggtatcgccattgagctgctggctgccattccaagtatcgtttacggcatgtggggcctgtttatctttgcgccgctgttcgccgtttacttccaggagccggtcggcaatatcatgtcgaatatcccgattgtcggcgcgctgttctccggcccggcctttggtatcggtatcctcgcggcaggcgtgatcctcgccatcatgattattccgtacattgcagcggtaatgcgcgatgtattcgaacaaaccccggtgatgatgaaagagtcggcctacggtattggctgcaccacctgggaagttatctggcgtatcgttcttccgttcaccaaaaatggtgttatcggcggcattatgttggggctggggcgcgcgctcggtgaaaccatggcggtgacctttatcatcggtaacacctaccaactcgacagcgcctcgctgtatatgccgggcaacagtatcacctctgcgctggccaacgaatttgcggaagcggaatccggtctgcacgtcgctgcactgatggaactgggcctgatcctgtttgtgattaccttcatcgtcctcgccgcatcgaagtttatgattatgcgcctggctaagaatgagggggcacgctaa

SEQ ID NO: 8628 - protein, 319 aa, Escherichia coli
MAATKPAFNPPGKKGDIIFSVLVKLAALIVLLMLGGIIVSLIISSWPSIQKFGLAFLWTKEWDAPNDIYGALVPIYGTLVTSFIALLIAVPVSFGIALFLTELAPGWLKRPLGIAIELLAAIPSIVYGMWGLFIFAPLFAVYFQEPVGNIMSNIPIVGALFSGPAFGIGILAAGVILAIMIIPYIAAVMRDVFEQTPVMMKESAYGIGCTTWEVIWRIVLPFTKNGVIGGIMLGLGRALGETMAVTFIIGNTYQLDSASLYMPGNSITSALANEFAEAESGLHVAALMELGLILFVITFIVLAASKFMIMRLAKNEGAR

SEQ ID NO: 8629 - DNA, 1041 bp, Escherichia coli
atgaaagttatgcgtaccaccgtcgcaactgttgtcgccgcgaccttatcgatgagcgctttctctgtgtttgcagaagcaagcctgacaggtgcaggtgcaaccttccctgcgccggtgtatgccaaatgggctgacacttaccagaaagaaaccggtaataaagttaactaccagggtatcggttcttccggtggcgtaaaacagattatcgctaacaccgttgatttcggtgcctctgacgcgccgctgtctgatgaaaaactggctcaggaaggcctgttccagttcccgaccgtgattggcggcgtggtgctggcggttaatattccaggtctgaagtctggcgaactggtgctggatggtaaaaccctcggcgacatctacctgggcaaaatcaagaagtgggatgatgaagccatcgccaaactgaatccgggtctgaaactgccttcacagaacattgctgtagtacgccgcgcagatggctccgggacttccttcgtcttcaccagctacctggcgaaagtgaacgaagagtggaaaaacaacgttggtactggctctaccgtaaaatggccgatcggtctgggcggtaaaggtaacgacggtatcgccgcgttcgttcagcgtctgccgggtgcaattggttacgttgaatatgcttacgcgaagcagaacaacctggcgtacaccaaactgatctccgctgatggcaaaccggtgagtccgaccgaagaaaacttcgctaatgcagcaaaaggcgcagactggagcaaaacattcgctcaggatctgaccaaccagaaaggcgaagatgcatggcctattacctctaccacgttcattctgatccataaagatcagaagaaaccagaacaaggcaccgaagtgttgaagttcttcgactgggcatacaaaaccggggctaaacaggcgaacgacctggattacgccagcctgccggatagcgtagttgaacaggttcgcgctgcgtggaagaccaatattaaagacagtagcggcaagccgctgtactaa

SEQ ID NO: 8630 - protein, 346 aa, Escherichia coli
MKVMRTTVATVVAATLSMSAFSVFAEASLTGAGATFPAPVYAKWADTYQKETGNKVNYQGIGSSGGVKQIIANTVDFGASDAPLSDEKLAQEGLFQFPTVIGGVVLAVNIPGLKSGELVLDGKTLGDIYLGKIKKWDDEAIAKLNPGLKLPSQNIAVVRRADGSGTSFVFTSYLAKVNEEWKNNVGTGSTVKWPIGLGGKGNDGIAAFVQRLPGAIGYVEYAYAKQNNLAYTKLISADGKPVSPTEENFANAAKGADWSKTFAQDLTNQKGEDAWPITSTTFILIHKDQKKPEQGTEVLKFFDWAYKTGAKQANDLDYASLPDSVVEQVRAAWKTNIKDSSGKPLY

SEQ ID NO: 8631 - DNA, 1830 bp, Escherichia coli
atgtgtggaattgttggcgcgatcgcgcaacgtgatgtagcagaaatccttcttgaaggtttacgtcgtctggaataccgcggatatgattctgccggtctggccgttgttgatgcagaaggtcatatgacccgcctgcgtcgcctcggtaaagtacagatgctggctcaggcagcggaagaacatcctctgcatggcggcaccggtattgctcacactcgctgggcgacccacggtgaaccttcagaagctaacgcgcatccgcatgtttctgaacacattgtggtggtgcataacggcatcatcgaaaaccatgaaccgctgcgtgaagagttaaaagcgcgtggctataccttcgtttctgaaaccgacaccgaagtgattgcacatttggtgaactgggagctgaaacaaggcggtactctgcgtgaggcagttctgcgtgctatcccgcaactgcgtggtgcgtacggtacagtgatcatggactcccgtcatccggataccctgctggcggcacgttctggtagtccgctggtgattggcctgggtatgggcgaaaactttatcgcttctgaccagctggcgctgttgccagtgactcgtcgctttatcttccttgaagagggcgatattgcggaaatcactcgccgttcggtaaacatcttcgataaaactggcgcggaagtaaaacgtcaggatatcgaatccaatctgcaatatgacgcgggcgataaaggtatttaccgccactacatgcagaaagagatctacgaacagccgaacgcgatcaaaaacacccttaccgggcgcatcagccacggtcaggttgatttaagcgagctgggaccgaacgccgatgaactgctgtcgaaggttgagcatattcagatcctcgcctgtggtacttcttataactccggtatggtttcccgctactggtttgaatcgctggcaggtattccgtgcgacgtcgaaatcgcctctgaattccgctatcgcaaatctgccgtgcgtcgtaacagcctgatgatcaccttgtcacagtctggcgaaaccgcggataccctggcgggcctgcgtctgtcgaaagagctgggttaccttggttcgctggcaatctgtaacgttccgggttcttctctggtgcgcgaatccgatctggcgctgatgaccaacgccggtacggaaattggcgtggcctccaccaaagcattcaccacccagttaactgtgctgttgatgctggtggcgaaactgtctcgcctgaaaggtctggatgcctccattgaacatgacatcgtgcatggtctgcaggcgctgccgagccgtattgagcagatgctgtctcaggacaaacgcattgaagcgctggcagaagatttctctgacaaacatcacgcgctgttcctgggccgtggcgatcagtacccaatcgcgctggaaggtgcattgaagctgaaagagatctcttacattcacgctgaagcctacgctgcaggcgaactgaaacacggtccgctggcgctgattgatgccgatatgccggttatcgtcgttgcaccgaacaacgaattgctggaaaaactgaaatccaacattgaagaagttcgcgcgcgtggcggtcagttgtatgtcttcgccgatcaggatgcgggttttgtgagcagtgacaatatgcacattattgagatgccgcatgtggaagaggtgattgcaccgatcttctacaccgttccgctgcaactactggcttaccacgttgcgctgatcaaaggcaccgacgttgaccagccgcgtaacctggcaaaatcggtaacggttgagtaa

SEQ ID NO: 8632 - protein, 609 aa, Escherichia coli
MCGIVGAIAQRDVAEILLEGLRRLEYRGYDSAGLAVVDAEGHMTRLRRLGKVQMLAQAAEEHPLHGGTGIAHTRWATHGEPSEANAHPHVSEHIVVVHNGIIENHEPLREELKARGYTFVSETDTEVIAHLVNWELKQGGTLREAVLRAIPQLRGAYGTVIMDSRHPDTLLAARSGSPLVIGLGMGENFIASDQLALLPVTRRFIFLEEGDIAEITRRSVNIFDKTGAEVKRQDIESNLQYDAGDKGIYRHYMQKEIYEQPNAIKNTLTGRISHGQVDLSELGPNADELLSKVEHIQILACGTSYNSGMVSRYWFESLAGIPCDVEIASEFRYRKSAVRRNSLMITLSQSGETADTLAGLRLSKELGYLGSLAICNVPGSSLVRESDLALMTNAGTEIGVASTKAFTTQLTVLLMLVAKLSRLKGLDASIEHDIVHGLQALPSRIEQMLSQDKRIEALAEDFSDKHHALFLGRGDQYPIALEGALKLKEISYIHAEAYAAGELKHGPLALIDADMPVIVVAPNNELLEKLKSNIEEVRARGGQLYVFADQDAGFVSSDNMHIIEMPHVEEVIAPIFYTVPLQLLAYHVALIKGTDVDQPRNLAKSVTVE

SEQ ID NO: 8633 - DNA, 1371 bp, Escherichia coli
atgttgaataatgctatgagcgtagtgatccttgccgcaggcaaaggcacgcgcatgtattccgatcttccgaaagtgctgcatacccttgccgggaaagcgatggttcagcatgtcattgatgctgcgaatgaattaggcgcagcgcacgttcaccttgtgtatggtcacggcggcgatctgcttaagcaggcgctgaaagacgacaacctgaactgggtgcttcagacagaacagctgggtacgggtcatgcgatgcagcaggccgcacctttctttgccgatgatgaagacattttaatgctctacggcgacgtgccgctgatctctgtcgaaacactccagcgtctgcgtgatgctaaaccgcagggtggcattggtctgctgacggtaaaactggatgatccgaccggttatggacgtatcacccgtgaaaacggcaaagttaccggcattgttgagcacaaagatgccaccgacgagcagcgtcagattcaggagatcaacaccggcattctgattgccaacggcgcagatatgaaacgctggctggcgaagctgaccaacaataatgctcagggcgaatactacatcaccgacattattgcgctggcgtatcaggaaggacgtgaaatcgtcgccgttcatccgcaacgtttaagcgaagtagaaggcgtgaataaccgcctgcaactctcccgactggagcgcgtttaccagtccgaacaggctgaaaaactgctgttagcaggtgttatgctgcgcgatccggcgcgttttgatctgcgcggtacgcttactcacgggcgcgatgttgaaattgatactaacgttatcatcgagggcaacgtgactctcggtcatcgcgtgaaaatcggcaccggttgcgtgattaaaaacagcgtgattggcgatgattgcgaaatcagtccatataccgtcgtggaagacgcgaatctggctgcggcctgtactattggcccgtttgcccgtctgcgtcctggtgctgagttgctggaaggtgcacacgtcggtaacttcgttgagatgaaaaaagcgcgtctgggtaaaggctcgaaagctggtcatctgacttacctgggcgatgcggaaattggcgataacgttaacatcggcgcgggaaccattacctgcaactacgatggtgcgaataaatttaagaccattatcggcgacgatgtgtttgtcggttccgacactcaactggtggccccggtaacagtaggcaaaggcgcgaccattgctgcgggtacaactgtgacgcgtaatgtcggcgaaaatgccctggcgatcagccgtgtgccgcagactcaaaaagaaggctggcgtcgtccggtaaagaaaaagtaa

SEQ ID NO: 8634 - protein, 456 aa, Escherichia coli
MLNNAMSVVILAAGKGTRMYSDLPKVLHTLAGKAMVQHVIDAANELGAAHVHLVYGHGGDLLKQALKDDNLNWVLQTEQLGTGHAMQQAAPFFADDEDILMLYGDVPLISVETLQRLRDAKPQGGIGLLTVKLDDPTGYGRITRENGKVTGIVEHKDATDEQRQIQEINTGILIANGADMKRWLAKLTNNNAQGEYYITDIIALAYQEGREIVAVHPQRLSEVEGVNNRLQLSRLERVYQSEQAEKLLLAGVMLRDPARFDLRGTLTHGRDVEIDTNVIIEGNVTLGHRVKIGTGCVIKNSVIGDDCEISPYTVVEDANLAAACTIGPFARLRPGAELLEGAHVGNFVEMKKARLGKGSKAGHLTYLGDAEIGDNVNIGAGTITCNYDGANKFKTIIGDDVFVGSDTQLVAPVTVGKGATIAAGTTVTRNVGENALAISRVPQTQKEGWRRPVKKK

SEQ ID NO: 8635 - DNA, 420 bp, Escherichia coli
atggcaatgacttaccacctggacgtcgtcagcgcagagcaacaaatgttctctggtctggtcgagaaaatccaggtaacgggtagcgaaggtgaactggggatctaccctggccacgcaccgctgctcaccgccattaagcctggtatgattcgcatcgtgaaacagcacggtcacgaagagtttatctatctgtctggcggcattcttgaagtgcagcctggcaacgtgaccgttctggccgacaccgcaattcgcggccaggatctcgacgaagcgcgagccatggaagcgaaacgtaaggctgaagagcacattagcagctctcacggcgacgtagattacgctcaggcgtctgcggaactggccaaagcgatcgcgcagctgcgcgttatcgagttgaccaaaaaagcgatgtaa

SEQ ID NO: 8636 - protein, 139 aa, Escherichia coli
MAMTYHLDVVSAEQQMFSGLVEKIQVTGSEGELGIYPGHAPLLTAIKPGMIRIVKQHGHEEFIYLSGGILEVQPGNVTVLADTAIRGQDLDEARAMEAKRKAEEHISSSHGDVDYAQASAELAKAIAQLRVIELTKKAM

SEQ ID NO: 8637 - DNA, 1383 bp, Escherichia coli
atggctactggaaagattgtccaggtaatcggcgccgtagttgacgtcgaattccctcaggatgccgtaccgcgcgtgtacgatgctcttgaggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagcttattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaaccggttctatcacctccgtacaggcagtatacgtacctgcggatgacttgactgacccgtctccggcaaccacctttgcgcaccttgacgcaaccgtggtactgagccgtcagatcgcgtctctgggtatctacccggccgttgacccgctggactccaccagccgtcagctggacccgctggtggttggtcaggaacactacgacactgcgcgtggcgttcagtccatcctgcaacgttatcaggaactgaaagacattatcgccatcctgggtatggatgaactgtctgaagaagacaaactggtggtagcgcgtgctcgtaagatccagcgcttcctgtcccagccgttcttcgtggcagaagtattcaccggttctccgggtaaatacgtctccctgaaagacaccatccgtggctttaaaggcatcatggaaggcgaatacgatcacctgccggagcaggcgttctacatggtcggttccatcgaagaagctgtggaaaaagccaaaaaactttaa

SEQ ID NO: 8638 - protein, 460 aa, Escherichia coli
MATGKIVQVIGAVVDVEFPQDAVPRVYDALEVQNGNERLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVSLKDTIRGFKGIMEGEYDHLPEQAFYMVGSIEEAVEKAKKL

SEQ ID NO: 8639 - DNA, 864 bp, Escherichia coli
atggccggcgcaaaagagatacgtagtaagatcgcaagcgtccagaacacgcaaaagatcactaaagcgatggagatggtcgccgcttccaaaatgcgtaaatcgcaggatcgcatggcggccagccgtccttatgcagaaaccatgcgcaaagtgattggtcaccttgcacacggtaatctggaatataagcacccttacctggaagaccgcgacgttaaacgcgtgggctacctggtggtgtcgaccgaccgtggtttgtgcggtggtttgaacattaacctgttcaaaaaactgctggcggaaatgaagacctggaccgacaaaggcgttcaatgcgacctcgcaatgatcggctcgaaaggcgtgtcgttcttcaactccgtgggcggcaatgttgttgcccaggtcaccggcatgggggataacccttccctgtccgaactgatcggtccggtaaaagtgatgttgcaggcctacgacgaaggccgtctggacaagctttacattgtcagcaacaaatttattaacaccatgtctcaggttccgaccatcagccagctgctgccgttaccggcatcagatgatgatgatctgaaacataaatcctgggattacctgtacgaacccgatccgaaggcgttgctggataccctgctgcgtcgttatgtcgaatctcaggtttatcagggcgtggttgaaaacctggccagcgagcaggccgcccgtatggtggcgatgaaagccgcgaccgacaatggcggcagcctgattaaagagctgcagttggtatacaacaaagctcgtcaggccagcattactcaggaactcaccgagatcgtctcgggggccgccgcggtttaa

SEQ ID NO: 8640 - protein, 287 aa, Escherichia coli
MAGAKEIRSKIASVQNTQKITKAMEMVAASKMRKSQDRMAASRPYAETMRKVIGHLAHGNLEYKHPYLEDRDVKRVGYLVVSTDRGLCGGLNINLFKKLLAEMKTWTDKGVQCDLAMIGSKGVSFFNSVGGNVVAQVTGMGDNPSLSELIGPVKVMLQAYDEGRLDKLYIVSNKFINTMSQVPTISQLLPLPASDDDDLKHKSWDYLYEPDPKALLDTLLRRYVESQVYQGVVENLASEQAARMVAMKAATDNGGSLIKELQLVYNKARQASITQELTEIVSGAAAV

SEQ ID NO: 8641 - DNA, 1542 bp, Escherichia coli
atgcaactgaattccaccgaaatcagcgaactgatcaagcagcgcattgctcagttcaatgttgtgagtgaagctcacaacgaaggtactattgtttctgtaagtgacggtgttatccgcattcacggcctggccgattgtatgcagggtgaaatgatctccctgccgggtaaccgttacgctatcgcactgaacctcgagcgcgactctgtaggtgcggttgttatggggccgtacgctgaccttgccgaaggcatgaaagttaagtgtactggccgtatcctggaagttccggttggccgtggcctgctgggccgtgtggttaacactctgggtgcaccaatcgacggtaaaggtccgctggatcacgacggcttctctgctgtagaagcaatcgctccgggcgttatcgaacgtcagtccgtagatcagccggtacagaccggttataaagccgttgactccatgatcccaatcggtcgtggtcagcgtgaattgatcatcggtgaccgtcagaccggtaaaaccgcactggctatcgatgccatcatcaaccagcgcgattccggtatcaaatgtatctatgtcgctatcggccagaaagcgtccaccatttctaacgtggtacgtaaactggaagagcacggcgcactggctaacaccatcgttgtggtagcaaccgcgtctgaatccgcagcactgcaatacctggcaccgtacgctggttgcgcaatgggtgaatacttccgtgaccgcggtgaagatgcgctgatcatttacgatgacctgtctaaacaggctgttgcttaccgtcagatctccctgctgctccgtcgtccgccaggacgtgaagcattcccaggcgacgtattctacctccactctcgtctgctggagcgtgctgcgcgtgttaacgccgaatacgttgaagctttcaccaaaggtgaagtgaaagggaaaaccggttctctgactgcgctgccgattatcgaaactcaggcgggtgacgtttctgcgttcgttccgaccaacgtaatctccattaccgatggtcagatcttcctggaaaccaacctgttcaacgccggtattcgtcctgcggttaacccgggtatttccgtatcccgtgttggtggtgcagcacagaccaagatcatgaaaaaactgtccggtggtatccgtaccgctctggcacagtatcgtgaactggcagcgttctctcagtttgcatccgaccttgacgatgcaacacgtaagcagcttgaccacggtcagaaagtgaccgaactgctgaagcagaaacagtatgcgccgatgtctgttgcgcaacagtctctggttctgttcgcagcagaacgtggttacctggcggatgttgaactgtcgaaaatcggcagcttcgaagccgctctgctggcttacgtcgaccgtgatcacgctccgttgatgcaagagatcaaccagaccggtggctacaacgacgaaatcgaaggcaagctgaaaggcatcctcgattccttcaaagcaacccaatcctggtaa

SEQ ID NO: 8642 - protein, 513 aa, Escherichia coli
MQLNSTEISELIKQRIAQFNVVSEAHNEGTIVSVSDGVIRIHGLADCMQGEMISLPGNRYAIALNLERDSVGAVVMGPYADLAEGMKVKCTGRILEVPVGRGLLGRVVNTLGAPIDGKGPLDHDGFSAVEAIAPGVIERQSVDQPVQTGYKAVDSMIPIGRGQRELIIGDRQTGKTALAIDAIINQRDSGIKCIYVAIGQKASTISNVVRKLEEHGALANTIVVVATASESAALQYLAPYAGCAMGEYFRDRGEDALIIYDDLSKQAVAYRQISLLLRRPPGREAFPGDVFYLHSRLLERAARVNAEYVEAFTKGEVKGKTGSLTALPIIETQAGDVSAFVPTNVISITDGQIFLETNLFNAGIRPAVNPGISVSRVGGAAQTKIMKKLSGGIRTALAQYRELAAFSQFASDLDDATRKQLDHGQKVTELLKQKQYAPMSVAQQSLVLFAAERGYLADVELSKIGSFEAALLAYVDRDHAPLMQEINQTGGYNDEIEGKLKGILDSFKATQSW

SEQ ID NO: 8643 - DNA, 534 bp, Escherichia coli
atgtctgaatttattacggtagctcgcccctacgccaaagcagcttttgactttgccgtcgaacaccaaagtgtagaacgctggcaggacatgctggcgtttgccgccgaggtaaccaaaaacgaacaaatggcagagcttctctctggcgcgcttgcgccagaaacgctcgccgagtcgtttatcgcagtttgtggtgagcaactggacgaaaacggtcagaacctgattcgggtaatggctgaaaatggtcgtcttaacgcgctcccggatgttctggagcagtttattcacctgcgtgccgtgagtgaggctaccgctgaggtagacgtcatttccgctgccgcactgagtgaacaacagctcgcgaaaatttctgctgcgatggaaaaacgtctgtcacgcaaagttaagctgaattgcaaaatcgataagtctgtaatggcaggcgttatcatccgagcgggtgatatggtcattgatggcagcgtacgcggtcgtcttgagcgccttgcagacgtcttgcagtcttaa

SEQ ID NO: 8644 - protein, 177 aa, Escherichia coli
MSEFITVARPYAKAAFDFAVEHQSVERWQDMLAFAAEVTKNEQMAELLSGALAPETLAESFIAVCGEQLDENGQNLIRVMAENGRLNALPDVLEQFIHLRAVSEATAEVDVISAAALSEQQLAKISAAMEKRLSRKVKLNCKIDKSVMAGVIIRAGDMVIDGSVRGRLERLADVLQS

SEQ ID NO: 8645 - DNA, 471 bp, Escherichia coli
gtgaatcttaacgcaacaatcctcggccaggccatcgcgtttgtcctgttcgttctgttctgcatgaagtacgtatggccgccattaatggcagccatcgaaaaacgtcaaaaagaaattgctgacggccttgcttccgcagaacgagcacataaggaccttgaccttgcaaaggccagcgcgaccgaccagctgaaaaaagcgaaagcggaagcccaggtaatcatcgagcaggctaacaaacgccgctcgcagattctggacgaagcgaaagctgaggcagaacaggaacgtactaaaatcgtggcccaggcgcaggcggaaattgaagccgagcgtaaacgtgcccgtgaagagctgcgtaagcaagttgctatcctggctgttgctggcgccgagaagatcatcgaacgttccgtggatgaagctgctaacagcgacatcgtggataaacttgtcgctgaactgtaa

SEQ ID NO: 8646 - protein, 156 aa, Escherichia coli
MNLNATILGQAIAFVLFVLFCMKYVWPPLMAAIEKRQKEIADGLASAERAHKDLDLAKASATDQLKKAKAEAQVIIEQANKRRSQILDEAKAEAEQERTKIVAQAQAEIEAERKRAREELRKQVAILAVAGAEKIIERSVDEAANSDIVDKLVAEL

SEQ ID NO: 8647 - DNA, 738 bp, Escherichia coli
ttgttcactcagtgcggcagcggaaatgacgtctacctcagcggtagcctcactcacggcacgcaggtgaataaactgctccagaacatccgggagcgcgttaagacgaccattttcagccattacccgaatcaggttctgaccgttttcgtccagttgctcaccacaaactgcgataaacgactcggcgagcgtttctggcgcaagcgcgccagagagaagctctgccatttgttcgtttttggttacctcggcggcaaacgccagcatgtcctgccagcgttctacactttggtgttcgacggcaaagtcaaaagctgctttggcgtaggggcgagctaccgtaataaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcacgtttacgctcggcttcaatttccgcctgcgcctgggccacgattttagtacgttcctgttctgcctcagctttcgcttcgtccagaatctgcgagcggcgtttgttagcctgctcgatgattacctgggcttccgctttcgcttttttcagctggtcggtcgcgctggcctttgcaaggtcaaggtccttatgtgctcgttctgcggaagcaaggccgtcagcaatttctttttga

SEQ ID NO: 8648 - protein, 245 aa, Escherichia coli
MFTQCGSGNDVYLSGSLTHGTQVNKLLQNIRERVKTTIFSHYPNQVLTVFVQLLTTNCDKRLGERFWRKRAREKLCHLFVFGYLGGKRQHVLPAFYTLVFDGKVKSCFGVGASYRNKFRHQPLPPYSSATSLSTMSLLAASSTERSMIFSAPATARIATCLRSSSRARLRSASISACAWATILVRSCSASAFASSRICERRLLACSMITWASAFAFFSWSVALAFARSRSLCARSAEARPSAISF

SEQ ID NO: 8649 - DNA, 240 bp, Escherichia coli
atggaaaacctgaatatggatctgctgtacatggctgccgctgtgatgatgggtctggcggcaatcggtgctgcgatcggtatcggcatcctcgggggtaaattcctggaaggcgcagcgcgtcaacctgatctgattcctctgctgcgtactcagttctttatcgttatgggtctggtggatgctatcccgatgatcgctgtaggtctgggtctgtacgtgatgttcgctgtcgcgtag

SEQ ID NO: 8650 - protein, 79 aa, Escherichia coli
MENLNMDLLYMAAAVMMGLAAIGAAIGIGILGGKFLEGAARQPDLIPLLRTQFFIVMGLVDAIPMIAVGLGLYVMFAVA

SEQ ID NO: 8651 - DNA, 816 bp, Escherichia coli
atggcttcagaaaatatgacgccgcaggattacataggacaccacctgaataaccttcagctggacctgcgtacattctcgctggtggatccacataaccccccagccaccttctggacaatcaatattgactccatgttcttctcggtggtgctgggtctgttgttcctggttttattccgtagtgtagccaaaaaggcaaccagcggcgtgccaggtaagtttcagaccgcgattgagctggtgatcggctttgttaatggtagcgtgaaagacatgtaccatggcaaaagcaagctgattgctccgctggccctgacgatcttcgtctgggtattcctgatgaacctgatggatttactgcctatcgacctgctgccgtacattgctgaacatgtactgggtctgcctgcactgcgtgtggttccgtctgctgacgtgaacgtaacgctgtctatggcactgggcgtatttatcctgattctgttctacagcatcaaaatgaaaggcatcggcggcttcacgaaagagttgacgctgcagccgttcaatcactgggcgttcattcctgtcaacttaatccttgaaggggtaagcctgctgtccaaaccagtttcactcggtttgcgactgttcggtaacatgtatgccggtgagctgattttcattctgattgctggtctgttgccgtggtggtcacagtggatcctgaatgtgccgtgggccattttccacatcctgatcattacgctgcaagccttcatcttcatggttctgacgatcgtctatctgtcgatggcgtctgaagaacattaa

SEQ ID NO: 8652 - protein, 271 aa, Escherichia coli
MASENMTPQDYIGHHLNNLQLDLRTFSLVDPHNPPATFWTINIDSMFFSVVLGLLFLVLFRSVAKKATSGVPGKFQTAIELVIGFVNGSVKDMYHGKSKLIAPLALTIFVWVFLMNLMDLLPIDLLPYIAEHVLGLPALRVVPSADVNVTLSMALGVFILILFYSIKMKGIGGFTKELTLQPFNHWAFIPVNLILEGVSLLSKPVSLGLRLFGNMYAGELIFILIAGLLPWWSQWILNVPWAIFHILIITLQAFIFMVLTIVYLSMASEEH

SEQ ID NO: 8653 - DNA, 381 bp, Escherichia coli
atgtctgtgtcgctcgtgagtcgaaacgttgctcggaagcttctgctcgttcagttactggtggtgatagcaagtggattgctgttcagcctcaaagaccccttctggggcgtctctgcaataagcgggggcctggcagtctttctgcctaacgttttgtttatgatatttgcctggcgtcaccaggcgcatacaccagcgaaaggccgggtggcctggacattcgcatttggcgaagctttcaaagttctggcgatgttggtgttactggtggtggcgttggcggttttaaaggcggtattcttgccgctgatcgttacgtgggttttggtgctggtggttcagatactggcaccggctgtaattaacaacaaagggtaa

SEQ ID NO: 8654 - protein, 126 aa, Escherichia coli
MSVSLVSRNVARKLLLVQLLVVIASGLLFSLKDPFWGVSAISGGLAVFLPNVLFMIFAWRHQAHTPAKGRVAWTFAFGEAFKVLAMLVLLVVALAVLKAVFLPLIVTWVLVLVVQILAPAVINNKG

SEQ ID NO: 8655 - DNA, 624 bp, Escherichia coli
gtgctcaacaaactctccttactgctgaaagacgcaggtatttcgcttaccgatcaccagaaaaaccagcttattgcctacgtgaatatgctgcataaatggaataaagcgtacaacctgacttcggtccgcgatcctaatgagatgctggtacgacatattctcgatagcattgtggtggcaccgtatctgcaaggtgaacggtttatcgatgtcggcaccggaccgggactgcctggcattccactctctatcgtgcgtcctgaagctcatttcacgttgttggatagccttggtaaacgcgtgcgtttccttcgtcaggtgcaacatgagcttaaactggagaatattgagccagtacagagcagggtagaagagtttccgtcagagccgccatttgatggcgtaattagccgcgcttttgcctctctgaacgatatggtgagctggtgccaccatcttcctggtgagcaaggccgtttctacgcgctgaaagggcaaatgccggaagatgaaatcgctttgttgcccgaggaatatcaggtcgaatcagtggttaaacttcaggttccagccctggatggcgaacgtcatctggtggtgattaaagcaaataaaatttaa

SEQ ID NO: 8656 - protein, 207 aa, Escherichia coli
MLNKLSLLLKDAGISLTDHQKNQLIAYVNMLHKWNKAYNLTSVRDPNEMLVRHILDSIVVAPYLQGERFIDVGTGPGLPGIPLSIVRPEAHFTLLDSLGKRVRFLRQVQHELKLENIEPVQSRVEEFPSEPPFDGVISRAFASLNDMVSWCHHLPGEQGRFYALKGQMPEDEIALLPEEYQVESVVKLQVPALDGERHLVVIKANKI

SEQ ID NO: 8657 - DNA, 1890 bp, Escherichia coli
atgttttatccggatccttttgacgtcatcatcattggcgggggtcatgcaggcaccgaggccgcgatggccgcggcgcgtatgggtcaacagactctgcttttgacacacaatatcgacactctggggcagatgagctgcaacccggcgatcggcggtattgggaagggacatctggtaaaagaagtggatgcactcggcggtctgatggcgaaagcgatcgatcaggcgggtatccagtttaggatactaaacgcaagcaagggaccggcggttcgcgctacccgagctcaggcagatcgtgtgctctaccgtcaggcggtacgtacggcgctggagaaccaaccgaacctgatgatcttccagcaggcggttgaagatcttattgtcgaaaacgatcgcgtggtcggtgccgttacccaaatgggactgaagttccgtgccaaagctgtcgtgctcaccgttgggacgttcctcgacggtaaaattcatatcggtctggataattacagcggtggccgtgctggtgatccgccgtccattccgctctctcgccgtttgcgtgaactgccgctgcgcgttggtcgtctgaaaaccgggacaccgccgcgtattgatgcacgtactatcgacttcagcgtgctggcgcaacagcatggcgataacccaatgccggtattctcgtttatgggtaatgcgtcccagcatccacagcaggtgccgtgttatatcacccataccaacgagaaaacccatgatgtgatccgcagtaacctcgatcgtagcccaatgtatgcaggggtgatcgaaggtgtcggcccacgctactgcccgtcgatcgaagacaaagtcatgcgcttcgccgaaagaaatcagcatcagatcttccttgaaccggaagggctgacctcaaacgaaatttatccgaacggtatctccaccagcctgccgttcgatgtgcagatgcaaatcgtccgctccatgcaggggatggaaaacgcgaagatcgtgcgtccgggttatgccattgagtatgacttcttcgatccacgcgacctgaaaccgacgctggagagcaagtttatccaggggctgttctttgctggtcagattaacggcactaccggttacgaagaagccgctgcgcaaggtttgctggctggtcttaacgctgcccgtctgtctgctgacaaagaaggttgggctccggcgcgttctcaggcatatctcggcgtactggttgatgacctgtgcactttaggaaccaaagaaccgtatcgtatgtttacctcgcgcgcagaatatcgtctgatgctgcgcgaagataatgctgatctgcgtttgactgaaatcggtcgcgaactgggcctggtggatgacgaacgttgggcgcgctttaacgagaaacttgagaatatcgagcgtgagcgtcagcgtctgaaatcgacctgggtaaccccgtcggcggaagctgcagccgaagtgaatgctcacctgactgcgccgctttcccgtgaagccagtggtgaagatctgctacgtcgtcctgaaatgacttatgaaaaattaaccacgctgacaccgtttgcccctgcgttgacagatgaacaggctgcggaacaggttgagattcaggttaaatacgaaggttatatcgcgcgccagcaagatgagatcgaaaagcagctgcgtaacgagaataccctgctaccagcgacgctggattaccgccaggtatccggtctttctaacgaagtgatcgccaaacttaacgatcacaaaccggcctctattggccaggcttcgcgtatttctggcgtcacgcctgcggctatctccattctgctggtgtggctgaaaaaacagggtatgctgcgtcgtagcgcataa

SEQ ID NO: 8658 - protein, 629 aa, Escherichia coli
MFYPDPFDVIIIGGGHAGTEAAMAAARMGQQTLLLTHNIDTLGQMSCNPAIGGIGKGHLVKEVDALGGLMAKAIDQAGIQFRILNASKGPAVRATRAQADRVLYRQAVRTALENQPNLMIFQQAVEDLIVENDRVVGAVTQMGLKFRAKAVVLTVGTFLDGKIHIGLDNYSGGRAGDPPSIPLSRRLRELPLRVGRLKTGTPPRIDARTIDFSVLAQQHGDNPMPVFSFMGNASQHPQQVPCYITHTNEKTHDVIRSNLDRSPMYAGVIEGVGPRYCPSIEDKVMRFAERNQHQIFLEPEGLTSNEIYPNGISTSLPFDVQMQIVRSMQGMENAKIVRPGYAIEYDFFDPRDLKPTLESKFIQGLFFAGQINGTTGYEEAAAQGLLAGLNAARLSADKEGWAPARSQAYLGVLVDDLCTLGTKEPYRMFTSRAEYRLMLREDNADLRLTEIGRELGLVDDERWARFNEKLENIERERQRLKSTWVTPSAEAAAEVNAHLTAPLSREASGEDLLRRPEMTYEKLTTLTPFAPALTDEQAAEQVEIQVKYEGYIARQQDEIEKQLRNENTLLPATLDYRQVSGLSNEVIAKLNDHKPASIGQASRISGVTPAAISILLVWLKKQGMLRRSA

SEQ ID NO: 8659 - DNA, 444 bp, Escherichia coli
atggcagatatcactcttatcagcggcagcaccctcggcggtgccgaatatgtagcagaacacctggctgaaaagctggaagagacgggtttaaccaccgaaacgctgcacggtccgctgttggaagatttatctgcctcggggatctggctggttatcagctcaacccacggtgccggagatattccggacaacctttctcctttctatgaagcattgcaggaacagaagcccgatctttctgcggtccgctttggcgcaatcggtattggtagtcgtgaatatgacaccttttgtggggctatcgataaaatcgaggcagaactcaaaaattccggagcaaaacagacaggcgaaacactgaagatcaacattcttgatcacgacattccggaggatccggcagaagaatggctgggatcgtggattaatttactcaaataa

SEQ ID NO: 8660 - protein, 147 aa, Escherichia coli
MADITLISGSTLGGAEYVAEHLAEKLEETGLTTETLHGPLLEDLSASGIWLVISSTHGAGDIPDNLSPFYEALQEQKPDLSAVRFGAIGIGSREYDTFCGAIDKIEAELKNSGAKQTGETLKINILDHDIPEDPAEEWLGSWINLLK

SEQ ID NO: 8661 - DNA, 459 bp, Escherichia coli
atggaaaattatctgatcgacaatctggaccgaggcatcctggaagcattaatgggcaatgcgcgcaccgcttacgccgaactggcgaaacaatttggcgtcagcccggggacgattcacgttcgagtagagaaaatgaagcaggcggggatcattaccggggcgcgtattgatgtcagcccgaagcagcttggttatgacgtaggctgctttatcggcattatattaaagagcgccaaagactatccttccgcgctggcaaagctggaaagcctcgatgaagtcactgaagcctattacacaaccggccactacagcatctttataaaagtgatgtgccgttcgatcgatgctctccagcatgtacttatcaacaagatccaaacaattgatgaaattcagtccaccgagacactgatcgtcctgcagaatccgatcatgcgtaccattaagccctga

SEQ ID NO: 8662 - protein, 152 aa, Escherichia coli
MENYLIDNLDRGILEALMGNARTAYAELAKQFGVSPGTIHVRVEKMKQAGIITGARIDVSPKQLGYDVGCFIGIILKSAKDYPSALAKLESLDEVTEAYYTTGHYSIFIKVMCRSIDALQHVLINKIQTIDEIQSTETLIVLQNPIMRTIKP

SEQ ID NO: 8663 - DNA, 993 bp, Escherichia coli
atgaaaaccgcttacattgccaaacaacgtcaaattagcttcgtgaaatctcacttttctcgtcaactggaagaacgtctggggctgatcgaagtccaggcaccgattcttagccgtgtgggggatggcacgcaggataacttgtcgggctgtgaaaaagcggtgcaggtaaaagtgaaagctctgcctgatgcccagttcgaagtggttcattcactggcgaagtggaaacgtcagaccttagggcaacacgacttcagcgcgggcgaagggctgtacacgcacatgaaagcccttcgccccgatgaagaccgtctttccccgttgcactcggtctatgtagaccagtgggactgggaacgcgtaatgggcgacggcgagcgtcaattctcgactctgaaaagcacggtagaggcgatctgggagggaattaaagcaaccgaagctgcggttagcgaagagtttggcctggcaccgttcctgccggatcagatccacttcgtacacagccaggagttactgtctcgttatccggagctcgatgccaaagggcgtgagcgggcgattgcgaaagatcttggcgcggtattcctggtcgggattggcggcaagctgagcgatggtcatcgtcacgacgtgcgcgcaccggattatgatgactggagcaccccgtcagagctgggccatgcgggtctgaacggcgatattctggtatggaacccggtactggaagatgcgtttgagctttcttccatggggatccgcgtggatgccgacacgctgaagcatcagctggcgctgaccggtgacgaagatcgcctggagctggagtggcatcaggcgctgctgcgcggtgaaatgccgcagaccatcggcggcggtatcggccagtctcgtttgaccatgctgctgctgcaactgccacatatcggccaggttcagtgtggtgtatggccggcagctgttcgtgagagcgtcccttctctgctgtaa

SEQ ID NO: 8664 - protein, 330 aa, Escherichia coli
MKTAYIAKQRQISFVKSHFSRQLEERLGLIEVQAPILSRVGDGTQDNLSGCEKAVQVKVKALPDAQFEVVHSLAKWKRQTLGQHDFSAGEGLYTHMKALRPDEDRLSPLHSVYVDQWDWERVMGDGERQFSTLKSTVEAIWEGIKATEAAVSEEFGLAPFLPDQIHFVHSQELLSRYPELDAKGRERAIAKDLGAVFLVGIGGKLSDGHRHDVRAPDYDDWSTPSELGHAGLNGDILVWNPVLEDAFELSSMGIRVDADTLKHQLALTGDEDRLELEWHQALLRGEMPQTIGGGIGQSRLTMLLLQLPHIGQVQCGVWPAAVRESVPSLL

SEQ ID NO: 8665 - DNA, 1452 bp, Escherichia coli
atgctaacgctggatacgcttaatgtgatgctggccgtcagcgaagagggattgatcgaagagatgatcatcgcgctgctggcctcaccgcagctggcagtcttctttgaaaaattcccacgactgaaggcggcaatcactgatgatgttccccgctggcgtgaggcgctgcgcagtcggctgaaagatgcccgagtcccgccggaactcaccgaagaggtgatgtgctatcagcaaagccagctcctctccacgccgcagtttattgtgcagctaccacaaatcctggacttactgcatcgtctgaattccccatgggcagaacaagcccgccagttggttgatgctaacagcacgatcacttcagcgttacacacgctttttctccagcgctggcgtttaagcctgatcgtgcaagcaacgacgttaaatcagcagctattagaagaagaacgcgaacaactgttgagtgaagttcaggaacgcatgacgctgagcgggcaacttgaaccgattctcgcagataacaataccgcagctggtcgtctgtgggatatgagcgccggtcagcttaaacgtggcgactatcagttgattgtgaaatacggtgaatttcttaacgaacagccggaactgaaacgtctggcagaacagctggggcgttcccgggaagccaaatcaataccgcgcaacgatgcgcagatggaaaccttccgcaccatggtgcgcgaaccggcgacagttcctgagcaggttgatggtctgcagcaaagcgatgatattttacgtctcttgccgccagaactggcgacactagggataacggaactggagtatgagttttaccgtcggctggtggaaaaacagttgctcacctatcgcctgcatggtgagtcgtggcgtgaaaaaatgatcgaacgcccggtggtgcataaagattacgacgaacagccgcgcggaccgtttattgtctgcgtggatacttccggctcaatgggcggctttaatgaacagtgtgcgaaagcgttctgcctggccttgatgcgcatagccctcgctgaaaaccggcgctgctatattatgctattttccaccgagatcgtccgttatgagctttcaggcccacaaggcatcgaacaagcaatccgttttttaagccagcagtttcgtggcggcaccgatctggccagttgttttcgcgccattatggaacgcttgcaaagccgggaatggtttgatgccgatgcggtggtgatttctgattttatcgcccagcggttacctgacgacgtgacgagcaaagtgaaagagttgcagcgggtacatcagcatcgctttcatgccgtggcgatgtcggcacatggcaaacccggcatcatgcgcattttcgatcatatctggcgctttgataccgggatgcgaagccgcctgctcagacgctggcggcgataa

SEQ ID NO: 8666 - protein, 483 aa, Escherichia coli
MLTLDTLNVMLAVSEEGLIEEMIIALLASPQLAVFFEKFPRLKAAITDDVPRWREALRSRLKDARVPPELTEEVMCYQQSQLLSTPQFIVQLPQILDLLHRLNSPWAEQARQLVDANSTITSALHTLFLQRWRLSLIVQATTLNQQLLEEEREQLLSEVQERMTLSGQLEPILADNNTAAGRLWDMSAGQLKRGDYQLIVKYGEFLNEQPELKRLAEQLGRSREAKSIPRNDAQMETFRTMVREPATVPEQVDGLQQSDDILRLLPPELATLGITELEYEFYRRLVEKQLLTYRLHGESWREKMIERPVVHKDYDEQPRGPFIVCVDTSGSMGGFNEQCAKAFCLALMRIALAENRRCYIMLFSTEIVRYELSGPQGIEQAIRFLSQQFRGGTDLASCFRAIMERLQSREWFDADAVVISDFIAQRLPDDVTSKVKELQRVHQHRFHAVAMSAHGKPGIMRIFDHIWRFDTGMRSRLLRRWRR

SEQ ID NO: 8667 - DNA, 1521 bp, Escherichia coli
ttgacgaaaggacgccacttcattatggctcaccctcatttattagcggaaagaatttcccgcctgagcagttcgttggaaaaggggctttatgaacgtagccacgccatccgcttgtgtttattagcggcattaagtggtgaaagtgtgttcctccttggcccaccaggtattgccaaaagtttgatcgcccggcgcttaaaattcgcctttcagaatgcccgcgcgtttgaatatctgatgacccgcttctccacgccggaagaagtttttggtcccctttctattcaggcgctaaaagatgaagggcgctatgaacgtttaaccagcggttacctgccggaagctgaaatcgtctttctggatgagatctggaaagcgggtccggcaattcttaataccctgctcaccgccattaacgagcgccagttccgcaacggcgcactcgtagaaaaaatcccgatgcgtctgctggtggcggcctccaacgagctgccggaagcagacagcagtctggaagcgttatatgaccgcatgctgattcgtctgtggttagataaagtgcaggataaagcgaatttccgctccatgctgaccagtcaacaggatgaaaatgacaatccggttcctgcctccttgcagatcacagatgaagaatatgaacgctggcagaaagagattggtgaaattacgctgcccgatcatgtatttgagctgatttttatgctgcgccagcaactggataaattaccggatgcgccttatgtctcggatcgtcgctggaaaaaagcgatccgcttattgcaggccagcgccttttttagcggtcgcagtgctgtcgccccggttgatctcattttgctgaaagattgcctgtggtatgacgcgcaaagcctgaatttgatacaacaacaaattgatgtattgatgaccggtcacgcctggcaacagcaagggatgttgacccgcctgggcgcgattgtgcaacgtcacctgcaacttcagcagcaacaaagcgataaaacagccttaacggtaattcgtctgggcggcatttttagccgtcgtcagcagtatcaactccctgttaacgttactgcttccactctgactctgctgctgcaaaaaccgttaaaactgcatgatatggaagtggttcatatctcctttgagcgtagcgcgctggaacagtggctgagtaaaggtggtgagattcgcggcaaactgaacggtatcggctttgcccagaaactgaatctggaagtcgatagcgcccaacatcttgttgtacgcgatgtaagtttacaaggcagtacgctagcacttccaggttcatcggctgaaggtctgccaggtgaaataaaacaacaactggaagagcttgaaagcgactggcgcaagcaacacgctttattcagcgaacagcaaaaatgtctgtttatccctggcgactggttaggtcgcattgaagccagcctacaggatgtcggcgcacagattcgccaggcacaacaatgctaa

SEQ ID NO: 8668 - protein, 506 aa, Escherichia coli
MTKGRHFIMAHPHLLAERISRLSSSLEKGLYERSHAIRLCLLAALSGESVFLLGPPGIAKSLIARRLKFAFQNARAFEYLMTRFSTPEEVFGPLSIQALKDEGRYERLTSGYLPEAEIVFLDEIWKAGPAILNTLLTAINERQFRNGALVEKIPMRLLVAASNELPEADSSLEALYDRMLIRLWLDKVQDKANFRSMLTSQQDENDNPVPASLQITDEEYERWQKEIGEITLPDHVFELIFMLRQQLDKLPDAPYVSDRRWKKAIRLLQASAFFSGRSAVAPVDLILLKDCLWYDAQSLNLIQQQIDVLMTGHAWQQQGMLTRLGAIVQRHLQLQQQQSDKTALTVIRLGGIFSRRQQYQLPVNVTASTLTLLLQKPLKLHDMEVVHISFERSALEQWLSKGGEIRGKLNGIGFAQKLNLEVDSAQHLVVRDVSLQGSTLALPGSSAEGLPGEIKQQLEELESDWRKQHALFSEQQKCLFIPGDWLGRIEASLQDVGAQIRQAQQC

SEQ ID NO: 8669 - DNA, 1869 bp, Escherichia coli
atgagcactgataataagcaatcattgcccgcgattaccctcgcggcgattggagttgtctacggcgatattggtaccagcccgttatatacacttcgtgaatgtttgtccggccagtttggttttggcattgaacgcgatgccgtgtttggctttttatcgctgatcttctggctgctaatctttgtggtttccattaaatatctcaccttcgtgatgcgggcagataacgccggtgaaggggggatcctgacgttgatgtcgcttgccgggcgtaatacgtcggcgcgaaccacatcaatgctggtgattatggggctaatcggcggcagctttttctatggtgaagtcgtcattactcccgctatttcggtgatgtccgccattgaaggtctggaaatcgtcgccccgcagctggatacctggatagttcccctctcaattatcgttctcacattattattcatgattcaaaaacatggcacggctatggtcggtaagctgtttgcgccgatcatgctgacctggtttttgattctggcagggctggggttacgtagcattattgctaacccggaagtgctgcatgcactgaatccgatgtgggcggtgcatttcttccttgaatacaaaacggtttcttttattgcattaggggcagtggtgctgtcgattacgggggtcgaggcgctgtatgctgatatggggcactttggtaagttccctattcgtctggcgtggttcaccgtcgtattgccttccttaacccttaattacttcggccagggagcgctgttgttaaagaatccggaagcgattaagaacccgttcttcctgttggcaccggactgggcgctgatcccgctgctgatcatcgccgcactggcgacggtaattgcctcgcaggcggttatctctggcgtcttctcattgacgcgtcaggcggtacgtctgggatatttgtcgccgatgcgcattattcacacttccgaaatggagtcagggcaaatctatattccctttgtgaactggatgctctatgtcgcggtcgtgattgtgattgtcagctttgagcactccagcaacctggcggcggcgtacgggattgcggtgaccggaaccatggtgctgacgtctattctctcgactaccgtggcacgtcagaactggcactggaataagtattttgttgcgctgatcctgattgctttcctttgtgtcgatattcccttgttcaccgctaacctcgataaactgctctccggcggctggttgccattgagcctcggtacggtgatgtttatcgtgatgaccacctggaagagcgagcgtttccgcttgctgcggcggatgcatgaacatggtaactctctggaagcgatgattgcttcgctggagaaatcaccgcccgttcgcgtgcctgggaccgcggtgtatatgtcgcgtgcaatcaacgtcattccctttgcgctgatgcataacctgaaacataacaaggtattgcatgagcgggtgattctgttaactctgcgcaccgaagacgcgccatatgtccataacgtccgtcgggtacagattgaacaactgtcgcccactttctggcgcgtggtggcaagttatggttggcgagaaacgccaaacgtggaagaagttttccaccgctgcggtctggaaggattaagttgccggatgatggaaacctccttctttatgtcgcatgagtcgttgatcctcggcaaacgcccgtggtatttgcgtctgcgcggcaagctgtacttgctgctgcaacgtaatgcgctgcgggcaccggatcaatttgaaatcccgccaaacagagttatcgaactgggtactcaggtcgaaatctaa

SEQ ID NO: 8670 - protein, 622 aa, Escherichia coli
MSTDNKQSLPAITLAAIGVVYGDIGTSPLYTLRECLSGQFGFGIERDAVFGFLSLIFWLLIFVVSIKYLTFVMRADNAGEGGILTLMSLAGRNTSARTTSMLVIMGLIGGSFFYGEVVITPAISVMSAIEGLEIVAPQLDTWIVPLSIIVLTLLFMIQKHGTAMVGKLFAPIMLTWFLILAGLGLRSIIANPEVLHALNPMWAVHFFLEYKTVSFIALGAVVLSITGVEALYADMGHFGKFPIRLAWFTVVLPSLTLNYFGQGALLLKNPEAIKNPFFLLAPDWALIPLLIIAALATVIASQAVISGVFSLTRQAVRLGYLSPMRIIHTSEMESGQIYIPFVNWMLYVAVVIVIVSFEHSSNLAAAYGIAVTGTMVLTSILSTTVARQNWHWNKYFVALILIAFLCVDIPLFTANLDKLLSGGWLPLSLGTVMFIVMTTWKSERFRLLRRMHEHGNSLEAMIASLEKSPPVRVPGTAVYMSRAINVIPFALMHNLKHNKVLHERVILLTLRTEDAPYVHNVRRVQIEQLSPTFWRVVASYGWRETPNVEEVFHRCGLEGLSCRMMETSFFMSHESLILGKRPWYLRLRGKLYLLLQRNALRAPDQFEIPPNRVIELGTQVEI

SEQ ID NO: 8671 - DNA, 420 bp, Escherichia coli
atgaaaaaaggcaccgttcttaattctgatatttcatcggtgatctcccgactgggacataccgatacgctggtggtgtgtgatgctggtttacccatccccaaaagtacaacgcgtatcgatatggcattaacccagggtgtaccttcttttatgcaggtgctgggtgtagtcacaaatgaaatgcaggtcgaggctgtcattatcgcggaagagatcaaacaacataatccgcaactccacgaaacgttgctcactcaccttgagcagctgcaaaaacaccagggaaacaccattgaaattcgttacaccacgcatgaacaattcaaacaacaaaccgcaggaagtcaggcggtaattcgcagcggagaatgttctccgtatgcgaatatcattctctgtgctggcgtgacgttctga

SEQ ID NO: 8672 - protein, 139 aa, Escherichia coli
MKKGTVLNSDISSVISRLGHTDTLVVCDAGLPIPKSTTRIDMALTQGVPSFMQVLGVVTNEMQVEAVIIAEEIKQHNPQLHETLLTHLEQLQKHQGNTIEIRYTTHEQFKQQTAGSQAVIRSGECSPYANIILCAGVTF

SEQ ID NO: 8673 - DNA, 1506 bp, Escherichia coli
atggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggtatctatactcgcgatgccggtacgcttttatggttggggaaagaaacgacatttaccgggccgaaatcttcccaggaagccgggattgggattatccaccaggaactgaacctgatcccgcagttaaccattgccgaaaacattttcctcggtcgtgagtttgttaatcgctttggcaaaattgactggaaaaccatgtatgccgaagcggataaattgctggctaaacttaacctgcgctttaaaagcgacaaactggtgggcgatctttccatcggtgaccagcaaatggttgaaatcgccaaagtgctgagctttgagtcgaaagtcatcattatggatgaaccgaccgatgcgctgaccgataccgaaaccgaatccttgttccgcgtcatccgcgagctgaaatcgcaaggccgcggtattgtctatatctcccaccgcatgaaagaaatcttcgagatttgcgatgacgttaccgtttttcgtgacggacaatttattgctgagcgcgaagtggcatcactgaccgaagattctctgattgagatgatggtgggccgcaagctggaagatcaatatccgcacctgaacaaagcgccgggagatatccgcctgaaagtcgataatctctgcggacctggcgttaacgatgtctcttttactttacgcaaaggcgaaattcttggcgtctctggtttgatgggcgctgggcgtaccgaactgatgaaagtgctctacggtgcactgccgcgcacaagcggttacgtcaccctggatgggcatgaagtcgttacccgttcgccgcaggatggcctggcaaacggcattgtttatatctccgaagaccgtaaacgtgacggtttagtgctgggcatgtcagtaaaagagaacatgtcgctgaccgcgctgcgctacttcagccgcgctggcggcagtttgaagcatgccgatgaacagcaggctgtgagtgatttcattcgtctgtttaatgtgaaaacgccatcgatggaacaggcaattggtctgctttccggtggcaatcagcaaaaagtagcgattgcccgtggtctgatgacacgccctaaagtgttgatcctcgatgagcctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 8674 - protein, 501 aa, Escherichia coli
MEALLQLKGIDKAFPGVKALSGAALNVYPGRVMALVGENGAGKSTMMKVLTGIYTRDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFEICDDVTVFRDGQFIAEREVASLTEDSLIEMMVGRKLEDQYPHLNKAPGDIRLKVDNLCGPGVNDVSFTLRKGEILGVSGLMGAGRTELMKVLYGALPRTSGYVTLDGHEVVTRSPQDGLANGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 8675 - DNA, 966 bp, Escherichia coli
atgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattcttcagcaaacctcggtgaacgccattatggcggtcgggatgacgctggtgatcctgacgtcgggtatcgacttgtcggtaggttctctgttggcgctgaccggcgcagttgctgcatctatcgtcggcattgaagtcaatgcgctggtggctgtcgctgccgctctcgcgttaggtgccgcaattggtgcggtaactggggtgattgtagcgaaaggtcgcgtccaggcgtttatcgctacgctggttatgatgcttttactgcgcggcgtgaccatggtttataccaatggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaatgaagcggcaacgcgtctttctggtatcaacgtcaataaaatcaaaatcatcgtctattctctttgtggtctgctggcatcgctggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaa

SEQ ID NO: 8676 - protein, 321 aa, Escherichia coli
MTTQTVSGRRYFTKAWLMEQKSLIALLVLIAIVSTLSPNFFTINNLFNILQQTSVNAIMAVGMTLVILTSGIDLSVGSLLALTGAVAASIVGIEVNALVAVAAALALGAAIGAVTGVIVAKGRVQAFIATLVMMLLLRGVTMVYTNGSPVNTGFTENADLFGWFGIGRPLGVPTPVWIMGIVFLAAWYMLHHTRLGRYIYALGGNEAATRLSGINVNKIKIIVYSLCGLLASLAGIIEVARLSSAQPTAGTGYELDAIAAVVLGGTSLAGGKGRIVGTLIGALILGFLNNGLNLLGVSSYYQMIVKAVVILLAVLVDNKKQ

SEQ ID NO: 8677 - DNA, 897 bp, Escherichia coli
ttgaatatgaacatgaaaaaactggctaccctggtttccgctgttgcgctaagcgccaccgtcagtgcgaatgcgatggcaaaagacaccatcgcgctggtggtctccacgcttaacaacccgttctttgtatcgctgaaagatggcgcgcagaaagaggcggataaacttggctataacctggtggtgctggactcccagaacaacccggcgaaagagctggcgaacgtgcaggacttaaccgtccgcggcaccaaaattctgctgattaacccgaccgactccgacgcagtaggtaatgctgtgaagatggctaaccaggcgaacatcccggttatcactcttgaccgccaggcaacgaaaggtgaagtggtgagccacattgcatctgataacgtactgggcggcaaaatcgccggtgattacatcgcgaagaaagcgggtgaaggtgccaaagttatcgagctgcaaggcattgccggtacatccgcagcccgtgaacgtggcgaaggtttccagcaggccgttgctgctcacaagtttaatgttcttgccagccagcctgcagattttgatcgcaccaaaggtttgaacgtaatgcagaacctgttgaccgctcatccggatgttcaggctgtattcgcgcagaatgatgaaatggcgcttggcgcgctgcgcgcactgcaaactgccggtaaatcggatgtgatggtcgtcggatttgacggtacaccggatggcgaaaaagcggtgaatgatggcaaactagcagcgactatcgctcagctacccgatcagattggcgcgaaaggcgtcgaaaccgcagataaagtgctgaaaggcgagaaagttcaggctaagtatccggttgatctgaaactggttgttaagcagtag

SEQ ID NO: 8678 - protein, 298 aa, Escherichia coli
MNMNMKKLATLVSAVALSATVSANAMAKDTIALVVSTLNNPFFVSLKDGAQKEADKLGYNLVVLDSQNNPAKELANVQDLTVRGTKILLINPTDSDAVGNAVKMANQANIPVITLDRQATKGEVVSHIASDNVLGGKIAGDYIAKKAGEGAKVIELQGIAGTSAARERGEGFQQAVAAHKFNVLASQPADFDRTKGLNVMQNLLTAHPDVQAVFAQNDEMALGALRALQTAGKSDVMVVGFDGTPDGEKAVNDGKLAATIAQLPDQIGAKGVETADKVLKGEKVQAKYPVDLKLVVKQ

SEQ ID NO: 8679 - DNA, 957 bp, Escherichia coli
gtggcgcattttatggacatcccgaatatgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaagctgtggctgctgggcgtagcggtgcgaataccgcgtttattgcctgtacgggtgatgacagcattggcgagagcgtacgtcagcagctcgccactgataacatcgatatttctccggtcagcgtgatcaaaggcgaatcaacaggtgtggcgctgatttttgttaatggtgaaggtgagaatgtcatcggtattcatgccggcgctaatgctgccctttccccggcgctggtggaagcgcaacgtgagcgtattgccaacgcgtcggcattattaatgcagctggaatcaccactcgaaagtgtgatggcagcggcgaaaatcgcccatcaaaataagactatcgttgcgcttaacccggctccggctcgcgaacttcctgacgaacttctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgataccattgctgccggagatacctttaacggcgcgttaatcacggcgttgctggaagaaaaaccattgccagaggcgattcgttttgcccatgcagccgctgcgattgccgtaacacgtaaaggcgcacaaccttccgtaccgtggcgtgaagagatcgacgcatttttagacaggcagaggtga

SEQ ID NO: 8680 - protein, 318 aa, Escherichia coli
MAHFMDIPNMQNAGSLVVLGSINADHILNLQSFPTPGETVTGNHYQVAFGGKGANQAVAAGRSGANTAFIACTGDDSIGESVRQQLATDNIDISPVSVIKGESTGVALIFVNGEGENVIGIHAGANAALSPALVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 8681 - DNA, 873 bp, Escherichia coli
atgcccaatttcatcaccgcacgacgcagattcgataccactggctttttgctgtttggcctcagccttgttctcttctcaagcggaatagagctattcggggaaaagattgtcgccagctggattgccttgacggtaattgtcaccagcatcgggttactgcttctctatattctccatgcgcgacgcacgccaaacccattaatttcattagatttatttaaaacccgcactttctcgatcggtatcgtaggcaatattgcaacccgtctgggaaccggctgtgtaccgttccttatgccattgatgttacaggtaggatttgggtatcaggcgtttattgctggctgtatgatggcaccgacagcgttaggttccattattgcaaaatcgatggttacccaagtcttacgtcgtctgggctatcgccatacgttagtggggatcacggtgattatagggctaatgatcgctcagttctctttgcaatcaccagcaatggcgatatggatgctgatcttgccgttgtttatattagggatggctatgtcgacacaatttaccgcgatgaataccatcacacttgccgatctgaccgatgacaacgccagcagcggtaacagtgttctggcggtcacgcagcaactgtctatcagtttaggcgttgctgtaagtgcggccgtccttcgcgtttacgaagggatggaaggcacaacgacagtcgaacaattccactatacgtttatcacgatgggcattattactgttgcttcagcagcaatgttcatgctactgaaaacaaccgatggtaataatttgatcaaaagacagcgtaaatctaagccgaaccacgttccatcagaatcggagtaa

SEQ ID NO: 8682 - protein, 290 aa, Escherichia coli
MPNFITARRRFDTTGFLLFGLSLVLFSSGIELFGEKIVASWIALTVIVTSIGLLLLYILHARRTPNPLISLDLFKTRTFSIGIVGNIATRLGTGCVPFLMPLMLQVGFGYQAFIAGCMMAPTALGSIIAKSMVTQVLRRLGYRHTLVGITVIIGLMIAQFSLQSPAMAIWMLILPLFILGMAMSTQFTAMNTITLADLTDDNASSGNSVLAVTQQLSISLGVAVSAAVLRVYEGMEGTTTVEQFHYTFITMGIITVASAAMFMLLKTTDGNNLIKRQRKSKPNHVPSESE

SEQ ID NO: 8683 - DNA, 993 bp, Escherichia coli
ttggctacaatgaaagatgttgcccgcctggcgggcgtttctacctcaacagtttctcacgttatcaataaagatcgcttcgtcagtgaagcgattacagccaaagttgaagcggcgattaaagaactcaattacgcgccatcagctctggcgcgtagcctcaaactcaatcaaacacataccattggcatgttgatcactgccagtaccaatcctttctattcagaactggtgcgtggcgttgaacgcagctgcttcgaacgcggttatagtcttgtcctttgcaataccgaaggcgatgaacagcggatgaatcgtaatctggaaacgctgatgcaaaaacgcgttgatggcttgctgttactgtgcaccgaaacgcatcagccttcgcgtgaaatcatgcaacgttatccgacagtgcctaccgtgatgatggactgggctccgttcgatggcgacagcgatcttattcaggataactcgttgctgggcggagacttagcaacgcaatatctgatcgataaaggtcatacccgtattgcctgtattaccggtccgctggataaaactccggcgcgcctgcggttggaaggttatcgggcggcgatgaaacgtgcgggtctcaacattcctgatggctatgaagtcactggtgattttgaatttaacggcgggtttgacgccatgcgccaactgttatcacatccgctgcgtcctcaggctgtctttaccggaaatgacgctatggctgttggcgtttaccaggcgttatatcaggcagagttacaggttccgcaggatatcgcggtgattggctatgacgatatcgaactggcaagctttatgacgccaccattaacaactatccaccaaccgaaagatgaactgggggagctggcgattgatgtactcatccatcggataacccagccggccctacagcaacaacgattacaacttactccgattctgatggaacgtggttcggcttag

SEQ ID NO: 8684 - protein, 330 aa, Escherichia coli
MATMKDVARLAGVSTSTVSHVINKDRFVSEAITAKVEAAIKELNYAPSALARSLKLNQTHTIGMLITASTNPFYSELVRGVERSCFERGYSLVLCNTEGDEQRMNRNLETLMQKRVDGLLLLCTETHQPSREIMQRYPTVPTVMMDWAPFDGDSDLIQDNSLLGGDLATQYLIDKGHTRIACITGPLDKTPARLRLEGYRAAMKRAGLNIPDGYEVTGDFEFNGGFDAMRQLLSHPLRPQAVFTGNDAMAVGVYQALYQAELQVPQDIAVIGYDDIELASFMTPPLTTIHQPKDELGELAIDVLIHRITQPALQQQRLQLTPILMERGSA

SEQ ID NO: 8685 - DNA, 459 bp, Escherichia coli
atggcgggtttgccgtggatcgcggcgatggccttcttcatgcaggcacttgatgccactattctgaataccgccttacccgcaatcgctcatagccttaatcgttctcctctcgcgatgcaatcagccatcatcagttatacgctgacggtggcgatgcttattccggtaagcggatggctagccgatcgcttcggtacacgtcgcatttttacccttgccgtgagtctgttcacgttgggttctctggcctgcgcactttccaactcgctaccacagctggttgtcttccgggttattcaggggataggcggcgcaatgatgatgcctgttgctcggctggccttactgcgcgcttatcctcgtaatgaacttcttcctgtattgaattttgtcgccatgccgggtctggtggggccaattttaggccccgttcttggcggcgtgctggtcacctag

SEQ ID NO: 8686 - protein, 152 aa, Escherichia coli
MAGLPWIAAMAFFMQALDATILNTALPAIAHSLNRSPLAMQSAIISYTLTVAMLIPVSGWLADRFGTRRIFTLAVSLFTLGSLACALSNSLPQLVVFRVIQGIGGAMMMPVARLALLRAYPRNELLPVLNFVAMPGLVGPILGPVLGGVLVT

SEQ ID NO: 8687 - DNA, 693 bp, Escherichia coli
atgcctttaagcgcacaacagttagctgcacagaaaaacctttcgtatgttctggctgagaagctggcgcagcggatcttaaaaggtgaatatgaacccggcaccattttgcctggtgagattgagctgggcgagcaatttggagtgagtcgtacagcggtacgcgaagcggtcaaaacgttaacggcaaaagggatggttttaccgcgaccgcgaattggtacccgagtcatgccacaatcgaactggaattttcttgatcaggaattgcttacctggtggatgacagaagagaactttcatcaggtcatcgatcactttctggttatgcgtatctgtctggagccgcaagcttgcctactggcagcaaaggttggcaccgcggaacagaaggcgcatctcaatacgttaatggccgaaatggcggcattaaaagagaactttcgccgtgaacgctggatcgaagtcgatatggcctggcatgagcatatctatgaaatgagcgccaatccgtttttgacctcattcgcctcgctattccattcggtttatcacacttacttcacgtcaattaccagcgacacagtgataaagctggatctgcaccaggcgattgtcgatgcgattatccaaagcgatggcgacgcggcatttaaagcttgtcaggcgctgctacgctcaccagataagtga

SEQ ID NO: 8688 - protein, 230 aa, Escherichia coli
MPLSAQQLAAQKNLSYVLAEKLAQRILKGEYEPGTILPGEIELGEQFGVSRTAVREAVKTLTAKGMVLPRPRIGTRVMPQSNWNFLDQELLTWWMTEENFHQVIDHFLVMRICLEPQACLLAAKVGTAEQKAHLNTLMAEMAALKENFRRERWIEVDMAWHEHIYEMSANPFLTSFASLFHSVYHTYFTSITSDTVIKLDLHQAIVDAIIQSDGDAAFKACQALLRSPDK

SEQ ID NO: 8689 - DNA, 126 bp, Escherichia coli; identical to SEQ ID NO: 637

SEQ ID NO: 8690 - protein, 41 aa, Escherichia coli; identical to SEQ ID NO: 638

SEQ ID NO: 8691 - DNA, 840 bp, Escherichia coli
gtggatacggaattgttaaaaactttcctggaagttagccgaacgcgtcactttggtcgagcggctgaatcgctctatctgacccaatcagccgtgagctttcgaatcagacaactggaaaatcaactgggtgtgaatcttttcacccgccacagaaacaatatccgtttaaccgctgccggagaaaagcttctgccttatgcagaaacgctcatgagcacctggcaggccgcccgcaaggaggtggcgcatacctcacgacataatgagttttctatcggtgccagcgcctcgctgtgggagtgtatgcttaatcagtggctgggacgcttgtatcaaaatcaggatgtccatacaggcttacagttcgaagcgcgaattgcccaacggcagtctctggtaaaacagttgcatgaacgccagcttgatcttcttattacaactgaagcccccaaaatggacgaattttgtagtcagttgctggggtatttcactttagcgctttataccagtgccccttctaaactaaagggagatcttaactatctgcgactagagtgggggccagattttcaacagcatgaggcaggtttgatcggtgctgacgaagttcccattctgacaaccagttctgctgaactggcacagcaacagattgcgatgcttaatggttgcacctggctacccgtcagttgggcacgtaaaaaaggcggcctgcataccgttgtcgatagcacaacactttcacggccgctttatgccatatggctacaaaatagcgataaaaatgcgttgattcgcgatctattgaaaattaacgtgctggatgaagtgtattaa

SEQ ID NO: 8692 - protein, 279 aa, Escherichia coli
MDTELLKTFLEVSRTRHFGRAAESLYLTQSAVSFRIRQLENQLGVNLFTRHRNNIRLTAAGEKLLPYAETLMSTWQAARKEVAHTSRHNEFSIGASASLWECMLNQWLGRLYQNQDVHTGLQFEARIAQRQSLVKQLHERQLDLLITTEAPKMDEFCSQLLGYFTLALYTSAPSKLKGDLNYLRLEWGPDFQQHEAGLIGADEVPILTTSSAELAQQQIAMLNGCTWLPVSWARKKGGLHTVVDSTTLSRPLYAIWLQNSDKNALIRDLLKINVLDEVY

SEQ ID NO: 8693 - DNA, 339 bp, Escherichia coli
atggcggaaagctttacgacgactaatcgatatttcgacaataaacattatccacgtggattctctcgtcatggtgacttcaccatcaaagaggcacaactgcttgagcgtcatggttatgccttcaatgagttggatcttggcaaacgcgagccggttaccgaggaagagaaactcttcgtagcagtatgccgtggcgaacgtgaaccagtgacagaagcagaacgcgtgtggtccaagtatatgacgcgtatcaagcgtccaaaacgttttcacaccctttccggcggtaaaccgcaggttgaaggtgctgaagactacaccgattctgacgattaa

SEQ ID NO: 8694 - protein, 112 aa, Escherichia coli
MAESFTTTNRYFDNKHYPRGFSRHGDFTIKEAQLLERHGYAFNELDLGKREPVTEEEKLFVAVCRGEREPVTEAERVWSKYMTRIKRPKRFHTLSGGKPQVEGAEDYTDSDD

SEQ ID NO: 8695 - DNA, 1521 bp, Escherichia coli
atgtcactgtcaattgttcatacccgcgcagccctgggagtaaatgcgcccccaatcactgttgaggtacatatcagtaaaggtctaccaggcttaacgatggtgggcttaccagaaacaacggtaaaagaagctcgcgatcgcgtgcgcagcgccattatcaatagcggatatgaatatccggcgaaaaaaatcaccatcaaccttgctccagccgatctgccaaaagaagggggacgatatgatttgcctatcgctattgcgttactggcggcctcagaacagcttacagccaataagttagatgaatatgaattagtcggagaactggcgcttacaggcgctctgcgtggcgttcccggcgcaatctccagtgcaactgaagctattaagtcgggcagaaaaattatcgtcgcgaaagataacgaagatgaagtggggctaattaacggtgaaggatgcctgatagccgatcatctgcaggctgtctgcgcgtttctggaaggtaagcacgctctcgaacacccgaaaccaactaatgcagtatcccgggcgctacaacatgatctcagtgatgttgtcggtcaggagcaaggaaagcgaggactggaaattaccgccgctggcgggcacaaccttttactgattggaccgccgggaacaggtaaaacaatgctcgccagccgtattaatggccttttgccagatttaagcaatgaagaggcactggagagcgctgcgatattaagtctggtaaatgctgaatcagtacaaaaacaatggcggcagcgcccgttccgctcacctcatcacagtgcgtcgttaactgcgatggtgggcggtggtgcaattccagggccaggtgaaatttcgctggcgcataacggcgtgctttttcttgatgagctacctgaatttgaacggcgtacactggatgccttgcgagagccgattgaatccgggcagatccatctttcacgcacacgagcaaaaataacctatccagcccgtttccagcttgtcgcggcaatgaatcccagccctaccggacattatcagggaaaccataaccgctgcacaccagaacagacattacgttatctcaaccggctctcggggccctttctcgaccgcttcgatctctcactggagatcccattaccgccccccggcattttgagtaaaacggtagtgccgggagaaaacagcaccaccgttaaacaacgtgtaatggccgccagagagcgccaatttaagcggcagaataaactgaacgcctggctggataatccggaaatacgccaattctgcaagcttgaaagcgaagatgcgcagtggctggaagaaacgctgatccatctggggttatcgattcgtgcctggcagcggttattgaaagttgcacgaaccattgctgatattgatcagtctgacattatcacacgtcagcatttgcaggaggcagttagctatcgtgcgattgaccgtttgctcatccatctgcaaaaactactgacataa

SEQ ID NO: 8696 - protein, 506 aa, Escherichia coli
MSLSIVHTRAALGVNAPPITVEVHISKGLPGLTMVGLPETTVKEARDRVRSAIINSGYEYPAKKITINLAPADLPKEGGRYDLPIAIALLAASEQLTANKLDEYELVGELALTGALRGVPGAISSATEAIKSGRKIIVAKDNEDEVGLINGEGCLIADHLQAVCAFLEGKHALEHPKPTNAVSRALQHDLSDVVGQEQGKRGLEITAAGGHNLLLIGPPGTGKTMLASRINGLLPDLSNEEALESAAILSLVNAESVQKQWRQRPFRSPHHSASLTAMVGGGAIPGPGEISLAHNGVLFLDELPEFERRTLDALREPIESGQIHLSRTRAKITYPARFQLVAAMNPSPTGHYQGNHNRCTPEQTLRYLNRLSGPFLDRFDLSLEIPLPPPGILSKTVVPGENSTTVKQRVMAARERQFKRQNKLNAWLDNPEIRQFCKLESEDAQWLEETLIHLGLSIRAWQRLLKVARTIADIDQSDIITRQHLQEAVSYRAIDRLLIHLQKLLT

SEQ ID NO: 8697 - DNA, 99 bp, Escherichia coli
gtgcaaaggatgaactacgaggaagggaacaacattcatactgaaattgaatttttttcactcactattttctttttaaaaaacaacaatttctcttga

SEQ ID NO: 8698 - protein, 32 aa, Escherichia coli
MQRMNYEEGNNIHTEIEFFSLTIFFLKNNNFS

SEQ ID NO: 8699 - DNA, 1647 bp, Escherichia coli
atgaatggcgcacagtgggtggtacatgcgttgcgggcacagggtgtgaacaccgttttcggttatccgggtggcgcaattatgccggtttacgatgcattgtatgacggtggcgtggaacacttgctgtgccgacacgagcaaggtgcagcaatggcggctatcggttatgcccgtgctaccggcaaaactggcgtttgcatcgccacgtctggtccaggtgcaaccaacctgataaccgggcttgcggacgcgctgttagattccatccccgttgttgctatcaccggtcaggtatccgcaccgtttatcggcactgacgcatttcaggaggtggatattctggggttgtcgttagcctgcaccaagcacagtttcctggtgcaatcactggaagagttaccgcgtatcatggccgaagcgtttgacgtcgccagctctggtcgtcctggtccggttttggtcgatattccaaaagatatccagttagccagcggcgatctggaaccgtggttcaccactgttgaaaacgaagtgactttctcacatgccgaagtcgagcaagcgcgtcagatgctggcaaaagcgcaaaaaccgatgctgtacgttggcggtggcgtgggcatggcgcaggcagtttcggctttgcgtgaatttctcgctgccacaaaaatgcctgccacctgtacgttgaaagggctgggcgcagtagaagcagattatccgtactatctgggcatgctggggatgcacggcaccaaagcggcgaacttcgcagtgcaggagtgcgatctactgatcgccgtgggcgcacgttttgatgaccgggtgaccggcaaactgaacaccttcgcaccacacgccagcgttatccatatggatatcgatccggcagaaatgaacaagctgcgtcaggcacatgtggcattacagggtgatttaaatgctctgttaccagcattacagcagccgttaaatatcgatgactggcagcaacactgcgcgcaactgcgtgatgaacatgcctggcgttacgaccatcctggtgacgctatctacgcgccgttgttgttaaaacaactgtcggatcgtaaatctgcggattgcatcgtgaccacagatgtggggcagcaccagatgtgggctgcccagcacatcgtccacactcgcccggaaaacttcatcacctccagcggcttaggcaccatgggtttcggtttaccggcggcggttggcgcacaagtcgcgcgaccgaacgatactgtcgtctgtatctccggtgacggctctttcatgatgaatgtgcaagaactgggcaccgtaaaacgcaagcagttaccgttgaaaatcgtcttactcgataaccaacggttagggatggttcgacaatggcagcaactgtttttccaggaacgatacagcgaaactacccttaccgataaccccgatttcctcatgttagccagcgccttcggcatccctggccaacacatcacccataaagaccaggttgaagcggcactcgacaccatgctgaacagtgatgggccatacctgcttcatgtctcaatcgacgaacttgagaacgtctggccgctggtgccgcctggtgccagtaattctgaaatgttggagaaattatcatga

SEQ ID NO: 8700 - protein, 548 aa, Escherichia coli
MNGAQWVVHALRAQGVNTVFGYPGGAIMPVYDALYDGGVEHLLCRHEQGAAMAAIGYARATGKTGVCIATSGPGATNLITGLADALLDSIPVVAITGQVSAPFIGTDAFQEVDILGLSLACTKHSFLVQSLEELPRIMAEAFDVASSGRPGPVLVDIPKDIQLASGDLEPWFTTVENEVTFSHAEVEQARQMLAKAQKPMLYVGGGVGMAQAVSALREFLAATKMPATCTLKGLGAVEADYPYYLGMLGMHGTKAANFAVQECDLLIAVGARFDDRVTGKLNTFAPHASVIHMDIDPAEMNKLRQAHVALQGDLNALLPALQQPLNIDDWQQHCAQLRDEHAWRYDHPGDAIYAPLLLKQLSDRKSADCIVTTDVGQHQMWAAQHIVHTRPENFITSSGLGTMGFGLPAAVGAQVARPNDTVVCISGDGSFMMNVQELGTVKRKQLPLKIVLLDNQRLGMVRQWQQLFFQERYSETTLTDNPDFLMLASAFGIPGQHITHKDQVEAALDTMLNSDGPYLLHVSIDELENVWPLVPPGASNSEMLEKLS

SEQ ID NO: 8701 - DNA, 264 bp, Escherichia coli
atgatgcaacatcaggtcaatgtatcggctcgcttcaatccggaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgctatctgccagagcacaaccacatcacaacaaatccgcgcctga

SEQ ID NO: 8702 - protein, 87 aa, Escherichia coli
MMQHQVNVSARFNPETLERVLRVVRHRGFHVCSMNMAAASDAQNINIELTVASPRSVDLLFSQLNKLVDVAHVAICQSTTTSQQIRA

SEQ ID NO: 8703 - DNA, 855 bp, Escherichia coli
atgtcgcacgcgctgcactatggcacctcggtttttgaaggcatccgttgctacgactcgcacaaaggaccggttgtattccgccatcgtgagcatatgcagcgtctgcatgactccgccaaaatctatcgtttcccggtttcgcagagcattgatgagctgatggaagcttgtcgcgacgtgatccgcaaaaacaatctcaccagcgcctatatccgtccgctgattttcgtcggtgatgttggcatgggcgtaaacccgccagcgggatactcaaccgatgtgattatcgccgctttcccgtggggggcgtatctgggcgcagaagcgctggagcaggggatcgatgcgatggtttcctcctggaaccgtgctgcaccaaacaccatcccaaccgcagcgaaagctggaggtaactacctctcttccctgttggtgggtagcgaagcgcgccgccacggttatcaggaaggtatcgcattggatgtgaatggttatatctctgaaggcgcaggagaaaacctgtttgaagtgaaagacggtgtgctgttcactccaccgttcacctcctccgcgctgccgggtattacccgtgatgccatcatcaaactggcgaaagagctgggaattgaagtgcatgaacaggtgctgtcgcgcgaatccctgtacctggcggatgaagtctttatgtccggtacggcggcagaaatcacgccagtgcgcagtgtagatggtattcaggttggtgaaggccgttgcggcccggttaccaaacgcattcagcaagccttcttcggcctcttcactggcgagaccgaagataaatggggctggttagatcaagttaatcaataa

SEQ ID NO: 8704 - protein, 284 aa, Escherichia coli
MSHALHYGTSVFEGIRCYDSHKGPVVFRHREHMQRLHDSAKIYRFPVSQSIDELMEACRDVIRKNNLTSAYIRPLIFVGDVGMGVNPPAGYSTDVIIAAFPWGAYLGAEALEQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVHEQVLSRESLYLADEVFMSGTAAEITPVRSVDGIQVGEGRCGPVTKRIQQAFFGLFTGETEDKWGWLDQVNQ

SEQ ID NO: 8705 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctacgcgatctcggtaaactggttgccgaacaaattgaagcggctggcggcgttgccaaagagttcaacaccattgcggtggatgatgggatcgctatgggccacgggggcatgctttattcactgccatctcgcgaactgatcgctgattccgttgaatatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactgtccgatcagatcattaagctcgatctggttgatgcgatgatccagggcgcagacccgaaagtttctgactcccagagcgatcaggttgaacgatccgcctgcccaacctgcggttcctgctccgggatgtttactgctaactcaatgaactgcctgaccgaagcgctgggcctgtcgcagccgggcaacggctcgctgctggcaacccacgctgatcgcaagcaactgttcctcaatgctggtaaacgcattgttgaattgaccaaacgttactacgaacaggatgatgaaagcgcactgccgcgtaacatcgccagtaaggcggcgtttgaaaacgccatgacgctggatatcgcgatgggcggctctaccaacaccgttctccacctgctggcggcggcgcaggaagcggaaatcgacttcaccatgagtgatatcgataagctctcccgcaaagtaccgcagctgtgtaaagttgcgccgagcacccaaaaataccatatggaagatgttcaccgtgctggtggtgttatcggtattctcggcgagctggatcgtgcggggttactgaaccgtgatgtgaaaaatgtacttggcctgacgttgccgcaaacgctggaacaatacgacatcatcgtgacccaggatgatgcggtaaaaaatatgttccgcgctggcccggcgggcattcgtactacacaggcattctcgcaggattgccgctgggatacgctggacgacgatcgctccaatggctgtatccgctcgctggaacacgcctacagcaaagacggcggcctggcggtgctctacggtaatttcgcagaaaacggctgcatcgttaaaaccgcaggcgtcgatgacagcatcctcaaattcactggcccggcgaaagtctacgaaagccaggacgacgcggtagaagcgattctcggcggtaaagttgtcgccggagatgtggtagtaattcgctatgaaggcccgaaaggcggtccggggatgcaggaaatgctctacccaaccagtttcctgaaatcaatgggtctcggtaaagcctgtgcgctgatcaccgacggtcgtttctctggcggcacctctggtctttccatcggccacgtctcaccggaagcggcaagtggcggcagcattggcctgattgaagatggtgacctgatcgctatcgacattccgaaccgtggcattcagttacaggtaagcgatgccgaactggcggcgcgtcgtgaagcgcaggaagctcggggtgacaaagcctggacgccgaaaaaccgtgaacgtcaggtttcctttgcgctgcgtgcctacgccagcctggcaaccagcgccgacaaaggcgcggtgcgcgataaatcgaaactggggggttaa

SEQ ID NO: 8706 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQDDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDIIVTQDDAVKNMFRAGPAGIRTTQAFSQDCRWDTLDDDRSNGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQEARGDKAWTPKNRERQVSFALRAYASLATSADKGAVRDKSKLGG

SEQ ID NO: 8707 - DNA, 1545 bp, Escherichia coli
atggcagactcacaacccctgtccggtgcccctgaaggtgccgaatatttaagagcggtgctgcgcgcgccggtctacgaagcggcgcaggtcacgccgctacaaaaaatggaaaaactctcgtcgcgtctcgataacgtgattctggtgaaacgcgaagaccgtcagccagttcatagctttaagctgcgcggcgcatacgccatgatggcgggcctgacggaagaacagaaagcgcacggcgtgatcaccgcttctgcgggtaaccacgcgcagggcgtcgcgttttcttccgcacggttaggcgtgaaggcactgatcgtcatgccaaccgccaccgccgatatcaaagtcgacgcggtgcgcggcttcggcggcgaagtgcttcttcacggcgcgaactttgatgaagcaaaagcgaaagcgatcgaactgtcacagcagcagggcttcacctgggtgccgccgttcgaccatccgatggtgatcgccgggcaaggcacgctggcgctggaactgctccagcaggacgcccatctcgaccgcgtatttgtgccagtcggcggcggcggtctggcggcgggcgtggcggtactgatcaaacaactgatgccgcaaatcaaagtgattgccgtggaagcggaagactccgcctgcctgaaagcggcgctggatgcaggtcatccggttgatctgccacgcgtggggctgtttgccgaaggtgttgcggtgaaacgcatcggcgacgaaaccttccgtttatgccaggagtatctcgacgacatcatcaccgtcgatagcgatgccatatgtgcggcgatgaaagacctgttcgaagatgtgcgcgcggtagcggaaccctctggcgcgctggcactggcgggaatgaaaaaatatatcgcccagcacaacattcgcggtgagcggctggcgcatattctttctggtgctaacgtgaactttcacggcctgcgctacgtctcggaacgttgcgaactgggcgaacagcgtgaagcgttgctggcggtaaccatcccggaagagaagggcagcttcctgaagttctgccagctgcttggcgggcgctcggtcaccgagttcaactaccgttttgccgatgccaaaaacgcctgcatttttgttggtgtgcgcctgagccgtggtctcgaagagcgcaaagaaattttgcagatgctcaacgatggcggctacagcgtagtggatctctccgacgacgaaatggcgaagctgcatgtgcgctatatggtcggcgggcgtccgtcgcatccgttgcaggaacgcctctacagcttcgaattcccggaatcgccgggcgcgctgttgcgcttcctcaacacgctgggtacgcactggaacatttctttgttccactatcgcagccatggcaccgactacgggcgcgtactggcggcgttcgaacttggcgaccatgaaccggatttcgaaacccggttgaatgagttgggttacgattgccacgacgaaaccaataacccggcgttcaggttctttttggcgggttaa

SEQ ID NO: 8708 - protein, 514 aa, Escherichia coli
MADSQPLSGAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKALIVMPTATADIKVDAVRGFGGEVLLHGANFDEAKAKAIELSQQQGFTWVPPFDHPMVIAGQGTLALELLQQDAHLDRVFVPVGGGGLAAGVAVLIKQLMPQIKVIAVEAEDSACLKAALDAGHPVDLPRVGLFAEGVAVKRIGDETFRLCQEYLDDIITVDSDAICAAMKDLFEDVRAVAEPSGALALAGMKKYIAQHNIRGERLAHILSGANVNFHGLRYVSERCELGEQREALLAVTIPEEKGSFLKFCQLLGGRSVTEFNYRFADAKNACIFVGVRLSRGLEERKEILQMLNDGGYSVVDLSDDEMAKLHVRYMVGGRPSHPLQERLYSFEFPESPGALLRFLNTLGTHWNISLFHYRSHGTDYGRVLAAFELGDHEPDFETRLNELGYDCHDETNNPAFRFFLAG

SEQ ID NO: 8709 - DNA, 960 bp, Escherichia coli
ttgcggaaattgatatattcacaacgtcacattgcaatttctgcaacgtcaacattaagggctgcgccattggatttacgcgatctgaaaaccttcctgcatctggcggaaagccgccattttggccgcagcgcgcgggcaatgcacgttagcccgtccacgctctctcggcagattcagcgcctggaagacgatctcggtcagccgctgtttgtgcgcgataaccgcacggtaacgctaaccgaagcaggcgaagaactgcgcgttttcgcccagcaaacgctgttgcagtatcaacagctgcgccacaccatcgatcagcaaggaccgtcgctctctggcgaattacatatcttctgctcggtgaccgctgcctacagccatctgccgccgattctcgatcgcttccgcgcggaacacccgtcggtggagattaaactcacgactggtgatgcggcagatgcgatggaaaaggtagtcactggcgaagcggatctggcgattgccgggaaaccggagactctgcccggcgcagtggcgttttcgatgctggagaatctggcagtagtgctgattgcccccgcgctaccctgcccggtgcgtaaccaagtttcggcagagaagccggactggtctacagtgccgtttatcatggccgatcagggaccggtgcgccggcgcattgaactgtggtttcgacgcaacaaaatcagcaacccgatgatttacgccacggtcggcgggcatgaagcgatggtgtcgatggtagcgctcggctgtggcgtggccttgttgccggaagtggtgctggaaaacagcccggaaccagtgcgtaaccgcgtgatgattttagagcgcagtgatgagaaaacaccttttgaactgggcgtctgtgcgcagaaaaagcggctgcatgagccgctgattgaggcgttctggaagattttgccgaaccattaa

SEQ ID NO: 8710 - protein, 319 aa, Escherichia coli
MRKLIYSQRHIAISATSTLRAAPLDLRDLKTFLHLAESRHFGRSARAMHVSPSTLSRQIQRLEDDLGQPLFVRDNRTVTLTEAGEELRVFAQQTLLQYQQLRHTIDQQGPSLSGELHIFCSVTAAYSHLPPILDRFRAEHPSVEIKLTTGDAADAMEKVVTGEADLAIAGKPETLPGAVAFSMLENLAVVLIAPALPCPVRNQVSAEKPDWSTVPFIMADQGPVRRRIELWFRRNKISNPMIYATVGGHEAMVSMVALGCGVALLPEVVLENSPEPVRNRVMILERSDEKTPFELGVCAQKKRLHEPLIEAFWKILPNH

SEQ ID NO: 8711 - DNA, 1626 bp, Escherichia coli
atggcgcagcccttaatgttgacgttgcagaaattgcaatgtgacgttgtgaatatatcaatttccgcaataaatttcctgtcatatagtgaattcaatctcgcaaacgcgaaccgaacaataagaagcacaacatcacgaggaatcaccatggctaactacttcaatacactgaatctgcgccagcagttggcacagctgggcaaatgtcgctttatggggcgcgatgaattcgccgatggcgcgagctaccttcagggtaaaaaagtagtcatcgtcggctgtggtgcacagggtctgaaccagggcctgaacatgcgtgattctggtctcgatatctcctacgctctgcgtaaagaagcgattgccgagaagcgcgcatcctggcgtaaagcgaccgaaaacggcttcaaagttggcacttacgaagaactgatcccgcaggcggatctggtggttaacctgacgccagacaagcagcactctgacgtagtgcgttccgttcagccgctgatgaaagacggcgcggcgctgggctactctcatggtttcaatatcgtagaagtgggtgagcagatccgtaaagacatcaccgtcgtaatggttgcgccgaaatgccctggcaccgaagtacgtgaagagtacaaacgtggattcggcgtaccgacgctgattgccgttcacccggaaaacgatccgaaaggcgaaggcatggcgatcgctaaagcatgggcggctgcaaccggcggtcaccgtgcgggcgttctggaatcctctttcgttgcggaagtgaaatctgacctgatgggcgagcaaaccatcctgtgcggtatgttgcaagctggttctctgctgtgcttcgacaagctggtggaagaaggcaccgatccggcatacgcagaaaaactgattcagttcggttgggaaaccatcaccgaagcgctgaaacagggcggcatcaccctgatgatggaccgtctttctaacccggcgaaactgcgtgcttacgcgctctctgagcaattgaaagagatcatggcgccgctgttccagaaacatatggacgacatcatctccggcgaattctcctccggcatgatggctgactgggccaacgacgataagaaactgctgacctggcgtgaagagactggcaaaaccgcattcgaaaccgcgccgcagtatgaaggcaaaatcggcgaacaggagtacttcgataaaggcgtactgatgatcgcgatggtaaaagcaggcgttgagttggcgtttgaaaccatggttgattccggcatcatcgaagaatctgcttactatgaatcactgcacgaactgccgctgattgccaacaccatcgcccgtaagcgtctgtacgaaatgaacgtggttatctccgatactgccgagtacggtaactatctgttctcttacgcttgtgtgccgctgctgaaaccgtttatggcagagctgcaaccgggcgacctgggtaaagctattccggaaggtgcggtagataacgcgcaactgcgtgatgtaaatgaagcgattcgcagccatgcgattgagcaggtaggtaagaaactgcgcggctatatgacggatatgaaacgtattgctgttgcgggttaa

SEQ ID NO: 8712 - protein, 541 aa, Escherichia coli
MAQPLMLTLQKLQCDVVNISISAINFLSYSEFNLANANRTIRSTTSRGITMANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVVNLTPDKQHSDVVRSVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNAQLRDVNEAIRSHAIEQVGKKLRGYMTDMKRIAVAG

SEQ ID NO: 8713 - DNA, 282 bp, Escherichia coli
atggcaaaaacagcagcagcactgcatatccttgtaaaagaagagaaactggctctggatcttctcgagcagatcaagaatggtgccgatttcggcaagctggcgaagaaacactccatttgcccgtcaggcaaacgcggcggtgatttgggtgaattccgccagggtcaaatggttccggcgttcgataaagtggttttctcttgtccggtactggagccaaccggcccgctgcatacccagttcggttaccacatcattaaggtgctgtaccgtaactaa

SEQ ID NO: 8714 - protein, 93 aa, Escherichia coli
MAKTAAALHILVKEEKLALDLLEQIKNGADFGKLAKKHSICPSGKRGGDLGEFRQGQMVPAFDKVVFSCPVLEPTGPLHTQFGYHIIKVLYRN

SEQ ID NO: 8715 - DNA, 2037 bp, Escherichia coli
ttgagcgattttcctatgcgtctaaaccccggccaacaacaagctgtcgaattcgttaccggcccctgcctggtgctggcgggtgcgggttccggtaagacgcgagtgatcaccaataaaatcgctcacctgattcgcggttgcggttatcaggcgcggcatattgcggcagtcacctttaccaacaaagcggcgcgcgagatgaaagagcgtgtggcgcagacgctggggcgcaaagaggcgcgagggttgatgatctccaccttccacacgcttgggctggatattatcaagcgcgaatatgcggcgttggggatgaagtctaacttttcgctgtttgacgataccgatcagcttgctttgcttaaagagttgaccgaggggctgattgaagatgacaaagttctcctgcaacagctaatttcgaccatctccaactggaagaacgatctcaaaacaccggcgcaggcggcggcagaggcaaagggcgagcgggaccgtatttttgcccattgttatgggctgtatgatgcacacctgaaagcctgtaacgttctcgacttcgatgatctgattttattgccaacgttgctgctgcaacgcaatgaagaagtccgcgagcgctggcagaacaaaattcgctacctgctggtggatgagtatcaggacaccaacaccagccagtatgaactggtgaaactgctggtgggcagccgcgcgcgctttaccgtggtgggtgacgatgaccagtcgatctactcctggcgcggcgcacgtccgcagaatctggtgctgctgagccaggattttccggcgctgaaggtgattaagcttgagcagaactaccgctcttccggacgtattttgaaagcggcgaacatcctgatcgccaataacccgcacgtctttgaaaagcgtctgttctccgaactgggttacggcacagagctaaaagttttaagcgcgaataacgaggaacatgaagccgagcgcgtcaccggcgagctgatcgcccatcacttcgtcaataaaacgcagtacaaagattacgccattctttatcgcggcaaccatcagtcgcgggtatttgaaaaattcctgatgcaaaaccgcatcccgtacaaaatatctggcggtacgtcgtttttctctcgtcctgaaatcaaggacttgctggcttatctgcgcgtgctgactaacccggacgatgacagcgcatttctgcgtatcgttaacacgccgaagcgagagattggcccggcgacgctgaaaaagctaggtgaatgggcgatgacgcgcaataaaagcatgtttaccgccagctttgatatgggcctgagtcagaccctgagcggacgtggttatgaagcattgacccgcttcactcactggttggcggaaatccagcgtctggcggagcgggagccgattgccgcggtgcgtgatctgatccacggcatggattatgaatcctggctgtacgaaacatcgcccagcccgaaagccgccgaaatgcgcatgaagaacgtcaaccaactgtttagctggatgacggagatgctcgaaggcagcgaactggatgagccgatgacgctcacccaggtggtgacgcgctttactttgcgcgacatgatggagcgcggcgagagcgaggaagagctggatcaggtgcaactgatgactctgcacgcgtcgaaagggctggagtttccctatgtctacatggttggtatggaagaagggtttttgccccaccagagcagcatcgatgaagacaatattgatgaggagcggcggctggcctatgtcggcattacccgcgcccagaaggaattgacctttacgctgtgtaaagaacgccgtcagtacggcgaactggtgcgcccggagccgagccgcttcctgctggagctgccgcaggatgatttgatttgggaacaggagcgcaaagtggtcagcgccgaagaacggatgcagaaagggcaaagccatctggcgaatctgaaagcgatgatggcggcaaaacgagggaaataa

SEQ ID NO: 8716 - protein, 678 aa, Escherichia coli
MSDFPMRLNPGQQQAVEFVTGPCLVLAGAGSGKTRVITNKIAHLIRGCGYQARHIAAVTFTNKAAREMKERVAQTLGRKEARGLMISTFHTLGLDIIKREYAALGMKSNFSLFDDTDQLALLKELTEGLIEDDKVLLQQLISTISNWKNDLKTPAQAAAEAKGERDRIFAHCYGLYDAHLKACNVLDFDDLILLPTLLLQRNEEVRERWQNKIRYLLVDEYQDTNTSQYELVKLLVGSRARFTVVGDDDQSIYSWRGARPQNLVLLSQDFPALKVIKLEQNYRSSGRILKAANILIANNPHVFEKRLFSELGYGTELKVLSANNEEHEAERVTGELIAHHFVNKTQYKDYAILYRGNHQSRVFEKFLMQNRIPYKISGGTSFFSRPEIKDLLAYLRVLTNPDDDSAFLRIVNTPKREIGPATLKKLGEWAMTRNKSMFTASFDMGLSQTLSGRGYEALTRFTHWLAEIQRLAEREPIAAVRDLIHGMDYESWLYETSPSPKAAEMRMKNVNQLFSWMTEMLEGSELDEPMTLTQVVTRFTLRDMMERGESEEELDQVQLMTLHASKGLEFPYVYMVGMEEGFLPHQSSIDEDNIDEERRLAYVGITRAQKELTFTLCKERRQYGELVRPEPSRFLLELPQDDLIWEQERKVVSAEERMQKGQSHLANLKAMMAAKRGK

SEQ ID NO: 8717 - DNA, 1485 bp, Escherichia coli
atgggttccacctcgtcgctgtatgcagccattgatctcggttcgaatagttttcatatgctggttgtgcgcgaggtggctggaagcatccagacgctgacgcgaataaaacgcaaagtgcgtctggctgccggcctgaatagcgaaaatgccctgtctaatgaagcaatggagcgcggttggcaatgtctgcgcctgtttgctgaacgtctgcaagatatccctccctcgcaaattcgcgttgtcgctacggcgacattacgacttgccgtcaatgcgggtgattttattgccaaagcgcaggaaatcctcggttgtccggtacaggtgatcagcggtgaagaggaagcgcgtctgatttatcagggcgttgctcacaccactggcggtgccgatcagcgcctggtggtggatatcggcggagccagtactgaactggtaaccggcacgggtgcacaaaccacctctttgttcagcctgtcgatgggctgcgttacctggctggaacgctattttgccgatcgtaatctggggcaggaaaattttgatgctgcagaaaaagcggcacgcgaagtgttacgtccggttgccgatgaattacggtatcacggctggaaagtgtgcgttggcgcttccggcaccgtgcaggcgttacaggaaatcatgatggcacaggggatggatgaacgcattaccctggaaaagttgcagcaactgaaacaacgcgccattcattgcggtcggctggaagagctagagattgacgggctgacgctggaacgtgcgttagtgttcccgagtggtctggcgatcctgatagccatttttaccgaactgaatattcagtgtatgaccctggcgggcggtgcgctgcgtgaaggcctggtctacggtatgttgcatcttaccgtcgagcaggatattcgcagccgtacgctgcgtaatattcagcgccgctttatgatcgatattgatcaggcacagcgcgtagccaaggttgcggctaacttcttcgatcaggtggaaaatgaatggcatcttgaagcaataagccgcgatttgctcatcagcgcctgtcagcttcatgaaatcggcctgagcgttgacttcaaacaagcgccgcaacacgctgcttatctggtgcgtaacctagatcttcccggttttacccccgcacagaaaaaactgctggcgacgctactgctcaaccagactaatccggtcgatctctcatcgctgcatcagcaaaatgccgtaccaccgcgcgtcgcagaacaactctgccgtttactccgcctggctatcatttttgccagccgtcgccgtgacgatctcgtgccagagatgacattacaggctaaccatgaactgttgaccttgacgcttccgcaaggttggctaacccaacatccgctgggtaaagagattattgatcaggaaagccagtggcagagctatgtccactggccgctggaagtgcattaa

SEQ ID NO: 8718 - protein, 494 aa, Escherichia coli
MGSTSSLYAAIDLGSNSFHMLVVREVAGSIQTLTRIKRKVRLAAGLNSENALSNEAMERGWQCLRLFAERLQDIPPSQIRVVATATLRLAVNAGDFIAKAQEILGCPVQVISGEEEARLIYQGVAHTTGGADQRLVVDIGGASTELVTGTGAQTTSLFSLSMGCVTWLERYFADRNLGQENFDAAEKAAREVLRPVADELRYHGWKVCVGASGTVQALQEIMMAQGMDERITLEKLQQLKQRAIHCGRLEELEIDGLTLERALVFPSGLAILIAIFTELNIQCMTLAGGALREGLVYGMLHLTVEQDIRSRTLRNIQRRFMIDIDQAQRVAKVAANFFDQVENEWHLEAISRDLLISACQLHEIGLSVDFKQAPQHAAYLVRNLDLPGFTPAQKKLLATLLLNQTNPVDLSSLHQQNAVPPRVAEQLCRLLRLAIIFASRRRDDLVPEMTLQANHELLTLTLPQGWLTQHPLGKEIIDQESQWQSYVHWPLEVH

SEQ ID NO: 8719 - DNA, 1266 bp, Escherichia coli
atgagcaaaacacatttaacagaacagaagttttccgacttcgccctgcatccgaaggttgtagaagcccttgaaaaaaaagggtttcataactgtacgcccattcaggcactggcccttccgctgacgctggcgggtcgtgacgtagccgggcaggcgcaaaccggtaccgggaaaacgatggcgtttcttacgtcaacgtttcattatcttctctctcatcccgcgattgccgatcgcaaggtgaatcaaccgcgtgccttaattatggcaccgacgcgtgaacttgccgtgcagatccatgccgacgcggaaccactggcggaagctactggcctgaagctgggtctggcttacggtggtgatggctacgacaaacagctgaaagtgctggaaagcggcgttgacattctgattggcaccacgggtcgtttaattgactacgccaagcagaaccacattaacctcggtgccattcaggtggtggtactggacgaagccgatcgcatgtacgatctgggctttattaaagatatccgctggctgttccgccgtatgccgcctgcaaaccagcgcctcaacatgctgttctccgccacgctttcgtaccgggtacgtgaactggcgttcgagcagatgaacaatgccgaatatattgaagtggaaccggaacagaaaacgggccatcgtattaaagaagagcttttctacccttctaacgaagaaaaaatgcgtttgctgcaaacgctgatcgaagaagagtggccagacagagcgattattttcgccaacaccaaacaccgttgtgaagagatctggggccacctggcggcagatggtcatcgtgtcggtttattgacaggcgatgtcgcgcagaaaaaacgtctgcgtattcttgatgaatttacccgtggggatctggatattctggttgccaccgacgttgccgcgcgtggtttgcatattcctgctgtgacacacgtctttaactacgatttacccgatgactgtgaagattacgttcaccgtattggtcgaacaggtcgcgcaggcgcaagcggtcactctattagcctggcgtgtgaagagtatgcattgaatttgcctgctattgagacctatattggtcactcaattccggtaagtaaatacaatccggacgcattgatgaccgatctgccaaaaccgctgcgcctcacgcgcccgcgcacaggcaatggtccgcgtcgtactggcgctccgcgtaatcgtcgtcgttcaggttaa

SEQ ID NO: 8720 - protein, 421 aa, Escherichia coli
MSKTHLTEQKFSDFALHPKVVEALEKKGFHNCTPIQALALPLTLAGRDVAGQAQTGTGKTMAFLTSTFHYLLSHPAIADRKVNQPRALIMAPTRELAVQIHADAEPLAEATGLKLGLAYGGDGYDKQLKVLESGVDILIGTTGRLIDYAKQNHINLGAIQVVVLDEADRMYDLGFIKDIRWLFRRMPPANQRLNMLFSATLSYRVRELAFEQMNNAEYIEVEPEQKTGHRIKEELFYPSNEEKMRLLQTLIEEEWPDRAIIFANTKHRCEEIWGHLAADGHRVGLLTGDVAQKKRLRILDEFTRGDLDILVATDVAARGLHIPAVTHVFNYDLPDDCEDYVHRIGRTGRAGASGHSISLACEEYALNLPAIETYIGHSIPVSKYNPDALMTDLPKPLRLTRPRTGNGPRRTGAPRNRRRSG

SEQ ID NO: 8721 - DNA, 435 bp, Escherichia coli
ttgctttacgaaagcgtatccggtgaaataaagtcaacctttagttggttaatgttacaccaacaacgaaaccaacacgccaggcttattcctgtggagttatatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggcgcactgtctaaaggtcagttgaaagagttcctcgacgctaacctggcgtaa

SEQ ID NO: 8722 - protein, 144 aa, Escherichia coli
MLYESVSGEIKSTFSWLMLHQQRNQHARLIPVELYMSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLA

SEQ ID NO: 8723 - DNA, 1332 bp, Escherichia coli
atggatgatcctgccataccattcacaacattaagttcgagatttaccccaagtttaagaactcacaccactatgaatcttaccgaattaaagaatacgccggtttctgagctgatcactctcggcgaaaatatggggctggaaaacctggctcgtatgcgtaagcaggacattatttttgccatcctgaagcagcacgcaaagagtggcgaagatatctttggtgatggcgtactggagatattgcaggatggatttggtttcctccgttccgcagacagctcctacctcgccggtcctgatgacatctacgtttcccctagccaaatccgccgtttcaacctccgcactggtgataccatctctggtaagattcgcccgccgaaagaaggtgaacgctattttgcgctgctgaaagttaacgaagttaacttcgacaaacctgaaaacgcccgcaacaaaatcctctttgagaacttaaccccgctgcacgcaaactctcgtctgcgtatggaacgtggtaacggttctacggaagatttaaccgctcgcgtactggatctggcatcacctatcggtcgtggtcagcgtggtctgattgtggcaccgccgaaagccggtaaaaccatgctgctgcagaacattgctcagagcattgcttacaaccacccggattgtgtgctgatggttctgctgatcgacgaacgtccggaagaagtaaccgagatgcagcgtctggtaaaaggtgaagttgttgcttctacctttgacgaacccgcatctcgccacgttcaggttgcggaaatggtgatcgagaaggcgaaacgcctggttgagcacaagaaagacgttatcattctgctcgactccatcactcgtctggcgcgcgcttacaacaccgttgttccggcgtcaggtaaagtgttgaccggtggtgtggacgccaacgccctgcatcgtccgaaacgcttcttcggtgcggcgcgtaacgtggaagagggcggcagcctgaccattatcgcgacggcgcttatcgataccggttctaaaatggacgaagttatctacgaagagtttaaaggtacaggcaacatggaactgcacctctctcgtaagatcgctgaaaaacgcgtcttcccggctatcgactacaaccgttccggtacccgtaaagaagagctgctcacgactcaggaagaactgcagaaaatgtggatcctgcgcaaaatcattcacccgatgggcgaaatcgatgcaatggaattcctcattaataaactggcaatgaccaagaccaatgacgatttcttcgaaatgatgaaacgctcataa

SEQ ID NO: 8724 - protein, 443 aa, Escherichia coli
MDDPAIPFTTLSSRFTPSLRTHTTMNLTELKNTPVSELITLGENMGLENLARMRKQDIIFAILKQHAKSGEDIFGDGVLEILQDGFGFLRSADSSYLAGPDDIYVSPSQIRRFNLRTGDTISGKIRPPKEGERYFALLKVNEVNFDKPENARNKILFENLTPLHANSRLRMERGNGSTEDLTARVLDLASPIGRGQRGLIVAPPKAGKTMLLQNIAQSIAYNHPDCVLMVLLIDERPEEVTEMQRLVKGEVVASTFDEPASRHVQVAEMVIEKAKRLVEHKKDVIILLDSITRLARAYNTVVPASGKVLTGGVDANALHRPKRFFGAARNVEEGGSLTIIATALIDTGSKMDEVIYEEFKGTGNMELHLSRKIAEKRVFPAIDYNRSGTRKEELLTTQEELQKMWILRKIIHPMGEIDAMEFLINKLAMTKTNDDFFEMMKRS

SEQ ID NO: 8725 - DNA, 126 bp, Escherichia coli
atgccaaaaacgccacgtgtttacgtggcgttttgcttttatatctgtaatcttaatgccgcgctggcgatgttaggaaaattcctggattttgctggtgtgttatgcaatttgcatatcaagtag

SEQ ID NO: 8726 - protein, 41 aa, Escherichia coli
MPKTPRVYVAFCFYICNLNAALAMLGKFLDFAGVLCNLHIK

SEQ ID NO: 8727 - DNA, 1104 bp, Escherichia coli
gtgaatttactgacagtgagtactgatctcatcagtatttttttattcacgacactgtttctgttttttgcccgtaaggtggcaaaaaaagtcggtttagtggataaaccaaacttccgcaaacgtcaccagggattgatacctctcgttggggggatttcggtttacgcagggatttgcttcacgttcggaattgtcgattactatattccgcatgcatctctctatctcgcttgtgctggtgtgcttgttttcattggcgcgctggatgaccgttttgatatcagcgtaaaaatccgtgccaccatacaggccgctgttggcattgttatgatggtgttcggcaaactttatctcagtagcctgggttatatctttggctcctgggagatggtgctcggaccgtttggttacttcctgacgctatttgccgtctgggcggccattaatgcgttcaacatggttgatggcattgatggcttgctgggcgggttgtcctgcgtctcgtttgcagcaatcggtatgattttgtggttcgacgggcaaaccagtctcgcaatctggtgctttgcgatgatcgccgccatcctgccatacatcatgcttaaccttggtatcctgggtcgccgctacaaagtctttatgggggatgcgggcagtacgctgattggttttaccgttatctggatcctgctcgaaacgacccagggcaaaactcatcccatcagcccggttaccgctttgtggataatcgccattccgctaatggatatggtggcgattatgtaccgtcgcctgcgtaaaggcatgagcccattctctccagaccgtcagcatattcaccatttgatcatgcgtgccgggtttacttcccgccaggcgtttgtgctgattacccttgccgcagcactgctcgcttccattggcgtgctggcagaatattctcattttgtcccggagtgggtcatgctggtgctctttttgctagcattcttcctctatggatattgcattaagcgtgcctggaaagttgctcgctttattaagcgcgtaaaacgcagactgcgtagaaatcgtggtggcagccccaatttaaccaaataa

SEQ ID NO: 8728 - protein, 367 aa, Escherichia coli
MNLLTVSTDLISIFLFTTLFLFFARKVAKKVGLVDKPNFRKRHQGLIPLVGGISVYAGICFTFGIVDYYIPHASLYLACAGVLVFIGALDDRFDISVKIRATIQAAVGIVMMVFGKLYLSSLGYIFGSWEMVLGPFGYFLTLFAVWAAINAFNMVDGIDGLLGGLSCVSFAAIGMILWFDGQTSLAIWCFAMIAAILPYIMLNLGILGRRYKVFMGDAGSTLIGFTVIWILLETTQGKTHPISPVTALWIIAIPLMDMVAIMYRRLRKGMSPFSPDRQHIHHLIMRAGFTSRQAFVLITLAAALLASIGVLAEYSHFVPEWVMLVLFLLAFFLYGYCIKRAWKVARFIKRVKRRLRRNRGGSPNLTK

SEQ ID NO: 8729 - DNA, 1047 bp, Escherichia coli
atgacacaaccaatgcctgggaaaccggccgaagacgctgaaaatgaactggatattcgtgggttgtttcgtaccttgtgggctgggaagctgtggattattggcatggggctggcgtttgcgttaatcgcgctggcgtatactttttttgctcgccaggagtggagctcgacagcgattaccgatcgtccaacggtgaatatgctggggggatattactcacagcagcaatttttgcgtaacctggatgtccgttcaaacatggcttctgccgaccaaccatcggtcatggacgaagcctataaagagtttgttatgcaactggcctcgtgggatacccgcagagagttctggctgcaaaccgactattacaaacagcggatggtgggcaatagcaaagccgatgcggcgttgctggatgaaatgattaacaacatcgtgtttattcccggtgactttacccgcgcggtcaatgacagcgtgaagcttattgccgaaaccgcgcctgacgctaataacctgttacgtcagtatgttgcttttgccagccagcgtgcagccagccatctgaatgatgagctgaaaggcgcatgggcggcacgcaccatccagatgaaagctcaggtgaagcgtcaggaagaggtggcgaaagccatctacgatcgccggatgaacagtattgaacaggcgctgaaaattgctgagcagcataatatttcgcgcagtgcgacagatgtgcctgccgaggaattacctgattcagaaatgttcctgcttgggcgtccaatgctccaggctcgactggaaaatttacaggccgtcggtccggcctttgatctcgactatgatcaaaatcgggccatgttaaacaccctgaatgttggtccaaccctggatccgcgttttcagacctatcgctatttgcgtacgccggaagaaccggtaaaacgcgatagcccacgtcgtgccttcctgatgattatgtggggcattgtcggggggctgatcggggctggtgtcgcattaacccgccgttgctcgaaatag

SEQ ID NO: 8730 - protein, 348 aa, Escherichia coli
MTQPMPGKPAEDAENELDIRGLFRTLWAGKLWIIGMGLAFALIALAYTFFARQEWSSTAITDRPTVNMLGGYYSQQQFLRNLDVRSNMASADQPSVMDEAYKEFVMQLASWDTRREFWLQTDYYKQRMVGNSKADAALLDEMINNIVFIPGDFTRAVNDSVKLIAETAPDANNLLRQYVAFASQRAASHLNDELKGAWAARTIQMKAQVKRQEEVAKAIYDRRMNSIEQALKIAEQHNISRSATDVPAEELPDSEMFLLGRPMLQARLENLQAVGPAFDLDYDQNRAMLNTLNVGPTLDPRFQTYRYLRTPEEPVKRDSPRRAFLMIMWGIVGGLIGAGVALTRRCSK

SEQ ID NO: 8731 - DNA, 1131 bp, Escherichia coli
gtgaaagtactgactgtatttggtacgcgcccggaagccatcaagatggcaccgttggtgcatgcgttggcaaaagatcctttttttgaggctaaagtttgcgtcactgcgcagcatcgggagatgctcgatcaggtgctgaaactcttttccattgtacctgactacgatctcaacataatgcagccaggacagggccttacagagataacctgtcggattctggaagggctaaaacctattcttgccgagttcaaaccagacgtcgtgctggttcacggcgatactactacaacgctggcaaccagcctggcggcgttttatcagcgtattccagttggtcacgttgaggcaggtctgcgcacgggcgatctctattcgccgtggccggaagaggctaaccgtacattgaccgggcatctggcgatgtatcacttctctccaaccgaaacttcccggcaaaacttgctgcgtgaaaacgttgctgacagccgaatcttcattaccggtaatactgtcatcgatgcactgttatgggtgcgtgaccaggtgatgagcagcgatacgctgcgttcagaactggcggcaaattacccgtttatcgaccccgataaaaagatgattctggtgaccggtcacaggcgtgagagcttcggtcgtggctttgaagaaatctgccaggcgctggcagacatcgccaccacgcaccaggacatccagattgtctatccggtgcatctcaacccgaacgtcagagagccggtcaatcgcattctggggcatgtgaaaaatgtcattctgatcgatccccaggagtatttaccgtttgtctggctgatgaaccacgcttggctgattttgaccgactcaggcggcattcaggaagaagcgccttcgctggggaaaccggtgctggtgatgcgcgataccactgagcgtccggaagcggtgacagcggggacggtgcgtctggtcggcacggataagcagcgaattgtcgaggaagtgacgcgtcttttaaaagacgaaaacgaatatcaagctatgagccgcgcccataacccgtatggtgatggtcaggcatgctctcgcattctggaagcgttaaaaaataatcggatatcactatga

SEQ ID NO: 8732 - protein, 376 aa, Escherichia coli
MKVLTVFGTRPEAIKMAPLVHALAKDPFFEAKVCVTAQHREMLDQVLKLFSIVPDYDLNIMQPGQGLTEITCRILEGLKPILAEFKPDVVLVHGDTTTTLATSLAAFYQRIPVGHVEAGLRTGDLYSPWPEEANRTLTGHLAMYHFSPTETSRQNLLRENVADSRIFITGNTVIDALLWVRDQVMSSDTLRSELAANYPFIDPDKKMILVTGHRRESFGRGFEEICQALADIATTHQDIQIVYPVHLNPNVREPVNRILGHVKNVILIDPQEYLPFVWLMNHAWLILTDSGGIQEEAPSLGKPVLVMRDTTERPEAVTAGTVRLVGTDKQRIVEEVTRLLKDENEYQAMSRAHNPYGDGQACSRILEALKNNRISL

SEQ ID NO: 8733 - DNA, 1263 bp, Escherichia coli
atgagttttgcgaccatttctgttatcggactgggttacatcgggctgcctacagcagctgcgtttgcctcaaggcaaaaacaggtgattggtgtcgatatcaaccaacacgcggttgataccatcaatcgtggcgaaatccatatcgtcgagcctgatttggcgagcgtagtaaaaactgccgtagaaggcggttttttacgagcgagcacgacgccagttgaagcggatgcctggttgattgctgtacccacgccgtttaaaggcgatcatgagccagatatgacctacgttgaatcggctgctcgctccatcgcgccagtgctgaaaaaaggcgcgttggtgatccttgaatccacctcgccggtggggtcaaccgagaagatggcagaatggttagcagagatgcgtccagatctcactttcccacagcaggtgggcgagttggcggacgtcaacattgcttactgcccggaacgcgtattaccgggccaggttatggtcgagctgattaaaaacgatcgcgtgattggtggtatgacgccggtttgttcggcccgcgccagcgaactgtacaaaattttcctcgaaggtgagtgtgtcgtcactaactcgcggacggcagaaatgtgtaagctcaccgaaaacagcttccgcgatgtgaatatcgcttttgctaatgaattgtcgctgatttgtgccgatcaggggattaacgtctgggaactgattcgcctggcgaatcgtcaccctcgcgtcaatattcttcagccaggccctggcgtgggcggtcactgcatcgctgttgatccgtggtttatcgtggcacagaacccccagcaggcgcggcttatccgtaccgcgcgcgaagtgaacgatcacaaaccgttctgggttatcgatcaggtgaaagcggcggtggctgattgtctggctgctaccgataaacgcgtcagtgaactgaaaatcgcctgctttggtctggcgtttaaaccgaatattgatgacctgcgcgaaagtccggcaatggaaatcgctgaactgatcgcccagtggcacagcggcgaaacgctggttgttgagcctaacatccacgagttgccgaagaaactgaccgggctttgtactctggcgcagcttgacgaggcgctggcaacggcagatgtgctggtgatgctggtcgatcatagtcagttcaaagttatcaatggcgacaacgtccatcagcagtatgtcgtcgatgccaaaggagtctggcgctga

SEQ ID NO: 8734 - protein, 420 aa, Escherichia coli
MSFATISVIGLGYIGLPTAAAFASRQKQVIGVDINQHAVDTINRGEIHIVEPDLASVVKTAVEGGFLRASTTPVEADAWLIAVPTPFKGDHEPDMTYVESAARSIAPVLKKGALVILESTSPVGSTEKMAEWLAEMRPDLTFPQQVGELADVNIAYCPERVLPGQVMVELIKNDRVIGGMTPVCSARASELYKIFLEGECVVTNSRTAEMCKLTENSFRDVNIAFANELSLICADQGINVWELIRLANRHPRVNILQPGPGVGGHCIAVDPWFIVAQNPQQARLIRTAREVNDHKPFWVIDQVKAAVADCLAATDKRVSELKIACFGLAFKPNIDDLRESPAMEIAELIAQWHSGETLVVEPNIHELPKKLTGLCTLAQLDEALATADVLVMLVDHSQFKVINGDNVHQQYVVDAKGVWR

SEQ ID NO: 8735 - DNA, 1068 bp, Escherichia coli
atgagaaagattctgataacaggtggtgccgggtttattggctcggcgctggtgcgttatatcatcaacgaaacgagcgacgcggtggtggtggtcgataagctgacctacgccggaaacctgatgtcgctggcaccggtcgcgcaaagcgagcgctttgcctttgagaaagttgatatctgcgatcgggcagaactggcgcgcgtattcactgagtatcagccagactgtgtcatgcatctggcagccgaaagccatgttgaccgttctattgacggcccggcagcgtttattgaaaccaacattgtcgggacttatacactgcttgaagcggcgcgggcttactggactgcgctgacggaagataaaaaatcagcgttccgttttcatcatatctccaccgacgaagtatatggtgacctgcactcgacggatgatttcttcaccgaaaccacgccgtatgcgccgagtagcccttattccgcgtcaaaagccagcagcgaccatctggtgcgcgcctggctgcggacctatggtctgccgacgcttatcaccaactgctcgaataactacggtccttaccactttccggaaaaactgatcccgctgatgatcctcaacgcgctggcgggtaaaccgctgccggtatatggcaacgggcagcaaatccgtgactggctgtatgttgaagatcacgcccgcgcgctgtattgcgcggcgaccaccgggaaagtcggtgaaacctataatattggtggtcacaacgagcgtaagaatctcgatgttgtggaaaccatttgcgagctgctggaagaactggctccgaataagccgcacggcgtggcgcactatcgtgacctgatcacctttgtcgctgaccgtccggggcatgatctgcgttatgccattgatgcttcgaaaattgcccgtgaacttggctggctgccgcaggaaacctttgaaagtggaatgcgtaaaacggtgcagtggtatctggctaatgaaagctggtggaagcaggtgcaggacggcagctatcagggcgagcgtttaggtctgaaaggctaa

SEQ ID NO: 8736 - protein, 355 aa, Escherichia coli
MRKILITGGAGFIGSALVRYIINETSDAVVVVDKLTYAGNLMSLAPVAQSERFAFEKVDICDRAELARVFTEYQPDCVMHLAAESHVDRSIDGPAAFIETNIVGTYTLLEAARAYWTALTEDKKSAFRFHHISTDEVYGDLHSTDDFFTETTPYAPSSPYSASKASSDHLVRAWLRTYGLPTLITNCSNNYGPYHFPEKLIPLMILNALAGKPLPVYGNGQQIRDWLYVEDHARALYCAATTGKVGETYNIGGHNERKNLDVVETICELLEELAPNKPHGVAHYRDLITFVADRPGHDLRYAIDASKIARELGWLPQETFESGMRKTVQWYLANESWWKQVQDGSYQGERLGLKG

SEQ ID NO: 8737 - DNA, 882 bp, Escherichia coli
atgaaaggtattatcttggcgggcggttccggcacccgattgcatccgattacgcgcggcgtatcgaagcaactgttgccgatttacgataagccaatgatttactatccgctgtcggtgctgatgctagccggtatccgcgaaattctcatcattactacgccggaagataaaggttatttccagcgcctgctgggtgacggcagtgagttcggtatccagctggaatacgccgaacagcccagtccggacggtctggcgcaggcctttatcatcggtgaaaccttcctcaacggtgaaccttcttgtctggtgctgggcgataacatcttcttcggacagggcttcagtccgaagctgcgtcatgttgcggcgcgcacggaaggggcgacggtatttggctatcaggtgatggacccggaacgctttggcgtggtggagtttgacgacaatttccgcgctatctcgctggaagaaaaaccaaaacagccgaaatcaaactgggcggtgaccgggctttatttctacgacagtaaagtcgtggagtacgcaaagcaggtgaagccgtcggagcgtggtgaactggagattacctccatcaaccagatgtacctcgaggcgggcaacctgaccgttgaactgctcgggcgcggatttgcctggctggataccggcactcacgacagcctgattgaggccagcacttttgtgcagacagtagaaaaacgccagggctttaagattgcctgcctggaagagattgcctggcgtaacggctggctcgatgacgagggtgtgaagcgtgctgccagttcattagcgaaaactggctacggccaatatctgctggagttacttcgtgcccgtccgcgccagtattga

SEQ ID NO: 8738 - protein, 293 aa, Escherichia coli
MKGIILAGGSGTRLHPITRGVSKQLLPIYDKPMIYYPLSVLMLAGIREILIITTPEDKGYFQRLLGDGSEFGIQLEYAEQPSPDGLAQAFIIGETFLNGEPSCLVLGDNIFFGQGFSPKLRHVAARTEGATVFGYQVMDPERFGVVEFDDNFRAISLEEKPKQPKSNWAVTGLYFYDSKVVEYAKQVKPSERGELEITSINQMYLEAGNLTVELLGRGFAWLDTGTHDSLIEASTFVQTVEKRQGFKIACLEEIAWRNGWLDDEGVKRAASSLAKTGYGQYLLELLRARPRQY

SEQ ID NO: 8739 - DNA, 675 bp, Escherichia coli
gtgcccgtccgcgccagtattgagccactaacctgggaaaacgccttctttggtgttaacagcgccatcgtgcgcattacgtctgaagcaccgctcctgacgccagacgcgttagcgccgtggtcacgggtgcaggccaaaattgcggcatcaaatacgggtgaactggatgctctgcaacagctgggattctccctggtagaaggtgaagttgatttggcactacccgtgaacaatgtcagtgatagcggtgcagtagtggcacaagagaccgatattcccgcattacgtcagttagccagcgccgcatttgcgcaaagccgttttcgtgcgccgtggtatgcgcctgacgccagcggtcgcttttatgcacagtggattgaaaatgccgtgcgcggcacctttgatcatcaatgtctgattttacgtgcggcgtccggcgatattcgcggttatgtctctttacgggaactcaatgcgacagatgcgcgaattggcctgctggctggacgcggtgcaggtgctgagctaatgcaaacggcgctaaactgggcgtatgctcgcggtaaaacaactttgcgggtggcgacccagatgggcaacaccgccgcgcttaaacgatacatacaaagtggtgcgaatgtagaaagcaccgcgtactggttatacaggtga

SEQ ID NO: 8740 - protein, 224 aa, Escherichia coli
MPVRASIEPLTWENAFFGVNSAIVRITSEAPLLTPDALAPWSRVQAKIAASNTGELDALQQLGFSLVEGEVDLALPVNNVSDSGAVVAQETDIPALRQLASAAFAQSRFRAPWYAPDASGRFYAQWIENAVRGTFDHQCLILRAASGDIRGYVSLRELNATDARIGLLAGRGAGAELMQTALNWAYARGKTTLRVATQMGNTAALKRYIQSGANVESTAYWLYR

SEQ ID NO: 8741 - DNA, 1131 bp, Escherichia coli
atgattccatttaacgcaccgccggtggtgggaaccgaactcgactatatgcagtcggcaatgggtagcggcaaactgtgcggcgatggtggttttacccgtcgctgccagcagtggctggagcaacgttttggcagcgccaaagtgttactgacgccatcctgtaccgcttcgctggagatggcggcgctgctgctcgatatccagcctggcgatgaagtgatcatgccgagctatacctttgtctccaccgccaatgcctttgtgctgcgtggcgcgaaaatcgtctttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaagaagcataatctgtttgtggtggaagatgccgctcagggcgtgatgtccacttacaaagggcgtgcgctgggaaccattggtcatattggctgctttagcttccatgaaaccaaaaactacacggcgggtggtgaaggcggcgcgacgctgattaacgataaagcgttgatcgaacgagccgagatcatccgtgaaaaaggcacaaaccgcagccagttcttccgtggtcaggtcgataaatatacctggcgcgatattggctccagctatttgatgtccgatctgcaagctgcgtacctgtgggcgcaactggaagctgcggatcgtatcaaccagcaacgtctggcgctgtggcaaaactactacgatgcgctggcgcctctggcaaaaaatgggcgtatcgagctgccgtcgattcccgatggctgcgtgcagaacgcgcatatgttctacattaaactgcgggatattgatgaccggagcgcattgattaactttctgaaagaagcggaaatcatggcggtgttccattacattccgctgcacggttgccctgcgggggaacgctttggtgagttccacggtgaagatcgctacaccaccaaagagagcgagcgcctgctgcgcctgccgttgttctacaacctgtcgcccgtcaatcagcgtacggtaattgcgaccttgttgaactacttctcctga

SEQ ID NO: 8742 - protein, 376 aa, Escherichia coli
MIPFNAPPVVGTELDYMQSAMGSGKLCGDGGFTRRCQQWLEQRFGSAKVLLTPSCTASLEMAALLLDIQPGDEVIMPSYTFVSTANAFVLRGAKIVFVDVRPDTMNIDETLIEAAITDKTRVIVPVHYAGVACEMDTIMALAKKHNLFVVEDAAQGVMSTYKGRALGTIGHIGCFSFHETKNYTAGGEGGATLINDKALIERAEIIREKGTNRSQFFRGQVDKYTWRDIGSSYLMSDLQAAYLWAQLEAADRINQQRLALWQNYYDALAPLAKNGRIELPSIPDGCVQNAHMFYIKLRDIDDRSALINFLKEAEIMAVFHYIPLHGCPAGERFGEFHGEDRYTTKESERLLRLPLFYNLSPVNQRTVIATLLNYFS

SEQ ID NO: 8743 - DNA, 1251 bp, Escherichia coli
atgtcgttggcaaaagcgtccttgtggacggcggccagtacactggtcaagattggtgccgggttactggtcggtaagttgctggcagtgtcatttggtccggcggggcttgggctggcggcaaatttccgccagttgattaccgtgctcggcgtgcttgccggggcaggcatctttaacggcgtaaccaaatacgttgcccagtatcatgataatccccaacagctgcgccgcgtggtcggcacttcatcagcgatggtacttggcttctctacgctaatggcgctggtttttgtgctggcagctgcgctaatcagccaggggttgtttggtaataccgactatcaggggctggtgcgtttagtggcgctggtgcaaatggggattgcctggggcaacctgttactggcgttgatgaaaggctttcgcgatgccgcaggtaatgcgttatctctgattgtcggtagcttgattggcgttctcgcgtactacgtcagttatcgtttgggcggttatgaaggggcgttgctgggtctggcgctgattcccgcgctggtggtaattcctgctgttatcatgttgatcaaacgtggtgtcatcccgttaagctatctgaaacccagctgggataacggtctggcagggcagttgagcaaatttacgctcatggcgttgattacgtcggtgaccttgcctgttgcttacatcatgatgcgtaaactgctggcggcgcagtatagctgggatgaagtggggatctggcaaggggtgagcagtatttccgatgcctacctgcaatttattacggcatcgttcagcgtatatttgctgcccacgttgtcgcggttaacggaaaagcgcgatatcacccgggaagtggttaaatcgctgaaattcgtcttaccggcagtggcggcggcgagttttaccgtctggttgctgcgtgattttgctatctggctgctgttgtcgaataaatttaccgctatgcgcgatctctttgcctggcagttggtgggtgatgtgttaaaagtgggcgcttatgtctttggttatctggtgatcgccaaagcgtcactgcggttttatattctggcggaaatcagccagttcactttattgatggtatttgcccactggctaatccctgcgcatggcgcactgggcgcagcacaggcctatatggcaacctatatcgtctatttttctctttgttgtggcgtgtttttactctggcgtaggtgggcatga

SEQ ID NO: 8744 - protein, 416 aa, Escherichia coli
MSLAKASLWTAASTLVKIGAGLLVGKLLAVSFGPAGLGLAANFRQLITVLGVLAGAGIFNGVTKYVAQYHDNPQQLRRVVGTSSAMVLGFSTLMALVFVLAAALISQGLFGNTDYQGLVRLVALVQMGIAWGNLLLALMKGFRDAAGNALSLIVGSLIGVLAYYVSYRLGGYEGALLGLALIPALVVIPAVIMLIKRGVIPLSYLKPSWDNGLAGQLSKFTLMALITSVTLPVAYIMMRKLLAAQYSWDEVGIWQGVSSISDAYLQFITASFSVYLLPTLSRLTEKRDITREVVKSLKFVLPAVAAASFTVWLLRDFAIWLLLSNKFTAMRDLFAWQLVGDVLKVGAYVFGYLVIAKASLRFYILAEISQFTLLMVFAHWLIPAHGALGAAQAYMATYIVYFSLCCGVFLLWRRWA

SEQ ID NO: 8745 - DNA, 1086 bp, Escherichia coli
gtgggcatgactgtactgattcacgtactgggatcggatatccctcaccataaccgaaccgttctgcggtttttcaacgacgcgctggccgcgacgagcgggcacgcgcgcgagtttatggttgctggcaaggacgacggcttaagtgatagctgtccggcgctttctgtgcaatttttccctgggaaaaaatcgctggcggaagcggtcatcgcgaaagcaaaagctaaccgtcagcagcgattttttttccacggtcagttcaatcccaaactgtggctggctctgctgagtggtggcattaagcccagccagtttttctggcatatctggggagcagacctgtatgagctttccagtggcttgagatataagcttttttacccgctacgtcgcctggcgcaaaagagagtcggctgtgtatttgccacccgcggtgatttgagcttttttgccaaaacgcatccaaaggtgcggggagaactgctgtacttcccgacgcggatggacccttctcttaatacgatggcgaacgatcggcaacgtgaaggaaaaatgaccattctggtggggaactccggtgaccgcagcaatgagcatattgctgccttgcgcgccgttcatcagcaatttggcgatacggtaaaagtggtggtgccgatgggatatccgcctaataacgaagcgtacatcgaggaagttcgtcaggcgggactggagttattcagcgaagaaaacctacaagttctgagcgaaaaactggaatttgacgcctatctgacgctacttcgccagtgcgatctcggttactttatttttgcccgccagcagggcattggtacgctttgcttactgattcaggcgggcattccttgcgtgcttaaccgggaaaatccgttctggcaggatatgacggaacagcatttgccagtactgtttactaccgatgatctcaacgaggatattgtgcgtgaagcgcagcgccagttggcgtcggtggataaaaacaccattgccttctttagccctaactatctacaaggctggcagcgggcgttggcgattgccgccggggaggtcgcatga

SEQ ID NO: 8746 - protein, 361 aa, Escherichia coli
MGMTVLIHVLGSDIPHHNRTVLRFFNDALAATSGHAREFMVAGKDDGLSDSCPALSVQFFPGKKSLAEAVIAKAKANRQQRFFFHGQFNPKLWLALLSGGIKPSQFFWHIWGADLYELSSGLRYKLFYPLRRLAQKRVGCVFATRGDLSFFAKTHPKVRGELLYFPTRMDPSLNTMANDRQREGKMTILVGNSGDRSNEHIAALRAVHQQFGDTVKVVVPMGYPPNNEAYIEEVRQAGLELFSEENLQVLSEKLEFDAYLTLLRQCDLGYFIFARQQGIGTLCLLIQAGIPCVLNRENPFWQDMTEQHLPVLFTTDDLNEDIVREAQRQLASVDKNTIAFFSPNYLQGWQRALAIAAGEVA

SEQ ID NO: 8747 - DNA, 1353 bp, Escherichia coli
atgagtctgctgcaattcagtggcctgtttgttgtctggctgctctgcacgctgtttattgccacgctgacctggtttgagtttcgccgtgtgcgctttaacttcaatgtcttcttttcattgctgtttttgctcacctttttcttcggctttccgctgaccagcgtgctggtatttcgctttgatgttggtgtcgcgccgccagaaatcttgttgcaggcgttgctttctgcaggctgcttctacgcggtttactatgtcacctacaaaacccgtctacgcaaacgcgttgctgatgcaccgcgccgtccgctgtttaccatgaaccgcgtggagaccaatctcacgtgggtgatcctgatgggcatcgctctggtgagcgtcggcatcttcttcatgcacaacggctttttgctgttccggcttaattcttacagtcagatcttttccagcgaagtctccggcgtggcattaaaacgcttcttttactttttcatcccggcgatgctggtggtttattttctgcgccaggatagcaaagcgtggctgtttttcctcgtcagcacggttgcctttggcttgttgacttacatgattgtcggcggcactcgcgccaatatcatcatcgcattcgctatcttcctgtttattggcattattcgcggctggatttcgttgtggatgctggcggcggcgggcgtgctggggattgtgggcatgttctggctggcgctaaaacgctatggaatgaatgtgagcggcgatgaagcgttctatacgtttctctatctcactcgcgacaccttctcgccgtgggagaatctggcgttgctgttgcagaactacgacaacatcgacttccagggcctggctccaattgtccgcgatttctatgtctttatcccttcctggctgtggccgggtcgcccgagtatggtgctgaactccgccaactactttacctgggaagtgctgaataaccactccggactggcgatctcgcctacgcttataggctcactggttgttatgggcggcgcgttgttcatcccgctcggggcgattgtggttggactgattatcaaatggttcgactggctgtatgagctgggcaaccgcgagactaatcgctataaggctgcgatattgcacagtttctgcttcggggcgatcttcaatatgatcgtgctggcgcgtgaagggctggattcgtttgtctcacgcgtggtcttttttatcgtggtcttcggcgcatgtctgatgatcgcaaaactgttgtactggctttttgaaagcgccggactcattcataaacgaacaaaatcatcgctccggacgcaggttgaaggataa

SEQ ID NO: 8748 - protein, 450 aa, Escherichia coli
MSLLQFSGLFVVWLLCTLFIATLTWFEFRRVRFNFNVFFSLLFLLTFFFGFPLTSVLVFRFDVGVAPPEILLQALLSAGCFYAVYYVTYKTRLRKRVADAPRRPLFTMNRVETNLTWVILMGIALVSVGIFFMHNGFLLFRLNSYSQIFSSEVSGVALKRFFYFFIPAMLVVYFLRQDSKAWLFFLVSTVAFGLLTYMIVGGTRANIIIAFAIFLFIGIIRGWISLWMLAAAGVLGIVGMFWLALKRYGMNVSGDEAFYTFLYLTRDTFSPWENLALLLQNYDNIDFQGLAPIVRDFYVFIPSWLWPGRPSMVLNSANYFTWEVLNNHSGLAISPTLIGSLVVMGGALFIPLGAIVVGLIIKWFDWLYELGNRETNRYKAAILHSFCFGAIFNMIVLAREGLDSFVSRVVFFIVVFGACLMIAKLLYWLFESAGLIHKRTKSSLRTQVEG

SEQ ID NO: 8749 - DNA, 741 bp, Escherichia coli
atgaataacaacaccacggcaccgacctatacgctgcgtggcttacagttgattggttggcgtgatatgcagcacgccctcgattatctgttcgctgacgggcagcttaagcagggaacgctggttgccattaatgccgaaaaaatgctgaccattgaagataacgctgaggtcagggagttaattaacgctgccgaatttaaatatgcggatggcataagcgttgtacgttcagtacgtaaaaagtacccgcaggcgcaggtttcccgcgttgctggggccgatctctgggaagagctgatggcgcgcgcaggcaaagaagggacacaggtatttcttgtgggcggtaaacctgaagtgctggcgcaaactgaagctaaactgcgcaaccagtggaatgtgaatatcgttggcagtcaggatggttattttaaacccgagcagcgtcaggcgctgtttgaacgcattcatgccagcggagcgcaaatcgtcaccgttgcgatgggagcgccaaagcaggagatcttcatgcgcgactgccgtctggtgcatccagatgcgctgtatatgggcgttggcgggacctacgatgttttcaccggtcacgtaaaacgcgcaccgaaaatctggcaaacgctggggctggagtggctctaccgcctgctttcgcagccgagccgcattaagcgtcagcttcgtttgctgcgttatttacgctggcattacaccggcaacctctga

SEQ ID NO: 8750 - protein, 246 aa, Escherichia coli
MNNNTTAPTYTLRGLQLIGWRDMQHALDYLFADGQLKQGTLVAINAEKMLTIEDNAEVRELINAAEFKYADGISVVRSVRKKYPQAQVSRVAGADLWEELMARAGKEGTQVFLVGGKPEVLAQTEAKLRNQWNVNIVGSQDGYFKPEQRQALFERIHASGAQIVTVAMGAPKQEIFMRDCRLVHPDALYMGVGGTYDVFTGHVKRAPKIWQTLGLEWLYRLLSQPSRIKRQLRLLRYLRWHYTGNL

SEQ ID NO: 8751 - DNA, 99 bp, Escherichia coli
atgctttccggtgttaccgtttatcgttatgggtacatcgagtgttgcgaatgttttcgtaattcaggagaaatggcaaataaagcattaaaaatttga

SEQ ID NO: 8752 - protein, 32 aa, Escherichia coli
MLSGVTVYRYGYIECCECFRNSGEMANKALKI

SEQ ID NO: 8753 - DNA, 1320 bp, Escherichia coli
  n 1301, 1302, 1303, 1304, 1305: n is any nucleotide
atggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgttcctcgaaccggttaccggttcgttcgccgtttacgcgcatcgttatatgagcccgttctttggttatctcaccgcctggtcttactggtttatgtggatggcggtggggatctcagaaatcaccgccattggcgtttatgtccagttctggttcccggagatggcgcagtggatacccgcattgatcgcggtggcgctggtggcgttggcgaatctggctgcggtgaggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgctggtggctggaaagggttcctgaccgcattgtgtattgtggtggcgtcctaccagggcgtggagctgattggcattactgccggtgaagcgaagaatccgcaggtgacgctgcgcagtgccgtaggcaaggtgctgtggcgaatcctgattttctacgttggcgcgattttcgttatcgttactatcttcccgtggaatgaaataggcagcaacggtagcccgttcgtactgactttcgccaaaatcggcattaccgcagcggcgggcattatcaactttgtggttctgacggctgcgctctctggctgtaacagcggcatgtacagttgcggacgtatgctctacgcactggcgaaaaaccgtcagttaccggcggcaatggcgaaagtttcccgtcacggcgtaccggttgcgggtgtggcagtatctattgctattctgctaattggctcatgcctgaactacatcattcccaatccgcagcgtgtgtttgtttacgtctacagtgccagcgtgcttccggggatggtgccatggtttgtgatattgataagccagctgcgttttcgtcgtgcgcataaagcagcaattgccagccatccgttccgctcaatcctgttcccttgggccaactacgtaacaatggcattcctgatttgcgttttgatcggcatgtactttaatgaagatacgcgtatgtcgctgtttgtcgnnnnncattccattcattaa

SEQ ID NO: 8754 - protein, 439 aa, Escherichia coli
  Xaa 434, 435: Xaa is any amino acid
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVXXHSIH

SEQ ID NO: 8755 - DNA, 822 bp, Escherichia coli
  n 4, 5, 6, 7, 8: n is any nucleotide
atgnnnnnctaccagcgacagcttgaggcgatcatccattttgccagcgaaaatggcctgcaaagctggcagcaatgtgatgtgacgatggtgcgtaattttgctgtacgcagtcgccgtaaagggctgggagctgcaagtctggcgttacggctttctgcgctacgtagcttttttgactggctggtcagccagaatgaactcaaagctaacccggcgaaaggtgtttcggcaccgaaagcgccgcgtcatctgccgaaaaacatcgacgtcgatgatatgaatcggctgctggatattgatatcaacgatcccctcgccgtgcgcgatcgggcaatgctggaagtgatgtacggcgcgggtctgcgtctttccgagctggtggggctcgatatcaaacacctcgacctggagtctggcgaagtgtgggtgatgggaaaaggcagcaaagagcgccgcctgccgattggtcgcaacgccgtggcgtggattgagcactggcttgatttgcgcgacctgtttggtagtgaagacgacgcgctttttctgtcgaaactgggcaaacgcatctccgcgcgtaatgtgcagaaacgctttgccgaatggggcataaaacaagggctgaataatcacgttcacccgcataaattacgtcactcattcgctacccatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataa

SEQ ID NO: 8756 - protein, 273 aa, Escherichia coli
  Xaa 2, 3: Xaa is any amino acid
MXXYQRQLEAIIHFASENGLQSWQQCDVTMVRNFAVRSRRKGLGAASLALRLSALRSFFDWLVSQNELKANPAKGVSAPKAPRHLPKNIDVDDMNRLLDIDINDPLAVRDRAMLEVMYGAGLRLSELVGLDIKHLDLESGEVWVMGKGSKERRLPIGRNAVAWIEHWLDLRDLFGSEDDALFLSKLGKRISARNVQKRFAEWGIKQGLNNHVHPHKLRHSFATHMLESSGDLRGVQELLGHANLSTTQIYTHLDFQHLASVYDAAHPRAKRGK

SEQ ID NO: 8757 - DNA, 411 bp, Escherichia coli
  n 384, 385, 386, 387, 388: n is any nucleotide
atgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacatgcagcaatgatcaactttgccaaatggcgcagccggatcgacgtcccgcagcaaacccacgacactttaaaacagctggcgaagaannnnncattccattcattaattaattaa

SEQ ID NO: 8758 - protein, 136 aa, Escherichia coli
  Xaa 128, 129, 130: Xaa is any amino acid
MRFYRPLGRISALTFDLDDTLYDNRPVILRTEREALTFVQNYHPALRSFQNEDLQRLRQAVREAEPEIYHDVTRWRFRSIEQAMLDAGLSAEEASAGAHAAMINFAKWRSRIDVPQQTHDTLKQLAKXXXFHSLIN

SEQ ID NO: 8759 - DNA, 822 bp, Escherichia coli; identical to SEQ ID NO: 8755
  n 4, 5, 6, 7, 8: n is any nucleotide

SEQ ID NO: 8760 - protein, 273 aa, Escherichia coli; identical to SEQ ID NO: 8756
  Xaa 2, 3: Xaa is any amino acid

SEQ ID NO: 8761 - DNA, 411 bp, Escherichia coli; identical to SEQ ID NO: 8757
  n 384, 385, 386, 387, 388: n is any nucleotide

SEQ ID NO: 8762 - protein, 136 aa, Escherichia coli; identical to SEQ ID NO: 8758
  Xaa 128, 129, 130: Xaa is any amino acid

SEQ ID NO: 8763 - DNA, 1236 bp, Escherichia coli
atgcagcaacaggttccaacgcgtgcttttcatgtgatggcgaaaccgagcggttctgattgtaatctgaactgtgactactgtttttatctcgaaaaacaatccctttaccacgaaaagccagtcacgcatatggacgatgacacgctggaagcgtatgtccgtcactatatcgctgccagcgaaacccaaaacgaagtggcttttacctggcagggcggcgaaccaacgttactcgggctggatttttaccgccgtgccgtggcgctacaggcgaaatatggtgctggcaggaagataagtaatagcttccagactaacggcgtgctgctcgatgacgaatggtgtgcatttctggcagaaaatcattttcttgtagggttatcgctggatggtccggctgagatccacaatcaatatcgcgtgaccaaaggtggcagaccaacgcataagctggtgatgcgtgctctgacgctcctgcaaaaacatcatgtcgactataacgtgctggtctgcgtcaatcgcaccagtgcgttacaacctttgcaagtctatgattttctgtgtgatgcaggtgttgagttcatccagtttattccggtggtcgagcgcctggctgatgaaacggctgctcatgctggacttaagctacatgctcccggcgatattcagggcgaactgacggaatggtcggtgtgcccgcaagagttcggtgagtttctggtggcgattttcgaccactggattaagcgcgacgtcggcaaggttttcgtaatgaatatcgaatgggcgttcgccaattttgtcggcgcaccgggcgcggtttgccatcatcagccaacctgtgggcgctcggtgattgttgaacacaacggcgatgtttacgcctgcgatcactatgtttatccgcagtatcgactagggaatatgcttcagcagacgattgcagaaatgattgattccccgcaacagcaggcatttggtgaagataaattcaagcagttaccggcacagtgtcgcagttgcaacgtgttaaaagcgtgctggggaggctgcccgaaacaccgctttatgctcgatgccagcggcaaacccgggctgaattatttgtgtgccgggtatcagcgttatttccgccatctaccgccatatcttaaagcaatggctgatttgctggcgcacggtcgtccggccagcgacattatgcaggcgcatttgatggtggtgaataagtag

SEQ ID NO: 8764 - protein, 411 aa, Escherichia coli
MQQQVPTRAFHVMAKPSGSDCNLNCDYCFYLEKQSLYHEKPVTHMDDDTLEAYVRHYIAASETQNEVAFTWQGGEPTLLGLDFYRRAVALQAKYGAGRKISNSFQTNGVLLDDEWCAFLAENHFLVGLSLDGPAEIHNQYRVTKGGRPTHKLVMRALTLLQKHHVDYNVLVCVNRTSALQPLQVYDFLCDAGVEFIQFIPVVERLADETAAHAGLKLHAPGDIQGELTEWSVCPQEFGEFLVAIFDHWIKRDVGKVFVMNIEWAFANFVGAPGAVCHHQPTCGRSVIVEHNGDVYACDHYVYPQYRLGNMLQQTIAEMIDSPQQQAFGEDKFKQLPAQCRSCNVLKACWGGCPKHRFMLDASGKPGLNYLCAGYQRYFRHLPPYLKAMADLLAHGRPASDIMQAHLMVVNK

SEQ ID NO: 8765 - DNA, 1656 bp, Escherichia coli
atggaattttcgttttcacccaaacttcttgttgttgctgtcgccgcagctcttcctctcatagccagcgcagcagataccccgtcaaccgccaccgcacgcaaaggctttgccggatacgatcacccaaaccagtatctggttaaaccggcgaccactattgccgacaacatgatgccggtgatgcagcatcctgcacaagacaaagaaacccagcagaaactggcggaacttgagaaaaaaaccggtaagaaaccgaacgtggttgttttcttgctggatgatgtgggctggatggacgttggctttaacggcggcggcgtggcggtgggtaaccctacaccagatatcgacgccgttgccagccaggggctgattttaacttcggcgtattctcaaccgagttcttccccaacccgcgccacgattctcaccggacaatactccatccaccacggcattctgatgccgccaatgtacgggcaaccgggcggtctgcaagggttaaccacgctgccgcagttgctgcacgatcagggctacgtcacccaggctatcgggaaatggcatatgggggaaaacaaagagtcgcagccgcagaacgttggctttgatgatttccgcggctttaactcggtgtccgatatgtataccgaatggcgtgatgttcatgtcaacccggaagtcgccctgagcccggctcgttctgaatacatccaaaaactgccgttcagcaaagatgacgttcatgccgtgcgcggcggtgaacaggaagccattgccgacattacgccgaaatatatggaagacctggatcaacgctggatggaatatggcgttaagttcctcgacaagatggcgaagagtgataagcctttcttcctctattacggcactcgcggctgtcacttcgataactacccgaacgccaaatatgcgggtagctctccggcgcgcacctcttacggcgactgcatggtggagatgaacgatatcttcgccaatctgtataaagcactggagaaaaacggtcagcttgataacacgctgattgtgttcacctctgataacggtccggaagccgaagttccgccgcacggtcgcacgccgttccgcggtgcgaaaggttctacatgggaaggcggcgttcgtgtgccaaccttcgtttactggaaaggcatgatccaaccgcgtaaatctgacggcattgtcgatctggcggatctcttccctacggcgctggatctggcggggcatcctggggcgaaagtagcgaatttagtaccgaaaaccacctttatcgatggtgtggaccagacatctttcttcctgggaacaaatggtcagtctaaccgtaaggccgagcactacttcctcaacggtaaactttctgctgtgcgtatggatgagttcaagtatcacgtcctgattcagcaaccttacgcttatacccagagcggatatcagggtggattcaccggcacagtaatgcaaacggcgggatcgtcggtgtttaacctgtacaccgatccgcaggaaagcgactctatcggcgtgcgccatattccgatgggtgtaccgctacagaccgaaatgcacgcgtatatggagatcctgaaaaaatatccaccacgcgcgcagattaaatctgactaa

SEQ ID NO: 8766 - protein, 551 aa, Escherichia coli
MEFSFSPKLLVVAVAAALPLIASAADTPSTATARKGFAGYDHPNQYLVKPATTIADNMMPVMQHPAQDKETQQKLAELEKKTGKKPNVVVFLLDDVGWMDVGFNGGGVAVGNPTPDIDAVASQGLILTSAYSQPSSSPTRATILTGQYSIHHGILMPPMYGQPGGLQGLTTLPQLLHDQGYVTQAIGKWHMGENKESQPQNVGFDDFRGFNSVSDMYTEWRDVHVNPEVALSPARSEYIQKLPFSKDDVHAVRGGEQEAIADITPKYMEDLDQRWMEYGVKFLDKMAKSDKPFFLYYGTRGCHFDNYPNAKYAGSSPARTSYGDCMVEMNDIFANLYKALEKNGQLDNTLIVFTSDNGPEAEVPPHGRTPFRGAKGSTWEGGVRVPTFVYWKGMIQPRKSDGIVDLADLFPTALDLAGHPGAKVANLVPKTTFIDGVDQTSFFLGTNGQSNRKAEHYFLNGKLSAVRMDEFKYHVLIQQPYAYTQSGYQGGFTGTVMQTAGSSVFNLYTDPQESDSIGVRHIPMGVPLQTEMHAYMEILKKYPPRAQIKSD

SEQ ID NO: 8767 - DNA, 1197 bp, Escherichia coli
atgctaaaagtgttattgctctttgtgttgctgattgcggggatcgtggttggcccgatgattgccggccatcagggttacgtgctgatccagaccgacaactacaatattgaaaccagcgtcacgggcctcgcgattattttgattctggcgatggtagtgctgtttgccattgagtggctactgcggcgaatcttccgcacaggcgcgcacacccgtgggtggtttgtcggacgtaagcgtcgccgtgcacgtaagcagaccgaacaggcgctgctgaaactggcggaaggcgattatcagcaagttgaaaagctgatggcgaaaaatgccgatcacgctgaacaaccggtggtgaactatctactggcagccgaagccgcgcaacaacgtggtgatgaagcacgcgccaaccaacatctggaacgcgcagcggagctggccggcaatgacaccattccggtagaaatcacccgtgtacgtctgcaactggcccgtaatgaaaaccatgcagcacgtcacggcgtggataagctgctggaagttacgccacgccatccggaagtattacgtctggcggaacaggcgtatatccgcactggtgcatggagttcgctgctggatatcatcccatcaatggcgaaagcccatgttggtgatgaagaacatcgtgcaatgctggaacaacaggcatggattggcctgatggatcaggcgcgtgccgataacggtagtgaaggtttgcgtaactggtggaaaaaccaaagccggaaaacgcgtcatcaggtggccttgcaggtggcaatggcggaacatcttattgagtgtgacgatcatgatactgcccagcaaattatcatcgatggcctgaaacgccagtatgacgatcgcctgctgctgccgatcccgcgtctgaaaaccaataacccggaacagctggaaaaagtgctgcgccaacagatcaaaaacgtgggcgatcgcccgctgttgtggagcacactgggtcagtcgctgatgaaacacggagaatggcaggaagcatcgctcgccttccgcgcagcgctgaaacaacgtccggacgcctacgattacgcatggcttgccgacgcgctggacagactgcacaagccggaagaagccgcagcgatgcgtcgcgacggtttgatgttaacgttgcagaacaacccgccacagtag

SEQ ID NO: 8768 - protein, 398 aa, Escherichia coli
MLKVLLLFVLLIAGIVVGPMIAGHQGYVLIQTDNYNIETSVTGLAIILILAMVVLFAIEWLLRRIFRTGAHTRGWFVGRKRRRARKQTEQALLKLAEGDYQQVEKLMAKNADHAEQPVVNYLLAAEAAQQRGDEARANQHLERAAELAGNDTIPVEITRVRLQLARNENHAARHGVDKLLEVTPRHPEVLRLAEQAYIRTGAWSSLLDIIPSMAKAHVGDEEHRAMLEQQAWIGLMDQARADNGSEGLRNWWKNQSRKTRHQVALQVAMAEHLIECDDHDTAQQIIIDGLKRQYDDRLLLPIPRLKTNNPEQLEKVLRQQIKNVGDRPLLWSTLGQSLMKHGEWQEASLAFRAALKQRPDAYDYAWLADALDRLHKPEEAAAMRRDGLMLTLQNNPPQ

SEQ ID NO: 8769 - DNA, 1200 bp, Escherichia coli
atgacggaacaagaaaaaacctccgccgtggttgaagagaccagggaggccgtggacaccacgtcacaacctgtcgcaacagaaaaaaagagtaagaacaataccgcattgattctcagcgcggtggctatcgctattgctctggcggcgggcgtcggtttgtatggctggggtaaacaacaggccgtcaatcagactgccaccagcgatgccctggctaaccaacttacggcactgcaaaaagcccaggagagccaaaaagccgagctggaaggcattatcaagcaacaagctgtacagcttgagcaggcgaatcgtcagcaagaaacgctggcaaaacagctggatgaagtccaacaaaaggtcgccaccatttccggcagcgatgctaaaacctggctgctggcccaggccgattttctggtgaaactcgccggacggaagctgtggagcgatcaggacgtcacgaccgctgcagcgttgctgaaaagtgcagacgccagcctggcggatatgaatgacccgagtctgattaccgttcgccgggcaattaccgatgatatcgccagcctttctgcggtatcgcaggtggattatgacggtatcatccttaagcttaatcagctttcaaatcaggtagataatctgcgtctggccgataatgacagcgatggttcgccgatggattccgacggtgaagagctttccagttccatcagcgaatggcgtatcaatctgcaaaaaagctggcagaactttatggacaacttcattacgattcgccgtcgtgatgacaccgccgtaccgctgttagcgccaaatcaggatatctatctgcgcgaaaatattcgctctcgcctgctggtcgcagcacaagctgtaccgcgtcaccaggaagagacttatcgccaggcgctggagaacgtctccacctgggtacgtgcttactacgatactgatgatgccaccaccaaagcgttcctcgacgaggtggaccagttaagccagcaaaatatctcgatggatcttccggaaaccctgcaaagccaggcgatgctggaaaaattgatgcagacccgcgtgcgtaacctgctggcacaaccggcagcagggacaacggaagctaaacctgcacctgcacctgcacctgcacctgcaccgcaagctgatgctccggcagccgcgccgcaaggagaataa

SEQ ID NO: 8770 - protein, 399 aa, Escherichia coli
MTEQEKTSAVVEETREAVDTTSQPVATEKKSKNNTALILSAVAIAIALAAGVGLYGWGKQQAVNQTATSDALANQLTALQKAQESQKAELEGIIKQQAVQLEQANRQQETLAKQLDEVQQKVATISGSDAKTWLLAQADFLVKLAGRKLWSDQDVTTAAALLKSADASLADMNDPSLITVRRAITDDIASLSAVSQVDYDGIILKLNQLSNQVDNLRLADNDSDGSPMDSDGEELSSSISEWRINLQKSWQNFMDNFITIRRRDDTAVPLLAPNQDIYLRENIRSRLLVAAQAVPRHQEETYRQALENVSTWVRAYYDTDDATTKAFLDEVDQLSQQNISMDLPETLQSQAMLEKLMQTRVRNLLAQPAAGTTEAKPAPAPAPAPAPQADAPAAAPQGE

SEQ ID NO: 8771 - DNA, 741 bp, Escherichia coli
atgagtatcctggtcacccgcccgtctcccgcaggagaagagttagtgagccgtctgcgcacactggggcaggtggcctggcattttccgctgattgagttttctccgggtcgacaattaccgcaacttgctgatcaactggcagcgctgggagagagcgatctgttgtttgccctctcgcaacacgcggttgcttttgcccaatcacagctgcatcagcaagatcgtaaatggccccgactacctgattatttcgccattggacgcaccaccgcgctggcactacataccgtaagcggacagaagattctctacccgcaggatcgggaaatcagcgaagtcttgctacaattacctgaattacaaaatattgcgggcaaacgtgcgctgatattacgtggcaatggcggtcgtgagctaattggggattccctgacggcgcgcggtgctgaggtcactttttgtgaatgttatcaacgatgcgcaatccattacgatggtgcagaagaagcgatgcgctggcaatcccgcgaggtgacgacggtcgttgttaccagcggtgaaatgttgcagcaactctggtcgctgatcccacaatggtatcgtgagcactggttactacgctgtcgactattggtcgtcagtgagcgtttggcgaaactcgcccgggaactgggctggcaagacattaaggtcgccgataacgctgacaacgatgcgcttttacgggcattacaataa

SEQ ID NO: 8772 - protein, 246 aa, Escherichia coli
MSILVTRPSPAGEELVSRLRTLGQVAWHFPLIEFSPGRQLPQLADQLAALGESDLLFALSQHAVAFAQSQLHQQDRKWPRLPDYFAIGRTTALALHTVSGQKILYPQDREISEVLLQLPELQNIAGKRALILRGNGGRELIGDSLTARGAEVTFCECYQRCAIHYDGAEEAMRWQSREVTTVVVTSGEMLQQLWSLIPQWYREHWLLRCRLLVVSERLAKLARELGWQDIKVADNADNDALLRALQ

SEQ ID NO: 8773 - DNA, 963 bp, Escherichia coli
atgataatgacggtaacaagcatgttagacaatgttttaagaattgccacacgccaaagcccacttgcactctggcaggcacactatgtcaaagacaagttgatggcgagccatccgggcctggtcgttgaactggtaccgatggtgacgcgcggcgatgtgattcttgatacgccgctggcgaaagtaggcggaaaaggcttatttgtgaaagagctggaagtcgcgctcctcgaaaatcgcgccgatatcgccgtacattcaatgaaagatgtgccggttgaattcccacaaggtctggggctggtcaccatttgcaagcgcgaagatccccgcgatgcctttgtatccaacacctatgacagtctggatgcgttaccggcaggcagtatcgtcgggacgtccagtttacgtcgccagtgccaactggctgaacgccgcccggatctgattatccgctccctgcgcggcaacgtcggcactcgtctgagcaaactggataacggcgaatatgatgccatcattcttgccgtagccggactaaaacgtttaggtctggagtcccgcattcgcgccgcgttgccacccgagatttctcttccggcggtagggcaaggtgcggtgggcattgaatgccgccttgatgatgcacgcactcgcgagctgctcgccgcgctgaatcaccacgaaactgcactgcgcgttaccgccgaacgcgccatgaatacccgtctcgaaggcggatgtcaggtgccaattggtagctacgccgagcttattgatggcgaaatctggctgcgtgcgttggtcggcgcgccggacggttcgcagattattcgcggtgaacgccgcggtgcgccgcaagatgccgaacaaatggggatttcgctggcagaagagctactgaataacggcgcgcgcgagatcctcgctgaagtctataacggagacgccccggcatga

SEQ ID NO: 8774 - protein, 320 aa, Escherichia coli
MIMTVTSMLDNVLRIATRQSPLALWQAHYVKDKLMASHPGLVVELVPMVTRGDVILDTPLAKVGGKGLFVKELEVALLENRADIAVHSMKDVPVEFPQGLGLVTICKREDPRDAFVSNTYDSLDALPAGSIVGTSSLRRQCQLAERRPDLIIRSLRGNVGTRLSKLDNGEYDAIILAVAGLKRLGLESRIRAALPPEISLPAVGQGAVGIECRLDDARTRELLAALNHHETALRVTAERAMNTRLEGGCQVPIGSYAELIDGEIWLRALVGAPDGSQIIRGERRGAPQDAEQMGISLAEELLNNGAREILAEVYNGDAPA

SEQ ID NO: 8775 - DNA, 2547 bp, Escherichia coli
ttgtacctctatattgagactctgaaacagagactggatgccataaatcaattgcgtgtggatcgcgcgcttgctgctatggggcctgcattccaacaggtctacagtctactgccgacattgttgcactatcaccatccgctaatgccgggttaccttgatggtaacgttcccaaaggcatttgcctttacacgcctgatgaaactcaacgccactacctgaacgagcttgaactgtatcgtggaatgtcagtacaggacccaccgaaaggtgagcttccaattactggtgtatacaccatgggcagcacctcgtccgtagggcaaagttgttcctctgacctggatatctgggtctgtcatcaatcctggctcgatagcgaagagcgccagttgctacaacgtaaatgtagtctgctggaaagctgggccgcctcgctgggtgtggaagtcagcttcttcctgattgatgaaaaccgcttccgtcataatgaaagcggcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgttgacgccaaatgaatggctggatcttggtggcttaagctcgctttctgctgaagagtactttggtgccagcctttggcagctctacaagagtatcgattccccatacaaagcggtgctgaaaacactgctgctggaagcctattcctgggaatacccgaacccacgtctgctggcgaaagatatcaaacagcgtttgcacgacggcgaaatagtgtcgtttggtctcgacccgtattgcatgatgctggagcgcgtcactgaatatctgacggcgatcgaagattttactcgtctggatttagttcgccgatgcttctatttaaaagtttgcgaaaaactcagccgtgaacgcgcctgcgtaggctggcgtcgtgaagtgttaagccagttggtgaaagagtgggaatgggacgatgctcgtctggcgatgcttgataatcgcgctaactggaagattgatcaggtgcgtgaggcgcacaacgagttgctcgacgcgatgatgcagagctaccgcaatctgatccgctttgcgcgtcgcaataaccttagcgtttccgccagcccgcaggatatcggtgttctgacacgtaaactgtacgccgcgtttgaagcgttaccgggtaaagtgacgctggtaaacccgcagatttcacccgatctctcggaaccgaatctgacctttatttatgtgccgccgggccgggctaaccgttcaggttggtatctgtataaccgcgcgccaaatattgagtcgatcatcagccatcagccgctggaatataaccgttacctgaataaactggtggcgtgggcatggtttaacggcctgctgacctcgcgcacccgcttgtatattaaaggtaacggcattgtcgatttgcctaagttgcaggagatggtcgccgacgtgtcgcaccatttcccgctgcgcttacctgcaccgacaccgaaggcgctctacagcccgtgtgagatccgccatctggcgattatcgttaacctggaatatgacccgacagctgcgttccgcaatcaggtggtgcattttgatttccgtaagctggatgtcttcagctttggcgagaatcaaaattgcctggtaggtagcgttgacctgctgtatcgcaactcgtggaacgaagtgcgtacgctgcacttcaacggcgagcaatcgatgatcgaagccctgaaaactattctcggcaaaatgcatcaggacgccgcgccgccagatagcgtggaagtcttctgttatagccagcatctgcgcggcttaatccgtactcgcgtgcagcaactggtttctgagtgtattgaactgcgtctttccagcacccgccaggaaaccgggcgcttcaaggcgctgcgcgtctccggtcaaacctggggcttgttcttcgaacggctgaatgtctcggtacagaaactggaaaacgccatcgagttttatggcgctatttcgcataacaaactgcacggcctgtcagtgcaggttgaaaccaatcacgtcaaattaccggcggtggtggacggctttgccagcgaagggatcatccagtttttcttcgaagaaacgcaagacgagaatggctttaatatctacattctcgacgaaagcaaccgggttgaggtgtatcaccactgcgaaggcagcaaagaggaactggtgcgtgacgtcagtcgcttctactcgtcttcgcacgaccgtttcacctacggctcaagcttcatcaacttcaacctgccgcagttctatcagattgtgaaggttgatggtcgtgaacaggtgattccgtttcgcaccaaatctatcggtaacatgccacctgccaatcaggagcatgacgcgccgctgttgcagcagtatttttcgtga

SEQ ID NO: 8776 - protein, 848 aa, Escherichia coli
MYLYIETLKQRLDAINQLRVDRALAAMGPAFQQVYSLLPTLLHYHHPLMPGYLDGNVPKGICLYTPDETQRHYLNELELYRGMSVQDPPKGELPITGVYTMGSTSSVGQSCSSDLDIWVCHQSWLDSEERQLLQRKCSLLESWAASLGVEVSFFLIDENRFRHNESGSLGGEDCGSTQHILLLDEFYRTAVRLAGKRILWNMVPCDEEEHYDDYVMTLYAQGVLTPNEWLDLGGLSSLSAEEYFGASLWQLYKSIDSPYKAVLKTLLLEAYSWEYPNPRLLAKDIKQRLHDGEIVSFGLDPYCMMLERVTEYLTAIEDFTRLDLVRRCFYLKVCEKLSRERACVGWRREVLSQLVKEWEWDDARLAMLDNRANWKIDQVREAHNELLDAMMQSYRNLIRFARRNNLSVSASPQDIGVLTRKLYAAFEALPGKVTLVNPQISPDLSEPNLTFIYVPPGRANRSGWYLYNRAPNIESIISHQPLEYNRYLNKLVAWAWFNGLLTSRTRLYIKGNGIVDLPKLQEMVADVSHHFPLRLPAPTPKALYSPCEIRHLAIIVNLEYDPTAAFRNQVVHFDFRKLDVFSFGENQNCLVGSVDLLYRNSWNEVRTLHFNGEQSMIEALKTILGKMHQDAAPPDSVEVFCYSQHLRGLIRTRVQQLVSECIELRLSSTRQETGRFKALRVSGQTWGLFFERLNVSVQKLENAIEFYGAISHNKLHGLSVQVETNHVKLPAVVDGFASEGIIQFFFEETQDENGFNIYILDESNRVEVYHHCEGSKEELVRDVSRFYSSSHDRFTYGSSFINFNLPQFYQIVKVDGREQVIPFRTKSIGNMPPANQEHDAPLLQQYFS

SEQ ID NO: 8777 - DNA, 321 bp, Escherichia coli
atgaacgacagtgaatttcatcgcctggctgatcaactgtggctgaccattgaagaacatctggacgactgggatggcgacagcgatatcgactgtgaaatcaacggcggtgtactaaccattacctttgagaacggcagcaaaatcattatcaaccgccaggaaccactgcaccaggtgtggctggcaaccaaacagggtggctaccattttgatctgaaaggcgacgagtggatttgcgatcgtagcggtgaaaccttctgggatttgctggaacaggcggcgacgcagcaggcgggtgaaacagttagtttccgctaa

SEQ ID NO: 8778 - protein, 106 aa, Escherichia coli
MNDSEFHRLADQLWLTIEEHLDDWDGDSDIDCEINGGVLTITFENGSKIIINRQEPLHQVWLATKQGGYHFDLKGDEWICDRSGETFWDLLEQAATQQAGETVSFR

SEQ ID NO: 8779 - DNA, 1317 bp, Escherichia coli
atgaatggtcaaataatcacagttgcactcatcctgttggggaacacatttctgacacctcctgtacaggccatagggttcgactattacaatgatcacagtgtcatgtcttacggtaaaggttattggggggataagaaaatcattgcccaatttccggagatgaacagggccgatttgcgccttgtgaaaaatatctctgggaagacgggttatataccttccgatgaaataagcatagaaaatgaggaatatcactgggtgacagacggccacgttattctctggcgtggcaaaatcgttagcaatccaccgggaacacccactgtcgatattgccagctttcaggctatgggccgcttcgcggtcgataaatatagcctctattttgacggacagcgtaccgaaagtaatagcggcgcgtcacgtgttgatctggcgacactaaaagctatcgaaggtaactctaccacgctggtggatagtaaaaatctctacttgtccggtcgacgtcaggggagcagcagtaatgttactgtattagaaaaaagatggtggggtattaatccacgtcttatgagtgtaaacagaaatttgtattccaatgatctgcttatccgcagtgggcagaatatttatttaaatggcgctcaccttacggcgaatgcagactcatttgagataattcgctggatacctcattcactgctggtttttcgcgacaataagggtctgcatcgttatccctttggtcaattatctggcaaagcgatacccgtagatgatgacgtctcttttgaagtaggggaaagtcgcgttcgctggcgtaaacagctcacgcccgaccgtcagtggagcaagtggatagacctaccgggtattgaacctgaacaatttcatctgattactgacaatattgcgcagtataaagatcgactgtatgtaacaaaattatcgacttttggtgaagaccagcttgagataatcccgctggatacgccagacctggtcattgatgactcatttaatagcggcaaacaacatgcttactttatccgccaattacggtcacgcaagagcgtgcaaattattccagttaacggtccgctaactaaaaacgatcgcttcgcttatgacgatcgcaatgtttatacctggactgatacagaggtaaggattacgccctcccactgcccggcgaaaacacgcgtcagagaagagaatgtccgtgaaattcataacagcgacattattattccggtgacggatgaatcatgccggaacgcagcagcagacgggcaaactttgaagccctga

SEQ ID NO: 8780 - protein, 438 aa, Escherichia coli
MNGQIITVALILLGNTFLTPPVQAIGFDYYNDHSVMSYGKGYWGDKKIIAQFPEMNRADLRLVKNISGKTGYIPSDEISIENEEYHWVTDGHVILWRGKIVSNPPGTPTVDIASFQAMGRFAVDKYSLYFDGQRTESNSGASRVDLATLKAIEGNSTTLVDSKNLYLSGRRQGSSSNVTVLEKRWWGINPRLMSVNRNLYSNDLLIRSGQNIYLNGAHLTANADSFEIIRWIPHSLLVFRDNKGLHRYPFGQLSGKAIPVDDDVSFEVGESRVRWRKQLTPDRQWSKWIDLPGIEPEQFHLITDNIAQYKDRLYVTKLSTFGEDQLEIIPLDTPDLVIDDSFNSGKQHAYFIRQLRSRKSVQIIPVNGPLTKNDRFAYDDRNVYTWTDTEVRITPSHCPAKTRVREENVREIHNSDIIIPVTDESCRNAAADGQTLKP

SEQ ID NO: 8781 - DNA, 1470 bp, Escherichia coli
atgcactatcgcaatgtggtttgtttattgtcttgttcgttgtttttatcgtcggcatggggatgtcggcttgatgagccggaacataatatttaccagaaacagggaaaaggcgtggtgtatttgcgcccttatgaaaagaccaatctttcgctaccgcagattaactacaagcgtctgcgtctgttaccgaatttgctaattgacccaaccaaactggaggattgggaaacggtgcccccggctaccaatctcatgacagacgttgtctacagcggcgcaaacgcaactcttccccattactcttactatagcgatggtcgcgctattctctacgctggcgagattgtgcaaaaccctccaggcacaccgccagtcgatatctcgtcatttcaggcatggggtgattttgccgcagataagtacagcctctattacgaaggcaaacgcaccgatagcaaccagcaactaaaccgccgaacgttgcgtcaggtagaatttaacccgcaatggaaaccagactggctaggtttgattctccgtgacaagcactatctttacgcaaatggtcagcgccttgatgatcccgacacctttacggtactggctcaaaagtcatgggatcagcgcggtaaattctctacagcatttaatccctgccttcctgccccatttggcccctgggatacgctagcccgcacacagacgaaaatcatgatcaacggagaacaactggatgccgacccggacaccttttccgtcgtgcgctggatgcccggctcactcttcacctggcgtgataaaaacgggctgcagcgtaaagtcctcgacaaggaaaatctggcgtgggatgaagatttaacaaagcactgtctggatttttctctgcaggaaaagaaagtgttctggcgtaaagggcctgcttgtaaacaggaagaattatccggactcgatcctgaacagttccaccccatcagtgatgctgtcgcccagtatcaggattcgctttataccatcatcgaaacagagtctggtgaccgcaagttggagatcgtaaaactcgatgaccccaatcttattatcaacaaacgtttcaacgccgggaaacgccacggctatttacttacgcgtgccgaagggtgggtaaaccattccagtttacacgtgtttgaatctgacggaccgctgatcttactggataaccgctctccggatgaacgcgaagcccatcttaatgaccatccctttttgcgcagatggtatgcccgcgataaccgctacgtttacagctttgatggcgcgcagctctggcgataccgcaccgctgatccgaaacaagttcgcttaatctggaaggaacaacattcgggatatggctatggcgtaaattacaaaacgggatatctggacggaaaaattaccgatgacggcgaatttattcctgccccacgcaatgaggcaacaaaatga

SEQ ID NO: 8782 - protein, 489 aa, Escherichia coli
MHYRNVVCLLSCSLFLSSAWGCRLDEPEHNIYQKQGKGVVYLRPYEKTNLSLPQINYKRLRLLPNLLIDPTKLEDWETVPPATNLMTDVVYSGANATLPHYSYYSDGRAILYAGEIVQNPPGTPPVDISSFQAWGDFAADKYSLYYEGKRTDSNQQLNRRTLRQVEFNPQWKPDWLGLILRDKHYLYANGQRLDDPDTFTVLAQKSWDQRGKFSTAFNPCLPAPFGPWDTLARTQTKIMINGEQLDADPDTFSVVRWMPGSLFTWRDKNGLQRKVLDKENLAWDEDLTKHCLDFSLQEKKVFWRKGPACKQEELSGLDPEQFHPISDAVAQYQDSLYTIIETESGDRKLEIVKLDDPNLIINKRFNAGKRHGYLLTRAEGWVNHSSLHVFESDGPLILLDNRSPDEREAHLNDHPFLRRWYARDNRYVYSFDGAQLWRYRTADPKQVRLIWKEQHSGYGYGVNYKTGYLDGKITDDGEFIPAPRNEATK

SEQ ID NO: 8783 - DNA, 204 bp, Escherichia coli
atgaaaaacgtgtttaaggcactcactgtattacttactctcttcagcctgacgggctgcggtctgaaaggtccgctctatttcccgcctgcagataaaaacgcaccgccgccgaccaaaccggtagagacgcaaacgcaatccacggtgccggacaaaaacgaccgcgccactggcgatggtccatcccaggtgaattactaa

SEQ ID NO: 8784 - protein, 67 aa, Escherichia coli
MKNVFKALTVLLTLFSLTGCGLKGPLYFPPADKNAPPPTKPVETQTQSTVPDKNDRATGDGPSQVNY

SEQ ID NO: 8785 - DNA, 825 bp, Escherichia coli
atgcagttctcgaaaatgcatggccttggcaacgattttatggtcgtcgacgcggtaacgcagaatgtctttttttcaccggagctgattcgtcgcctggcggatcggcacctgggggtagggtttgaccaattgctggtggttgagccgccgtatgatcctgaactggattttcactatcgcattttcaatgctgatggcagtgaagtggcgcagtgcggcaacggcgcgcgctgctttgcccgttttgtgcgcctgaaagggctgaccaataagcgcgatatccgcgtcagcaccgccaacgggcggatggttctgaccgtcaccgatgatgatctggtccgcgtaaatatgggcgaacccaacttcgaaccttccgccgtgccgtttcgcgctaacaaagcggaaaagacctatattatgcgcgccgccgagcagacaatcttatgcggcgtggtgtcgatgggaaatccacattgcgtgattcaggtcgatgatgtcgataccgctgcggtagaaacgcttggtcctgttctggaaagccacgaacgtttcccggagcgcgccaatatcggttttatgcaagtggttaagcgcgagcatattcgtttacgcgtttatgagcgtggggcaggagaaacccaggcctgcggcagcggcgcgtgtgcggcggttgcagtagggatccagcaaggtttgctggccgaagaagtacgcgtggagctccccggcggtcgtcttgatatcgcctggaaaggtccgggtcacccgttatatatgactggcccggcggtacatgtctacgacggatttattcatctatga

SEQ ID NO: 8786 - protein, 274 aa, Escherichia coli
MQFSKMHGLGNDFMVVDAVTQNVFFSPELIRRLADRHLGVGFDQLLVVEPPYDPELDFHYRIFNADGSEVAQCGNGARCFARFVRLKGLTNKRDIRVSTANGRMVLTVTDDDLVRVNMGEPNFEPSAVPFRANKAEKTYIMRAAEQTILCGVVSMGNPHCVIQVDDVDTAAVETLGPVLESHERFPERANIGFMQVVKREHIRLRVYERGAGETQACGSGACAAVAVGIQQGLLAEEVRVELPGGRLDIAWKGPGHPLYMTGPAVHVYDGFIHL

SEQ ID NO: 8787 - DNA, 708 bp, Escherichia coli
atgaagcaaccaggggaagaactgcaggaaacactcacggagcttgatgaccgggcggttgtcgattatctgattaaaaatcctgagttttttatccgcaatgcgcgcgcagtagaagcgatacgtgtgccgcatccggtacgcggcaccgtttcgttggtcgagtggcacatggcccgcgcacgtaatcatattcatgttctggaagagaacatggcgctgttgatggaacaggcaatcgccaacgaaggcctgttttatcgtctactctacctgcagcgcagtctcaccgccgccagcagtctcgatgatatgctgatgcgctttcaccgctgggcgcgcgatctcggcctggcaggtgcgagtctgcgcctgtttccggatcgctggcgcttaggtgcgccgtcgaaccacactcatctggcattaagccgtcagtctttcgaaccgctgcgtattcagcgtctggggcaggaacagcactatctggggccgcttaacggaccggagcttctggtggtgctaccggaagcgaaagcggtgggatcggtggcgatgtcgatgctgggaagcgatgctgatttgggtgttgtgctgtttaccagtcgcgatgccagtcactatcaacaagggcagggaacgcagttacttcatgaaattgcactgatgttgccggagcttctggcgcgttggattgaacgcgtatga

SEQ ID NO: 8788 - protein, 235 aa, Escherichia coli
MKQPGEELQETLTELDDRAVVDYLIKNPEFFIRNARAVEAIRVPHPVRGTVSLVEWHMARARNHIHVLEENMALLMEQAIANEGLFYRLLYLQRSLTAASSLDDMLMRFHRWARDLGLAGASLRLFPDRWRLGAPSNHTHLALSRQSFEPLRIQRLGQEQHYLGPLNGPELLVVLPEAKAVGSVAMSMLGSDADLGVVLFTSRDASHYQQGQGTQLLHEIALMLPELLARWIERV

SEQ ID NO: 8789 - DNA, 897 bp, Escherichia coli
atgaccgatttacacaccgatgtagaacgctacctacgttatctgagcgtggagcgccagcttagcccgataaccctgcttaactaccagcgacagcttgaggcgatcatccattttgccagcgaaaatggcctgcaaagctggcagcaatgtgatgtgacgatggtgcgtaattttgctgtacgcagtcgccgtaaagggctgggagctgcaagtctggcgttacggctttctgcgctacgtagcttttttgactggctggtcagccagaatgaactcaaagctaacccggcgaaaggtgtttcggcaccgaaagcgccgcgtcatctgccgaaaaacatcgacgtcgatgatatgaatcggctgctggatattgatatcaacgatcccctcgccgtgcgcgatcgggcaatgctggaagtgatgtacggcgcgggtctgcgtctttccgagctggtggggctcgatatcaaacacctcgacctggagtctggcgaagtgtgggtgatgggaaaaggcagcaaagagcgccgcctgccgattggtcgcaacgccgtggcgtggattgagcactggcttgatttgcgcgacctgtttggtagtgaagacgacgcgctttttctgtcgaaactgggcaaacgcatctccgcgcgtaatgtgcagaaacgctttgccgaatggggcataaaacaagggctgaataatcacgttcacccgcataaattacgtcactcattcgctacccatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataa

SEQ ID NO: 8790 - protein, 298 aa, Escherichia coli
MTDLHTDVERYLRYLSVERQLSPITLLNYQRQLEAIIHFASENGLQSWQQCDVTMVRNFAVRSRRKGLGAASLALRLSALRSFFDWLVSQNELKANPAKGVSAPKAPRHLPKNIDVDDMNRLLDIDINDPLAVRDRAMLEVMYGAGLRLSELVGLDIKHLDLESGEVWVMGKGSKERRLPIGRNAVAWIEHWLDLRDLFGSEDDALFLSKLGKRISARNVQKRFAEWGIKQGLNNHVHPHKLRHSFATHMLESSGDLRGVQELLGHANLSTTQIYTHLDFQHLASVYDAAHPRAKRGK

SEQ ID NO: 8791 - DNA, 717 bp, Escherichia coli
atgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacatgcagcaatgatcaactttgccaaatggcgcagccggatcgacgtcccgcagcaaacccacgacactttaaaacagctggcgaagaaatggccgctggtggcgatcaccaacggtaacgcccagccggaactgtttggtttggggcattattttgagtttgtgctgcgcgctggcccgcacgggcgctcaaaaccgttcagcgatatgtacttcctggcggcggaaaaactcaacgtgccgatcggcgagatcttacatgtcggggacgatctcaccactgacgtgggtggggcaattcgcagcggaatgcaggcctgttggatcagaccggaaaatggcgatctgatgcaaacctgggacagccgtttactgccgcatctggaaatttcccggttggcatctctgacctcgctgatataa

SEQ ID NO: 8792 - protein, 238 aa, Escherichia coli
MRFYRPLGRISALTFDLDDTLYDNRPVILRTEREALTFVQNYHPALRSFQNEDLQRLRQAVREAEPEIYHDVTRWRFRSIEQAMLDAGLSAEEASAGAHAAMINFAKWRSRIDVPQQTHDTLKQLAKKWPLVAITNGNAQPELFGLGHYFEFVLRAGPHGRSKPFSDMYFLAAEKLNVPIGEILHVGDDLTTDVGGAIRSGMQACWIRPENGDLMQTWDSRLLPHLEISRLASLTSLI

SEQ ID NO: 8793 - DNA, 2217 bp, Escherichia coli
ttggcggagggcgttgcgcttctccgcccaacctatttttacgcggcggtgccaatggacgtttcttacctgctcgacagccttaatgacaaacagcgcgaagcggtggccgcgccacgcagcaaccttctggtgctggcgggcgcgggcagtggtaagacgcgcgtactggtgcatcgtatcgcctggctgatgagcgtggaaaactgctcgccatactcgattatggcggtaacgtttaccaacaaagcggcggcggagatgcgtcatcgtatcgggcagctgatgggcaccagccagggcggcatgtgggtcggcaccttccacgggctggcgcaccgtctgctgcgtgcgcaccatatggacgccaatctgccgcaggattttcagatcctcgacagcgaggaccagctacgcctgctcaaacgcctaatcaaggcgatgaacctcgacgagaagcagtggccgccgcgccaggcaatgtggtacatcaacagccagaaagatgaggggctgcgtccgcatcatattcagagctacggtaatccggtggagcagacctggcagaaggtgtatcaggcgtatcaggaagcgtgtgaccgcgcgggcctggtggacttcgccgagctgctgctacgtgctcacgagttgtggcttaacaagccgcatatccttcagcactatcgcgaacggtttaccaatatcctggtggacgaattccaggataccaacaacattcagtatgcgtggatccgactgctggcaggcgatactggcaaagtgatgatcgttggcgatgacgaccagtcaatctacggctggcgcggagcgcaggtggagaatattcagcgtttcctcaatgatttccccggtgctgaaactatccgtctggagcagaactaccgctctaccagcaatattctgagcgccgctaacgccctgattgaaaacaataacgggcgtctgggtaaaaaactgtggaccgatggcgcggacggtgagcctatttccctctattgcgcttttaacgaactcgacgaagcgcgttttgtggttaaccgcatcaaaacctggcaggacaacggcggggcgcttgccgagtgcgccattctctaccgcagcaacgcccagtcgcgtgtgctggaagaggcgttattgcaggcgagtatgccgtatcgtatttacggcgggatgcgcttcttcgaacgccaggaaatcaaagatgcgctctcgtatctgcgcctgattgccaaccgcaacgacgacgcggcctttgagcgtgtggttaatacgccaacgcggggtattggtgaccggacgctggacgtggtacgtcagacatcgcgcgatcgccagttaacactctggcaggcatgtcgtgaactgttgcaggaaaaagccctcgccggacgtgctgccagcgccttacagcggtttatggagctgatcgacgccttagcgcaggaaactgccgatatgccgctgcatgtacagactgaccgggtaattaaagactccggcctgcgcaccatgtacgagcaggagaagggcgaaaaaggtcagacgcgtatcgaaaacttagaggaactggtgacggcaacgcgccagttcagctacaacgaagaagacgaagatttaatgccgctgcaggcattcctctcccatgcggcgctggaagcgggcgaggggcaggcggatacctggcaggacgcggtgcagttgatgacgctacactcggcgaaaggtctggaattcccgcaggtgtttatcgttggtatggaagagggcatgttcccaagccagatgtcgctggatgaaggcgggcgtctggaagaagaacgccgtctggcctacgttggcgtaacccgcgcgatgcagaaactgacgctgacctacgcggaaacccgccgtctatatggcaaagaggtttaccatcgcccgtcgcgctttatcggtgagttgccggaagagtgtgtggaagaggtgcgcctgcgcgccacggtaagccgcccggtcagccatcaacggatggggacgccgatggtcgagaacgacagcggctacaagctcggccagcgcgtacgccacgctaagtttggtgaaggcaccatcgtcaatatggaaggcagcggtgagcatagccgtttgcaggtggcgttccagggccagggtattaaatggctggtggcggcttacgcccggttggagacggtgtga

SEQ ID NO: 8794 - protein, 738 aa, Escherichia coli
MAEGVALLRPTYFYAAVPMDVSYLLDSLNDKQREAVAAPRSNLLVLAGAGSGKTRVLVHRIAWLMSVENCSPYSIMAVTFTNKAAAEMRHRIGQLMGTSQGGMWVGTFHGLAHRLLRAHHMDANLPQDFQILDSEDQLRLLKRLIKAMNLDEKQWPPRQAMWYINSQKDEGLRPHHIQSYGNPVEQTWQKVYQAYQEACDRAGLVDFAELLLRAHELWLNKPHILQHYRERFTNILVDEFQDTNNIQYAWIRLLAGDTGKVMIVGDDDQSIYGWRGAQVENIQRFLNDFPGAETIRLEQNYRSTSNILSAANALIENNNGRLGKKLWTDGADGEPISLYCAFNELDEARFVVNRIKTWQDNGGALAECAILYRSNAQSRVLEEALLQASMPYRIYGGMRFFERQEIKDALSYLRLIANRNDDAAFERVVNTPTRGIGDRTLDVVRQTSRDRQLTLWQACRELLQEKALAGRAASALQRFMELIDALAQETADMPLHVQTDRVIKDSGLRTMYEQEKGEKGQTRIENLEELVTATRQFSYNEEDEDLMPLQAFLSHAALEAGEGQADTWQDAVQLMTLHSAKGLEFPQVFIVGMEEGMFPSQMSLDEGGRLEEERRLAYVGVTRAMQKLTLTYAETRRLYGKEVYHRPSRFIGELPEECVEEVRLRATVSRPVSHQRMGTPMVENDSGYKLGQRVRHAKFGEGTIVNMEGSGEHSRLQVAFQGQGIKWLVAAYARLETV

SEQ ID NO: 8795 - DNA, 903 bp, Escherichia coli
atgaaaaaaacgctcgcaacattatttttattaacctgtctggggtcatcatccgcttatgcggataacgctttgattttacaaacggattttagcctgaaagatggcgccgtctcggcgatgaaaggggtcgctttcggcgttgaccataatcttaaaatatttgatttaacacacgaaattccaccgtataacatctgggaaggcgcttaccgcctgtatcagactgccagttactggccgcaaggttcggtgtttgttagcgtggtcgatccaggtgttggtacagaccgtaaatcggtagtgctgaaaaccaaaaatggtcagtacttcgtttcaccagataacggtacgctcacgttggtggcggaatcgctgggtattgagagcgtccggcaaatcgatgaaaaaaccaaccgtctgaaaggttccgaaaagtcatataccttccacggtcgtgacgtgtatgcctacaccggtgcacgtctggcttccggggcgatcacgttcgagcaggtggggccagagcttcctgcaaaagttgtcgaactttcttatcagaaagccaaagcaacaaaaggtgaagtgaagggcaatatcccgattctcgatattcagtacggcaacgtctggagcaatatcagcgacgagttgctgaatcaggcaggaatcaaactcaacgacacgttgtgtgtgaccatttccgaaggttcccagcaaaaatacgcagggaaaatgccgtatgtcgcaagcttcggcgatgtgccggaaggccagccgatggtgtatctgaacagcttattgaatgtttccgtggcgctgaatatggataatttcgcgcagaaacatcaggttgcgtctggtgctgactggaatattgatgtgaagaagtgcgctaagtaa

SEQ ID NO: 8796 - protein, 300 aa, Escherichia coli
MKKTLATLFLLTCLGSSSAYADNALILQTDFSLKDGAVSAMKGVAFGVDHNLKIFDLTHEIPPYNIWEGAYRLYQTASYWPQGSVFVSVVDPGVGTDRKSVVLKTKNGQYFVSPDNGTLTLVAESLGIESVRQIDEKTNRLKGSEKSYTFHGRDVYAYTGARLASGAITFEQVGPELPAKVVELSYQKAKATKGEVKGNIPILDIQYGNVWSNISDELLNQAGIKLNDTLCVTISEGSQQKYAGKMPYVASFGDVPEGQPMVYLNSLLNVSVALNMDNFAQKHQVASGADWNIDVKKCAK

SEQ ID NO: 8797 - DNA, 726 bp, Escherichia coli
ttgaatctcaaacggatttttctcaccctcaccttacttcccttgtttgctgttgccgctgatgattgcgcaccctcagatccgacgctgaccgtacaggcgtataccgttaatcctcaaacagagcgggtgaaaatgtactggcaaaaagccaatggcgaagcgtggggaacgttacatgctctgctggcggatattaatagtcagggtcaggtgcagatggcgatgaacggcggcatctatgatgaaagctatgcgccgctcggtttgtacatcgaaaacggtcagcagaaggtggcgttaaatctcgcttcaggtgaagggaatttctttattcgtcctggcggagtgttttatgtcgcgggagataaagtcggcatcgttcgtctggatgcctttaaaaccagtaaagagattcagtttgcggtgcagtcagggccattgttgatggaaaacggtgtaattaatccgcgtattcatcccaacgtcgcctcacgtaaaattcgtaacggtgttgggattaataaacatgggaacgccgtgtttttgttgagccagcaggcgacaaatttttatgattttgcctgttatgccaaagcgaaactgaacgttgagcagctgctttatcttgatggcacaatttcacatatgtatatgaaaggcgaggcaatcccgtggcaacgctatccttttgtcaccatgatttccgtcgagcagaaaggttaa

SEQ ID NO: 8798 - protein, 241 aa, Escherichia coli
MNLKRIFLTLTLLPLFAVAADDCAPSDPTLTVQAYTVNPQTERVKMYWQKANGEAWGTLHALLADINSQGQVQMAMNGGIYDESYAPLGLYIENGQQKVALNLASGEGNFFIRPGGVFYVAGDKVGIVRLDAFKTSKEIQFAVQSGPLLMENGVINPRIHPNVASRKIRNGVGINKHGNAVFLLSQQATNFYDFACYAKAKLNVEQLLYLDGTISHMYMKGEAIPWQRYPFVTMISVEQKG

SEQ ID NO: 8799 - DNA, 114 bp, Escherichia coli
atgtgggatttttttatcctgttagcgaccttgacgagtaccaaaaagcgcgaagttcaactattgttctgtggtgttctgttgcgtgttgacggcaaaattttgctggcgtaa

SEQ ID NO: 8800 - protein, 37 aa, Escherichia coli
MWDFFILLATLTSTKKREVQLLFCGVLLRVDGKILLA

SEQ ID NO: 8801 - DNA, 951 bp, Escherichia coli
atgctgagcgcatttcaactggaaaataaccgactgacccggctggaagtcgaagagtcacaaccccttgtaaatgcagtatggattgatcttgtcgaaccggacgacgacgagcgactgcgcgtacaatctgaacttggccagagcctggcaacccgcccggaactggaagacatcgaagcatcggcacgtttctttgaagacgatgacggcctgcatattcactccttcttcttctttgaagatgcggaagatcacgccggtaactccactgtggcatttaccatccgtgatggtcgtctgtttactctgcgtgagcgtgaactgcccgcttttcgtctgtatcgtatgcgtgcccgtagccagtcaatggtggacggtaacgcctacgagctgctgctggatctgttcgaaaccaaaatcgaacagttggcagatgaaattgaaaatatctacagcgacctggagcagttgagccgggtaattatggaagggcatcagggcgatgagtacgacgaggcgctctccacgctggcggaactggaagatatcggctggaaagttcgcctgtgtctgatggatacccagcgcgcgctcaacttcctggtacgtaaagcacgcttaccgggtgggcaactggagcaggcgcgtgaaatcctgcgagatatcgaatccctgctgccgcataacgaatccctgttccagaaggtgaacttcctgatgcaggcggcgatgggctttatcaatatcgagcagaaccgcatcatcaaaatcttctcggtggtatccgtggtgttcctgccaccgacgctggtcgcttccagctacgggatgaactttgagtttatgccggaactgaagtggagcttcggctacccaggcgcgattatctttatgatcctcgcgggcctggcaccgtatctgtactttaagcggaagaactggttgtaa

SEQ ID NO: 8802 - protein, 316 aa, Escherichia coli
MLSAFQLENNRLTRLEVEESQPLVNAVWIDLVEPDDDERLRVQSELGQSLATRPELEDIEASARFFEDDDGLHIHSFFFFEDAEDHAGNSTVAFTIRDGRLFTLRERELPAFRLYRMRARSQSMVDGNAYELLLDLFETKIEQLADEIENIYSDLEQLSRVIMEGHQGDEYDEALSTLAELEDIGWKVRLCLMDTQRALNFLVRKARLPGGQLEQAREILRDIESLLPHNESLFQKVNFLMQAAMGFINIEQNRIIKIFSVVSVVFLPPTLVASSYGMNFEFMPELKWSFGYPGAIIFMILAGLAPYLYFKRKNWL

SEQ ID NO: 8803 - DNA, 498 bp, Escherichia coli
atgaaaagaaaactccagaaaattatattatatttatttcttctatgctgcatctataatttatggacattgcgtcctgtacagattttgtatacatactctgatgctggcaattcagtctttctggtcgttgatcatctgccatggactgatagcgataaaataaattggtatctgaagcatcaggatgaaattaaaagtcaaaatcccctaccagaagatagttggcatacctggtatgttattgatatcggtaatggcttcactgactataaaaaatatatcgaagggccgtatgaagatctctactgtttcccgacgattaagagcaatgataattgcatcgtaaaaaactatttaatggttattaatgaatatccttaccgtaatactcatttttttattgctgataacaatgagtatcaactaacccaggaaaataagatagagcgagtgttcaacccgcatgactttgaaaaagacaattttcagcaataa

SEQ ID NO: 8804 - protein, 165 aa, Escherichia coli
MKRKLQKIILYLFLLCCIYNLWTLRPVQILYTYSDAGNSVFLVVDHLPWTDSDKINWYLKHQDEIKSQNPLPEDSWHTWYVIDIGNGFTDYKKYIEGPYEDLYCFPTIKSNDNCIVKNYLMVINEYPYRNTHFFIADNNEYQLTQENKIERVFNPHDFEKDNFQQ

SEQ ID NO: 8805 - DNA, 849 bp, Escherichia coli
atgaacaacatattaggctcatcaattaatatgccctgtacacttttcgaaactattactttattcgatgatttttctgctgatgatatgcagtatggggatatggaagaacaagattttctctctctcggcttaagcgacatctctgcaaaagttgatccttaccgcctcattaaataccattttcctgggccgaattctacttatggtgcttttagtgttccaacttctggaacaaaaatatcacaaagtgaatgtattgatattttatttgcagaaatgaaagatctggcaaaaatgttttccttttttggacaatacaaaacactcatccaggatctgattgatcattttagatatgaaaatggcaacagtttccatagccaggaattgaacttatcttttcatgaacgaataaacaaatatgattataatagcccaatacgtgtaatcaaagaatgtatcgaaaatgatatttcttcaacacctacgataggataccggcctcttctcctacaaaagattaagaccgaattactttcatcaagactaaataaattcaatgattttaaagataattttaatggcctgggaatcagcattcatgatatctcagctcaaaaaatatctcttttaaattttcaaaaatatcctatgggctggagcgctaccattcatttcatagcacaagaccactttggtttggatgtgactgatataaaaaacaagatttacaacaagtatagattttttcgcatatggttctttttacaacggcataaagactttgctttcaaaccttttttcaccaattttaacactatcgaaagaatcgaaaattatctatga

SEQ ID NO: 8806 - protein, 282 aa, Escherichia coli
MNNILGSSINMPCTLFETITLFDDFSADDMQYGDMEEQDFLSLGLSDISAKVDPYRLIKYHFPGPNSTYGAFSVPTSGTKISQSECIDILFAEMKDLAKMFSFFGQYKTLIQDLIDHFRYENGNSFHSQELNLSFHERINKYDYNSPIRVIKECIENDISSTPTIGYRPLLLQKIKTELLSSRLNKFNDFKDNFNGLGISIHDISAQKISLLNFQKYPMGWSATIHFIAQDHFGLDVTDIKNKIYNKYRFFRIWFFLQRHKDFAFKPFFTNFNTIERIENYL

SEQ ID NO: 8807 - DNA, 111 bp, Escherichia coli
ttggtcttgctcatcgctaataacataatgctgaatttaccaaaaatgaaatttattaaagcaaatgaaaatatacaacgacgtctggaaattctgcctttccttatgtga

SEQ ID NO: 8808 - protein, 36 aa, Escherichia coli
MVLLIANNIMLNLPKMKFIKANENIQRRLEILPFLM

SEQ ID NO: 8809 - DNA, 891 bp, Escherichia coli
atggatgcaaaacaaacgcggcagggcgtattactcgctcttgccgcttattttatttggggtattgcgccagcgtacttcaaactgatttactacgtgcccgccgatgagatcctgacgcatcgcgtgatctggtcgtttttctttatggtggtgctgatgagcatttgccgccagtggtcctatttaaaaacgctgattcagacgccacagaaaatttttatgctggcagtctctgccgtgctgattggcggcaactggctactgtttatctgggcggtgaacaatcaccatatgctggaagcgagccttggttactttattaacccgctggtgaacattgtgctggggatgattttcctcggcgagcgattccgccggatgcaatggctggcggtgattctggcgatatgtggagtgctggttcagttgtggacttttggttcactgccgatcatcgcgctggggctggcgtttagttttgctttctacggcctggtgcgcaagaagattgctgttgaagcgcaaaccggcatgttaatcgaaactatgtggttgctgcccgtggcggcgatttacctgtttgctattgccgacagctcaaccagtcatatggggcaaaacccgatgtcgctgaatttactgctgatcgccgccggtattgtcaccaccgtgccactgttgtgttttactgcagcggcgacacgcctgcgtctctcaacgttaggctttttccagtacattggtccgacgctgatgttcctgctggctgtgacgttttatggtgaaaaaccgggtgccgataagatggtaactttcacctttatttgggtggcgctggcaatttttgtgatggatgcgatttatacgcagcgtagaacgtccaaataa

SEQ ID NO: 8810 - protein, 296 aa, Escherichia coli
MDAKQTRQGVLLALAAYFIWGIAPAYFKLIYYVPADEILTHRVIWSFFFMVVLMSICRQWSYLKTLIQTPQKIFMLAVSAVLIGGNWLLFIWAVNNHHMLEASLGYFINPLVNIVLGMIFLGERFRRMQWLAVILAICGVLVQLWTFGSLPIIALGLAFSFAFYGLVRKKIAVEAQTGMLIETMWLLPVAAIYLFAIADSSTSHMGQNPMSLNLLLIAAGIVTTVPLLCFTAAATRLRLSTLGFFQYIGPTLMFLLAVTFYGEKPGADKMVTFTFIWVALAIFVMDAIYTQRRTSK

SEQ ID NO: 8811 - DNA, 486 bp, Escherichia coli
atgaagtgtaaggatgttatgtctgccgtactgaccgctgaacaagccctcaaattagtgggtgagatgtttgtttatcacataccatttaaccgcgcattggggatggaactggagcgttacgaaaaagagttcgcacagctggcctttaaaaatcagccgatgatggtgggcaactgggcgcaaagcattttacacggcggggtcattgcgtcggcgctggatgtcgccgcaggtctggtgtgcgtgggaagtaccttaacccgccacgaaaccatcagtgaagatgaactacgccagcggctatcgcggatggggaccattgatcttcgcgtcgattatctgcgcccaggcagaggcgagcgttttactgctaccagtagcctgttacgtgcaggcaataaagtcgccgtcgcccgcgttgaattacacaatgaagaacagctttatattgccagtgccaccgccacctatatggtaggttga

SEQ ID NO: 8812 - protein, 161 aa, Escherichia coli
MKCKDVMSAVLTAEQALKLVGEMFVYHIPFNRALGMELERYEKEFAQLAFKNQPMMVGNWAQSILHGGVIASALDVAAGLVCVGSTLTRHETISEDELRQRLSRMGTIDLRVDYLRPGRGERFTATSSLLRAGNKVAVARVELHNEEQLYIASATATYMVG

SEQ ID NO: 8813 - DNA, 870 bp, Escherichia coli
atgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcaccctttatccttatgacaccaactacatcatctacacccaaaccagcgatctgaataaagaagcgattgccagttacgactgggcggaaaacgcgcgtaaggatgaagtaaagttccagttgagcctggcgtttccgctgtggcgtgggattttggggccaaactctgtactgggcgcctcctacacacagaaatcctggtggcagctttctaatagcgatgagtcatcaccgtttcgtgaaactaactacgaaccgcaattgttcctcggttttgccacggattacaactttgctggctggacgctgcgcgatgtggaaatgggctacaaccacgactcaaacgggcgttcagacccgacttcccgcagctggaaccgcctttatacccgcctgatggcagaaaacggtaactggctggtagaggtgaagccgtggtatgtggtggggaatacggacgataacccggacatcaccaaatatatgggttactaccagcttaaaatcggctatcacctcggtgatgcggtactgagcgcgaaagggcagtacaactggaacaccggttacggcggcgcggagttaggcttaagctacccgatcaccaaacatgtgcgcctttatactcaggtttacagcggttacggcgaatcgctcatcgactataacttcaaccagacccgcgttggtgtgggagttatgctaaacgacctgttttga

SEQ ID NO: 8814 - protein, 289 aa, Escherichia coli
MRTLQGWLLPVFMLPMAVYAQEATVKEVHDAPAVRGSIIANMLQEHDNPFTLYPYDTNYIIYTQTSDLNKEAIASYDWAENARKDEVKFQLSLAFPLWRGILGPNSVLGASYTQKSWWQLSNSDESSPFRETNYEPQLFLGFATDYNFAGWTLRDVEMGYNHDSNGRSDPTSRSWNRLYTRLMAENGNWLVEVKPWYVVGNTDDNPDITKYMGYYQLKIGYHLGDAVLSAKGQYNWNTGYGGAELGLSYPITKHVRLYTQVYSGYGESLIDYNFNQTRVGVGVMLNDLF

SEQ ID NO: 8815 - DNA, 1830 bp, Escherichia coli
gtggcgcaggcggaagtgttgaatctggagtccggagctaaacaggttttacaagaaacctttggctaccaacagtttcgccccggccaggaagagattatcgacaccgtactttccggtcgcgattgcctggtcgtcatgcccactggtggcggaaaatccctttgctatcaaatccctgccttattgctaaacggccttaccgtggttgtttcaccgctgatttccttgatgaaagatcaggtggatcaactgcaagccaacggcgtggcggcggcgtgccttaactcgacgcaaacccgcgagcagcaacttgaagttatgacaggctgtcgcaccgggcaaatccgcctgctttatatcgcgccggaacgcctgatgctggataactttcttgagcatctggcgcactggaatccggtgttattagccgttgatgaagcgcactgtatctcccaatggggccacgatttccgcccggaatacgctgccctcggtcagctgcgtcagcgttttccgacgctgccgtttatggcgctgactgccaccgccgacgacaccacgcgccaggatatcgtgcgcctgctggggctgaacgatccgctaattcaaatcagcagttttgaccgtccgaatattcgctacatgctgatggagaaattcaaaccgctcgatcagttgatgcgttatgtacaggaacaacgcggtaagtcggggattatttactgtaatagtcgtgcgaaagtagaagacaccgctgcgcgcctgcaaagcaagggaattagcgcggcggcctatcatgccgggctggaaaataatgttcgcgctgatgtgcaggaaaaattccagcgcgatgacctgcaaattgtggtggcgacggtggcgttcggcatgggcatcaacaagcctaacgttcgcttcgtggtgcattttgatattccgcgcaatatcgaatcctattatcaggaaactggacgcgccgggcgtgatggcctgcccgcggaagcgatgctgttttacgatccggctgatatggcgtggctgcgccgttgtctggaagagaagccgcaggggcagttgcaggatatcgaacgtcataaactcaatgcgatgggcgcgtttgccgaagcgcaaacttgtcgtcgtttggtattgctgaactattttggcgaagggcgtcaggagccgtgcgggaactgcgatatctgcctcgatccgccgaaacagtacgacggttcaaccgatgctcagattgccctttccaccattggtcgtgtgaatcagcggtttgggatgggttatgtggtggaagtgattcgcggtgctaataaccagcgtatccgcgactatggtcatgacaaactgaaagtctatggcatgggccgtgataaaagccatgaacattgggtgagcgtgatccgccagctgattcacctcggcctggtgacgcaaaatattgcccagcattctgccctacaactgacagaggctgcgcgtccggtgctgcgcggcgaatcctctttgcaacttgccgtgccgcgtatcgtggcgctcaaaccgaaagcgatgcagaaatcgttcggcggcaactatgatcgcaaactgttcgccaaattacgcaaactgcgtaaatcgattgccgatgaaagcaatgtcccgccgtacgtggtgtttaacgacgcaaccttgattgagatggcggagcagatgccgatcaccgccagcgaaatgctcagcgttaacggcgttggtatgcgcaagctggaacgctttggcaaaccgtttatggcgctgattcgtgcgcatgtcgatggtgacgacgaagagtag

SEQ ID NO: 8816 - protein, 609 aa, Escherichia coli
MAQAEVLNLESGAKQVLQETFGYQQFRPGQEEIIDTVLSGRDCLVVMPTGGGKSLCYQIPALLLNGLTVVVSPLISLMKDQVDQLQANGVAAACLNSTQTREQQLEVMTGCRTGQIRLLYIAPERLMLDNFLEHLAHWNPVLLAVDEAHCISQWGHDFRPEYAALGQLRQRFPTLPFMALTATADDTTRQDIVRLLGLNDPLIQISSFDRPNIRYMLMEKFKPLDQLMRYVQEQRGKSGIIYCNSRAKVEDTAARLQSKGISAAAYHAGLENNVRADVQEKFQRDDLQIVVATVAFGMGINKPNVRFVVHFDIPRNIESYYQETGRAGRDGLPAEAMLFYDPADMAWLRRCLEEKPQGQLQDIERHKLNAMGAFAEAQTCRRLVLLNYFGEGRQEPCGNCDICLDPPKQYDGSTDAQIALSTIGRVNQRFGMGYVVEVIRGANNQRIRDYGHDKLKVYGMGRDKSHEHWVSVIRQLIHLGLVTQNIAQHSALQLTEAARPVLRGESSLQLAVPRIVALKPKAMQKSFGGNYDRKLFAKLRKLRKSIADESNVPPYVVFNDATLIEMAEQMPITASEMLSVNGVGMRKLERFGKPFMALIRAHVDGDDEE

SEQ ID NO: 8817 - DNA, 621 bp, Escherichia coli
atgttgatgttattcctcaccgtcgccatggtgcacattgtggcgcttatgagccccggtcccgatttcttttttgtctctcagaccgctgttagtcgttcccgtaaagaagcgatgatgggcgtgctgggcattacctgcggcgtaatggtttgggctgggattgcgttgcttggcctacatttgattatcgaaaaaatggcctggctgcatacgctgattatggtgggcggtggcctgtatctctgctggatgggttaccagatgctacgtggtgcactgaaaaaagaggttgtttctgcccctgcgccacaagtcgaactggcgaaaagcgggcgcagttttcttaagggcttactgaccaatctcgcgaaccctaaagcgattatctactttggttcggtgttctcgctgtttgtcggtgataatgtcggcaccaccgaacgctggggcattttcgcgttgattattgtcgaaacactggcgtggtttaccgtcgttgccagcctgtttgctctgccgcaaatgcgccgtggttatcaacgtctggcgaagtggattgatggttttgccggggcgttatttgccggatttggcattcatttgattatttcgcgttaa

SEQ ID NO: 8818 - protein, 206 aa, Escherichia coli
MLMLFLTVAMVHIVALMSPGPDFFFVSQTAVSRSRKEAMMGVLGITCGVMVWAGIALLGLHLIIEKMAWLHTLIMVGGGLYLCWMGYQMLRGALKKEVVSAPAPQVELAKSGRSFLKGLLTNLANPKAIIYFGSVFSLFVGDNVGTTERWGIFALIIVETLAWFTVVASLFALPQMRRGYQRLAKWIDGFAGALFAGFGIHLIISR

SEQ ID NO: 8819 - DNA, 621 bp, Escherichia coli
atgaccttagaatggtggtttgcctacctgctgacatcgatcattttaagcctgtcgccaggctctggcgcaatcaacaccatgaccacctcgctcaaccacggttatcgcggcgcggtggcgtctattgctgggcttcagaccggactggcgattcatattgtgctggttggcgtggggttggggacgctattttcccgctcagtgattgcgtttgaagtgttgaagtgggcaggcgcagcttacttgatttggctgggaatacagcaatggcgcgccgctggcgcaattgatcttaaatcgctggcctccactcaatcgcgtcgacatttgttccagcgcgcagtttttgtgaatctcaccaatcccaaaagtattgtgtttctggcggcgctatttccgcaattcatcatgccgcagcagccacaactgatgcagtatatcgtgctcggcgtcaccactattgtggtcgatattattgtgatgatcggttacgccacccttgctcaacggattgctctatggattaaaggaccaaagcagatgaaggcgctgaataagattttcggctcgttatttatgctggtgggagcgctgttagcatcggcgaggcatgcgtga

SEQ ID NO: 8820 - protein, 206 aa, Escherichia coli
MTLEWWFAYLLTSIILSLSPGSGAINTMTTSLNHGYRGAVASIAGLQTGLAIHIVLVGVGLGTLFSRSVIAFEVLKWAGAAYLIWLGIQQWRAAGAIDLKSLASTQSRRHLFQRAVFVNLTNPKSIVFLAALFPQFIMPQQPQLMQYIVLGVTTIVVDIIVMIGYATLAQRIALWIKGPKQMKALNKIFGSLFMLVGALLASARHA

SEQ ID NO: 8821 - DNA, 1023 bp, Escherichia coli
atgtttcagcagcaaaaagactgggaaacaagagaaaacgcgtttgctgcttttaccatgggaccgctgactgatttctggcgtcagcgtgatgaagcagagtttactggtgtggatgacattccggttcgctttgtccgttttcgcgcacagcaccatgaccgggtggtagtcatctgtccggggcgtattgagagctacgtaaaatatgcggaactggcctacgacctgttccatttggggtttgatgttttaatcatcgaccatcgcgggcagggacgttccggtcgcctgttaggcgatccacatctcgggcatgttaatcgctttaatgattatgttgatgatctggcggcattctggcaacaggaggttcagcccggtccgtggcgtaaacgctatatactggcacattcgatgggcggtgcgatctccacattatttctgcaacgccatccaggtgtatgtgacgccattgcgctaactgcgccaatgtttgggattgtgattcgtatgccgtcatttatggcacggcagatcctcaattgggccgaagcgcatccacgtttccgtgatggctatgcgataggcaccgggcgctggcgcgcgttgccgtttgctatcaacgtactgacccacagcagacagcgatatcgacgtaacttacgtttctatgctgatgacccaacgattcgcgtcggtgggccgacctaccattgggtacgcgaaagtattctggctggcgaacaggtgttagccggtgcgggtgatgacgccacgccaacgcttctcttacaagctgaagaggaacgcgtggtggataaccgcatgcacgaccgtttttgtgaactacgcaccgctgcgggccatcctgtcgaaggaggacggccgttggtaattaaaggtgcgtaccatgagatcctttttgaaaaggacgcaatgcgctcagtcgcgctccacgctatcgttgattttttcaacaggcataactcacccagcggaaaccgctctacagaggtttaa

SEQ ID NO: 8822 - protein, 340 aa, Escherichia coli
MFQQQKDWETRENAFAAFTMGPLTDFWRQRDEAEFTGVDDIPVRFVRFRAQHHDRVVVICPGRIESYVKYAELAYDLFHLGFDVLIIDHRGQGRSGRLLGDPHLGHVNRFNDYVDDLAAFWQQEVQPGPWRKRYILAHSMGGAISTLFLQRHPGVCDAIALTAPMFGIVIRMPSFMARQILNWAEAHPRFRDGYAIGTGRWRALPFAINVLTHSRQRYRRNLRFYADDPTIRVGGPTYHWVRESILAGEQVLAGAGDDATPTLLLQAEEERVVDNRMHDRFCELRTAAGHPVEGGRPLVIKGAYHEILFEKDAMRSVALHAIVDFFNRHNSPSGNRSTEV

SEQ ID NO: 8823 - DNA, 864 bp, Escherichia coli
ttgattttttcaacaggcataactcacccagcggaaaccgctctacagaggtttaaatttcttatgtaccaggttgttgcgtctgatttagatggcacgttactttctcccgaccatacgttatccccttacgccaaagaaactctgaagctgctcaccgcgcgcggcatcaactttgtgtttgcgaccggtcgtcaccacgttgatgtggggcaaattcgcgataatctggagattaagtcttacatgattacctccaatggcgcgcgcgttcacgacctcgatggcaacctgatttttgctcataacctggatcgcgacattgccagtgacctgtttggcgtagtcaacgacaatccggacatcattactaacgtttatcgcgacgacgaatggtttatgaatcgccatcgcccggaagagatgcgcttttttaaagaagcggtgttcaaatatgcgctgtatgagccgggattgctggagccggaaggcgtcagcaaagtgttcttcacctgcgattcccatgaaaaacttctgccactggagcaagcgattaacgctcgctggggcgatcgcgtcaatgtcagtttctctaccttaacctgcctggaagtcatggctggcggcgtttcaaaaggccatgcgctggaagcggtggctaagaaactgggctacagtctgaaggattgtattgcgtttggtgatgggatgaacgacgccgaaatgctgtcgatggcggggaaaggctgcattatgggcagtgcgcaccagcgtctgaaagatctgcatccagagctggaagtgattggtactaacgccgaagacgcagtgccgcattatctgcgtaagctctatttatcgtaa

SEQ ID NO: 8824 - protein, 287 aa, Escherichia coli
MIFSTGITHPAETALQRFKFLMYQVVASDLDGTLLSPDHTLSPYAKETLKLLTARGINFVFATGRHHVDVGQIRDNLEIKSYMITSNGARVHDLDGNLIFAHNLDRDIASDLFGVVNDNPDIITNVYRDDEWFMNRHRPEEMRFFKEAVFKYALYEPGLLEPEGVSKVFFTCDSHEKLLPLEQAINARWGDRVNVSFSTLTCLEVMAGGVSKGHALEAVAKKLGYSLKDCIAFGDGMNDAEMLSMAGKGCIMGSAHQRLKDLHPELEVIGTNAEDAVPHYLRKLYLS

SEQ ID NO: 8825 - DNA, 954 bp, Escherichia coli
atgatcgaagtaaaacacctgaaaacgctacaagcgttgcggaactgcggctcactcgcagccgctgcggcgacgttgcatcaaacgcaatccgccctgtctcaccagtttagcgatctggaacaacgccttggcttccggctatttgtgcgtaaaagccagccgcttcggtttacaccgcagggagaaatcctgttgcaactggcgaatcaggtgctgccgcaaatcagccaggcactgcaagcctgcaatgaaccgcagcagacgcgcctgcgcattgccattgagtgccatagctgtattcagtggctgacgcccgcgttagaaaatttccataagaactggccgcaggtggagatggattttaaatcgggcgtgacgtttgacccgcagcccgcgttgcagcagggtgagctggatctggtgatgacctccgatattctgccgcgcagtggcctgcattattcgccgatgttcgactatgaagtgcgtctggtgttagcacctgaccatccactggcggcgaaaacgcgaatcacgccggaagacctcgccagcgaaacgctgttgatttatccggtgcagcgtagccgactggatgtctggcggcattttcttcagccagcaggcgtcagcccgtcactgaaaagcgtcgataacaccttattgttgattcagatggttgccgcacggatgggtattgccgcactaccgcattgggtggtggagagttttgaacgccagggtctggtggtcaccaaaaccctgggcgaaggcttgtggagccgactgtacgccgccgtgcgcgatggcgagcagcgtcagccgattacggaagcgtttattcgttcagcgcgcaatcacgcctgcgatcatctgccgtttgtgaagagcgcggagcgacccacttacgatgcacccacagtgaggccaggatcaccagcgcgcctgtaa

SEQ ID NO: 8826 - protein, 317 aa, Escherichia coli
MIEVKHLKTLQALRNCGSLAAAAATLHQTQSALSHQFSDLEQRLGFRLFVRKSQPLRFTPQGEILLQLANQVLPQISQALQACNEPQQTRLRIAIECHSCIQWLTPALENFHKNWPQVEMDFKSGVTFDPQPALQQGELDLVMTSDILPRSGLHYSPMFDYEVRLVLAPDHPLAAKTRITPEDLASETLLIYPVQRSRLDVWRHFLQPAGVSPSLKSVDNTLLLIQMVAARMGIAALPHWVVESFERQGLVVTKTLGEGLWSRLYAAVRDGEQRQPITEAFIRSARNHACDHLPFVKSAERPTYDAPTVRPGSPARL

SEQ ID NO: 8827 - DNA, 900 bp, Escherichia coli
gtggcgctacttatcatcaccacgattctgtgggccttctcctttagcttttatggcgagtaccttgcggggcacgtcgatagctattttgcggtgctggtgcgcgttggcctggcggcactcgtttttctgccgtttctgcgtacccgtggcaatagcctgaaaacggtcggcctgtatatgctggtgggcgcgatgcagctcggtgtgatgtatatgctgagtttccgcgcctatctctacctgacggtctccgaactgttgctgttcaccgtactgacgccgctctacatcacgctgatttatgacatcatgagtaagcgccgtctgcgctggggctatgcctttagcgccttgctggcggtgattggtgccgggattattcgctatgatcaggtcaccgaccatttctggactggcttattgctggtgcaactctccaatatcacttttgccatcggcatggtgggttacaaacgtctgatggaaactcgcccgatgccgcagcataacgcctttgcgtggttctatcttggcgcgttcctggtggcagtgattgcatggttcttgctgggaaatgcgcagaaaatgccgcaaaccacgttgcaatggggcattctggtgtttcttggtgtggtggcttccgggattggctactttatgtggaactacggcgcgacgcaggtggacgccggaacgctgggcattatgaataatatgcacgttccggcagggctgctggtaaacctggctatctggcaccaacagccgcactggccaacgtttattacaggcgcgctggtgatcctggcctcactgtgggtgcatcgtaagtgggtcgctccgcgctcttcacaaacggcagatgatcgcaggcgtgattgcgcgctgaacgaataa

SEQ ID NO: 8828 - protein, 299 aa, Escherichia coli
MALLIITTILWAFSFSFYGEYLAGHVDSYFAVLVRVGLAALVFLPFLRTRGNSLKTVGLYMLVGAMQLGVMYMLSFRAYLYLTVSELLLFTVLTPLYITLIYDIMSKRRLRWGYAFSALLAVIGAGIIRYDQVTDHFWTGLLLVQLSNITFAIGMVGYKRLMETRPMPQHNAFAWFYLGAFLVAVIAWFLLGNAQKMPQTTLQWGILVFLGVVASGIGYFMWNYGATQVDAGTLGIMNNMHVPAGLLVNLAIWHQQPHWPTFITGALVILASLWVHRKWVAPRSSQTADDRRRDCALNE

SEQ ID NO: 8829 - DNA, 2262 bp, Escherichia coli
atgacaattcttaatcacaccctcggtttccctcgcgttggcctgcgtcgcgagctgaaaaaagcgcaagagagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaatgttccgcaacgtcatcagaacaacgatggttcggtagatatcgacaccctgttccgtattggtcgtggacgtgcaccgactggcgaacctgcggcggcagcggaaatgaccaaatggtttaacaccaactatcactacatggtgccggagttcgttaaaggccaacagttcaaactgacctggacgcagctgctggaggaagtggacgaggcgctggcgctgggccacaaggtgaaacctgtgctgctggggccgattacctacctgtggctgggtaaagtgaaaggtgaacagtttgatcgcctgagcctgctgaacgacattctgccggtttatcagcaagtgctggcagaactggcgaaacgcggcatcgagtgggtacagattgatgaacccgcgttggtactggaactgccgcaggcgtggctgaacgcatacaaacccgcttacgacgcgctccagggacaggtgaaactgctgctgaccacctattttgaaggcgtaacgccaaatctcgacacgattactgcgctgcctgttcagggtctgcatgtcgatcttgtacatggtaaagatgacgttgctgaactgcacaagcgtctgccttctgactggctgctgtctgcgggtcttatcaatggtcgtaacgtctggcgcgccgatcttaccgagaaatatgcgcaaattaaggacattgtcggcaaacgcgatttgtgggtggcatcttcctgctcgttgctgcacagccccatcgacctgagcgtggaaacgcgtcttgatgcagaagtgaaaagctggtttgccttcgccctgcaaaaatgtcatgaactggcattgctgcgcgatgcgctaaacagtggtgatacggcagctctggcagagtggagcgctccgattcaggcgcgtcgtcactctactcgtgtacataatccggcagtagaaaagcgtctggcggcgatcaccgcccaggacagtcagcgtgcgaatgtctatgaagtgcgtgctgaagcccagcgtgcgcgttttaaactgcccgcatggccgaccaccacgattggttccttcccgcaaaccacggagattcgtaccctgcgtctggattttaaaaagggtaatctcgacgccaataactaccgcacgggcattgcggaacatatcaagcaggccattgttgagcaggaacgtttgggactggatgtgctggtacatggcgaggccgagcgtaatgacatggtggaatactttggcgagcacctcgacgggtttgtctttacgcaaaacggttgggtacagagctacggttcccgctgcgtgaagccaccgattgttattggtgacgttagtcgtccggcgccgattaccgtggagtgggcaaaatatgcgcaatccctgactgataaaccggtgaaagggatgttgaccggcccggtgactattctctgctggtcgttcccgcgtgaagatgtcagccgtgaaaccatcgccaaacaaattgcgctggcgctgcgtgatgaagtcgcggacctggaagccgctggaattggcatcattcagattgacgaaccggcattgcgcgaaggtttaccactgcgtcgcagcgactgggatgcctatctccagtggggcgtggaggctttccgtatcaacgccgccgtggcgaaagatgacacacaaatccacactcacatgtgttactgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgtctgtgggtcaacccggactgtggcctgaaaacgcgcggctggccagaaacccgcgcggcactggcgaacatggtgcaggcggcgcagaatttgcgtcggggatga

SEQ ID NO: 8830 - protein, 753 aa, Escherichia coli
MTILNHTLGFPRVGLRRELKKAQESYWAGNSTREELLAVGRELRARHWDQQKQAGIDLLPVGDFAWYDHVLTTSLLLGNVPQRHQNNDGSVDIDTLFRIGRGRAPTGEPAAAAEMTKWFNTNYHYMVPEFVKGQQFKLTWTQLLEEVDEALALGHKVKPVLLGPITYLWLGKVKGEQFDRLSLLNDILPVYQQVLAELAKRGIEWVQIDEPALVLELPQAWLNAYKPAYDALQGQVKLLLTTYFEGVTPNLDTITALPVQGLHVDLVHGKDDVAELHKRLPSDWLLSAGLINGRNVWRADLTEKYAQIKDIVGKRDLWVASSCSLLHSPIDLSVETRLDAEVKSWFAFALQKCHELALLRDALNSGDTAALAEWSAPIQARRHSTRVHNPAVEKRLAAITAQDSQRANVYEVRAEAQRARFKLPAWPTTTIGSFPQTTEIRTLRLDFKKGNLDANNYRTGIAEHIKQAIVEQERLGLDVLVHGEAERNDMVEYFGEHLDGFVFTQNGWVQSYGSRCVKPPIVIGDVSRPAPITVEWAKYAQSLTDKPVKGMLTGPVTILCWSFPREDVSRETIAKQIALALRDEVADLEAAGIGIIQIDEPALREGLPLRRSDWDAYLQWGVEAFRINAAVAKDDTQIHTHMCYCEFNDIMDSIAALDADVITIETSRSDMELLESFEEFDYPNEIGPGVYDIHSPNVPSVEWIEALLKKAAKRIPAERLWVNPDCGLKTRGWPETRAALANMVQAAQNLRRG

SEQ ID NO: 8831 - DNA, 258 bp, Escherichia coli
atgacgattacgatagttgaatttaacgtgctgaaagttatggctgagaaagatattgactggagctggatggtgctggatcgtactttagctatacgaaatattccaggatttggcaacgtagcgaatatcgtaacaaagctggttaatcatgggttggttgatatcgtaaatggtgagggcaactctaaaccacgctacagagtttctcaatatggattgaatcttatcaaagaacaacaagacaacctcttctga

SEQ ID NO: 8832 - protein, 85 aa, Escherichia coli
MTITIVEFNVLKVMAEKDIDWSWMVLDRTLAIRNIPGFGNVANIVTKLVNHGLVDIVNGEGNSKPRYRVSQYGLNLIKEQQDNLF

SEQ ID NO: 8833 - DNA, 690 bp, Escherichia coli
ttggcatttcccgataactacaaccgtctgtttataccacggcaaaaaactaaagataataatggcctcaaaacactcaatagtaaagcggttggcagactgcttgctgctggcggcatatacaatgggaatatcgaaggattcagggaaacagcaaacaagttgggaggagatgcacctgctggttacgatcaagttatggataacaaagggttactcatcgctggtgcttcaatagttgctggagttgttctgggaagaatgagattccctgatttggaatcatttgagcatttcggagccagaggagcagtatcaggaagaccatttaatcccgaccttgccggtggtccaatagaaaacctgacgatagatggcgtaacaatcaatagggaaggtatcgctattgttgaaaagcatatctccagatttgatcatgatccagctaatgatgtaatgatttcaaggctaaaaaaaatagcaaataaagaattgcttcctgaaaaatacgatctgaactactatactcatgaatgccgcgagtatcagcgttattgtaatttaggatgggaaacaggtgaaccgaatggtttagatggatatgaattatggaataatgcacatactgcaactctagaagactttaaaattaaagatactgacttatttcatccggatgcaaaaaaatga

SEQ ID NO: 8834 - protein, 229 aa, Escherichia coli
MAFPDNYNRLFIPRQKTKDNNGLKTLNSKAVGRLLAAGGIYNGNIEGFRETANKLGGDAPAGYDQVMDNKGLLIAGASIVAGVVLGRMRFPDLESFEHFGARGAVSGRPFNPDLAGGPIENLTIDGVTINREGIAIVEKHISRFDHDPANDVMISRLKKIANKELLPEKYDLNYYTHECREYQRYCNLGWETGEPNGLDGYELWNNAHTATLEDFKIKDTDLFHPDAKK

SEQ ID NO: 8835 - DNA, 558 bp, Escherichia coli
atggacgcaaagctgtacatcactgagatcatcaatgaattaaccttcgttaaggactctatccgtgaggatgactgcaccaaattgatcgacgctattcagcaaagccagcgcgttttctgctatggcctggggcgtgccggcttttccatgaaagccttcaccatgcgcctgatgcatatgggcaaagaggtttacttcctgacggaaaccattacgccgaactttgggcctggcgatctgtttatcgtttcttccgcttccggtgagacagcacaactggtggcactggcgaaaaaagcacgtcagtttggcggcgctgtggcggtgttaaccacgaatcgacacgccactatcaccgagtttgtcgacgtcatcgtgcaaatcaatgccccttccaaaaatcaaaaagattctgttttccgctcggcacagccgatggcgtcgttgtatgagcaagctttgctggtgattgccgatgcattagtgatgaagatggctgctgaaagcggtgcgccggaaagtgaactgtttaagcgccacgccaatctggaatag

SEQ ID NO: 8836 - protein, 185 aa, Escherichia coli
MDAKLYITEIINELTFVKDSIREDDCTKLIDAIQQSQRVFCYGLGRAGFSMKAFTMRLMHMGKEVYFLTETITPNFGPGDLFIVSSASGETAQLVALAKKARQFGGAVAVLTTNRHATITEFVDVIVQINAPSKNQKDSVFRSAQPMASLYEQALLVIADALVMKMAAESGAPESELFKRHANLE

SEQ ID NO: 8837 - DNA, 1509 bp, Escherichia coli
atgagcaaaaaaataacatccttgtttaacttcaagaagttgcagaaattttcttctgctctgatgttaccaatcgccattcttccggcggcgggtttgattttagccatcgggatttcatttaacattgagctgctggcgaattgcggcggcctgattttcgccaaccttcctttgctgttttgtgtcggtattgtgattggcctgacaggtgatggttcttcatcactttcagcgattatcagctacatgatcatgaatgccacgatgggaacgcaacttggcattaccgcggagtccgttgcagccagtaacggtgactatgcgatgatcctcggggtaccgacgttacaaacgggagtgtttggcggtttgattgtcgccatctttgtttatctgctctatacccgcttccacaatattgaattgcctcagtttcttggtttcttcggtggaaaacgctttgtaccgattattacggcggtggcggcaattattgtcggctatttattgccgtggctgtggataccggtacaaaaaggtctggcgtcgctttcaacgctggtgaccagtgggcataacgcgaacttcgcggcctttatttacgccgttggcgaacgttcgctgattccttttggcctgcatcatatctggaacgtgccgttttattacaactttggcgactacatgaccaaatccgggcaactggtgacgggcgatattccggtgttctttgcccaattgcgcgacggtgttccgttgacggcggggttgtttatgacaggtcgtttcccaatcatgatgtttgcgttacctgccgccgcgttggcgatgtatcaggaagcaaaaccggaacgtaaggcgctgattaaaggccttttactctccggtgcgctgaccacatttgttaccgggattacggagccgctggaatatgcatttttgtttgcagctccggttctctacatcattcacatcttcttatatgccacttcatttgtgctgatgaacatcctgaatgtgcacattggtcatccttttgctggcggtcttattgatttcgtactgaatggcgttatgccaaaccgcacgccgtggtatctggtgttcctggcaggcgcgggctatgcagcgatttactacaccgtatttcgggtactgatccgcaagttgaatctgaaaacaccgggacgtgaggatgaagagattgccgttgcaaccacattaacgcgcgaagaacgtccataccaaatcatcgaggcagtaggtggtttcgacaatatcgaagatgtggatgcctgcgcaacacgcctgaggctggcgctggtagacgataagaaagtgaatgaaaaacggctgaaggagttgggggctgcgggtttagtgaaactgggtgatggcggtgtacaggtgatatttggcggcaaatcgcaaatcctgcgcgacgaaatcaaaaccgtaatgagcagaccgcgcccgacagaaatgacagtggcctgtgctaactaa

SEQ ID NO: 8838 - protein, 502 aa, Escherichia coli
MSKKITSLFNFKKLQKFSSALMLPIAILPAAGLILAIGISFNIELLANCGGLIFANLPLLFCVGIVIGLTGDGSSSLSAIISYMIMNATMGTQLGITAESVAASNGDYAMILGVPTLQTGVFGGLIVAIFVYLLYTRFHNIELPQFLGFFGGKRFVPIITAVAAIIVGYLLPWLWIPVQKGLASLSTLVTSGHNANFAAFIYAVGERSLIPFGLHHIWNVPFYYNFGDYMTKSGQLVTGDIPVFFAQLRDGVPLTAGLFMTGRFPIMMFALPAAALAMYQEAKPERKALIKGLLLSGALTTFVTGITEPLEYAFLFAAPVLYIIHIFLYATSFVLMNILNVHIGHPFAGGLIDFVLNGVMPNRTPWYLVFLAGAGYAAIYYTVFRVLIRKLNLKTPGREDEEIAVATTLTREERPYQIIEAVGGFDNIEDVDACATRLRLALVDDKKVNEKRLKELGAAGLVKLGDGGVQVIFGGKSQILRDEIKTVMSRPRPTEMTVACAN

SEQ ID NO: 8839 - DNA, 1998 bp, Escherichia coli
atgaattcacaattactggctaacgccatccgaatgttaagtgttgatgcgatccagaaagcgaactccggtcatccgggcgcgccgatggggatggcggatattgccgaagtggtctggcgtcgtcacctgcgtcataacccaaaaaatccgcagtggtttaaccgcgaccgctatattcagtcgaacgggcacggttccatgttgatttacgctttgctgcatcttacaggctacgacctgtcgatggatgatattcgcgactttcgtcagctccactcccgcacgccaggtcatccagaatatggttatacgccgggtgttgaaaccaccaccggcccgttggggcagggcgtagctaatgcggtggggatggcgattgcggagaaggcgctggcggcagaatttaacaaaccgggctttaatattgttgatcatcacacatggctatttttgggtgatggctgcctgatggaagggatctcccacgaggcctgtggtcttgcaggaacgctgaagctcggcaatctgattgctatctgggacgataacggtatttcgatcgatggtcacgtagaaggctggtttgctgaagatacggctgcccgttttcgtgcctacggctggcatgtcattgaaggcgttgatggtcacgatccagaagaggtagatgctgcggtgcgtgaagcgaaaagcgtcacggataagcccagtctgctgtgctgcaaaacgattatcggttttggttcgccaaataaagccaacagccacgattgccacggctcggcgctgggtgcagatgaagtggcgctggtgcgtgaacgtctgcaatggccgtatgcccctttcgaaattcctggtgaaatttatgccgcatgggatgcgaccgagaaaggcgcgcaggttcaacaggaatgggatgcactgtttgctgactacgcgaagcagtggccggaactggcggcggagtttactcgtcgcatgaagggtgatttgcctgctggctgggccgagaatatgcagaaatatgtgcacgatctgcaatcccatccggcggcgctggcaacccgtcaggtcagccagaaatgcctcaatcacttcgcggatatgctgccggaactgatgggcggctcggcggacttgtcgccctctaacctgactcgccatcagaaatcggttgatttcaccggggaaaatccggcggggaattacatctcctatggcgtgcgtgaatttggtatgtcggccatcatgaacggtcttgcgctgcatggtgggtttatcccttacggcggtactttcctgatgtttatggaatatgcgcgtaatgcactgcgcatggcggcgctgatgaagatccgctcggtgtttgtttatacccacgataccatcggcctgggcgaagacggcccgacacatcagcccgttgagcaactggcgtcgctgcgtctgacgccgaatatggaaacctggcgcggttgcgatcaggtggaagtggcggtagcctggcaacaggcgattgagcgcaaagatggcccaacgtcgttggtattaacgcgccaacctctggcgcaacagccgcgcaccgctgcacagttggcagagattgcgcgtggtggttatgtactgagtgattgtgacggtcagcctgagatgatcctcatttctgcgggttcagagattgagttagtggtcagcgccgcaaaagcgttaacggaagaagggcgtaaagttcgcgtggtttccatgccgtgtaccgagcgtttcgataatcaggatgcggcgtacaaagagtcggtattgccaaaagctgtacgcaaacgtctggcggtagaagccagcatcgccggattctgggaacgctacgtcggcctggacggtaaagtgatcggcatgacgagctttggtgagtctgctccggcgaatgtgttgttcaaacactttggttttacgccggaaaatgtcctggcgcaggcgcgtgagctactgaacagctaa

SEQ ID NO: 8840 - protein, 665 aa, Escherichia coli
MNSQLLANAIRMLSVDAIQKANSGHPGAPMGMADIAEVVWRRHLRHNPKNPQWFNRDRYIQSNGHGSMLIYALLHLTGYDLSMDDIRDFRQLHSRTPGHPEYGYTPGVETTTGPLGQGVANAVGMAIAEKALAAEFNKPGFNIVDHHTWLFLGDGCLMEGISHEACGLAGTLKLGNLIAIWDDNGISIDGHVEGWFAEDTAARFRAYGWHVIEGVDGHDPEEVDAAVREAKSVTDKPSLLCCKTIIGFGSPNKANSHDCHGSALGADEVALVRERLQWPYAPFEIPGEIYAAWDATEKGAQVQQEWDALFADYAKQWPELAAEFTRRMKGDLPAGWAENMQKYVHDLQSHPAALATRQVSQKCLNHFADMLPELMGGSADLSPSNLTRHQKSVDFTGENPAGNYISYGVREFGMSAIMNGLALHGGFIPYGGTFLMFMEYARNALRMAALMKIRSVFVYTHDTIGLGEDGPTHQPVEQLASLRLTPNMETWRGCDQVEVAVAWQQAIERKDGPTSLVLTRQPLAQQPRTAAQLAEIARGGYVLSDCDGQPEMILISAGSEIELVVSAAKALTEEGRKVRVVSMPCTERFDNQDAAYKESVLPKAVRKRLAVEASIAGFWERYVGLDGKVIGMTSFGESAPANVLFKHFGFTPENVLAQARELLNS

SEQ ID NO: 8841 - DNA, 846 bp, Escherichia coli
atgaataacataaccgtaaaaagtctgattcaaagcaattaccctacactgcatcaggcggaaaaaaaggtcgctgactatattcttagccacgcacatgaagtcgtgaactatagtgtcactgaactatcagaaaaaagccatgccagtgaagcgactatcgtacgcacctgtaagaaattaggttatcagggttattaccatttaaaaattgcattagcaaaagaagtcattaatcctgacaatagctatcctgataataccgattttaccgatataacgtcgctggccacatttttattaaaaaaacaggccgaagatttaatacaatcaacgcaattttttaatgccgaagtgcttgagtccattctcaaactacttgctaattgcgacactattttcttttttgctgccggaaattcaaaccctctggccgtttatggtgcttataaattcagccaactcggattaaaaaccgttgttcacgtcagcccggaaatgcaaattaatgcggcatattctatggggaaacgtgacctggcgattggtatttctaactctggcagcaccaacttaatggtcgatatctttaaagtggtgaaagagcgcggtgccaaatccgtttgtatcactaactatattaaatctccgttatcaaaactctccacccatcaactcaataccgcggtcagcgataaaatcttctttgaagccttcgactccactcgcgttccggcaatgggcgttattgatatgctggtgctgttgtttatgtataaaaacaaggcgcattacgagaaataccgcacccgtgaagagtttcttggctcccgtttcaaggggtaa

SEQ ID NO: 8842 - protein, 281 aa, Escherichia coli
MNNITVKSLIQSNYPTLHQAEKKVADYILSHAHEVVNYSVTELSEKSHASEATIVRTCKKLGYQGYYHLKIALAKEVINPDNSYPDNTDFTDITSLATFLLKKQAEDLIQSTQFFNAEVLESILKLLANCDTIFFFAAGNSNPLAVYGAYKFSQLGLKTVVHVSPEMQINAAYSMGKRDLAIGISNSGSTNLMVDIFKVVKERGAKSVCITNYIKSPLSKLSTHQLNTAVSDKIFFEAFDSTRVPAMGVIDMLVLLFMYKNKAHYEKYRTREEFLGSRFKG

SEQ ID NO: 8843 - DNA, 906 bp, Escherichia coli
atgttcatctcagacgaaacgcttcgtgttattcatctggtcgccagacaccagagcattaccaccgcagccgagcagttaaataaagtcccttccgccatcagttacaccatcaagaaagcggaagagagcctgggcgttgaactgttcattcgtaagggacgctatattgaattatcgccagcgggaagttacttcatcgaacatagcaaaactattcttggcgacctggaagcattaaagcgcaacacagtgctgattcacgatggtattgagcgtgaactgacaattgcggtgaacaatattattcctggtgatttgctggtggcatttattcgagattttgaacggcaattcacatcaacaacactgacggtagatcttgaggtatacaacggctgctgggatgcgctgtacagtaagcgtgctgatctggtctacggtgctcctcatgcagtaccaagcagtgaaggcatcattagcgaaccggtcggacaaatggaatgggattttgtcgtcagcccactccacccactggcagcgaagcggcatccattagaaaacagtgaattgcgtcactatccagcggtttgtatccgcgatacctccgttaacttccccccgatgcaagcctggttgttggaaggacaaaaacccatttttgttcctgacttcgctacggcaatcgccttaatagaacaaaacgtcggtattggttatattccacatcatctggcattgccgttattgaacagcggtaaattgcttaaaaagccaatgcgcgaacataaacacgccaccaagttatttcttgccgctcgttccgatggtatgggcaaagcctgtcagtggtgcatagaatatttaagaaacccacaattaatgacacaatttgtatttaattga

SEQ ID NO: 8844 - protein, 301 aa, Escherichia coli
MFISDETLRVIHLVARHQSITTAAEQLNKVPSAISYTIKKAEESLGVELFIRKGRYIELSPAGSYFIEHSKTILGDLEALKRNTVLIHDGIERELTIAVNNIIPGDLLVAFIRDFERQFTSTTLTVDLEVYNGCWDALYSKRADLVYGAPHAVPSSEGIISEPVGQMEWDFVVSPLHPLAAKRHPLENSELRHYPAVCIRDTSVNFPPMQAWLLEGQKPIFVPDFATAIALIEQNVGIGYIPHHLALPLLNSGKLLKKPMREHKHATKLFLAARSDGMGKACQWCIEYLRNPQLMTQFVFN

SEQ ID NO: 8845 - DNA, 1224 bp, Escherichia coli
atgcgtaaaaaagaagagaatctgaatacggcatcaggattgcgtattgccatgattttgctgggtattgccgtcacacctgtgctgttgtcatcctcaagcctcggcaatcaactttccagcggcagtttaattagcgtcgtattgttaggcggcgtcattctgaccttactttcagccatcaccattagcgtgggagaaaaagcccgcctgccaacgtatggcattgtgaaatattcgtttggcgaaaaaggggccatcgccattaacattttgatggcgataagtctgttcggctggattgccgttaccgccaatatgtttggtcattcggtacatgacttactggctcaacatggactggaagttccactggcactgttagtggcggctggctgtgtcatttttgtcgcctctacggcatttggctttgccgttctgggaaaaattgcccaggttgccgtgccggttatcgcgctggtgctgtgttacatcctctatgtggcaacccataccgaagtggcagtaccagcggcgattgtggagatgaatacaggtgtcgccgtttccaccgttgttggcaccattattgtgctggttgccacactgcctgatttcggtagttttgtgcataaccgcaaacatgcgctgattgccgcaggcgtgacgtttctggttgcctaccctctgctctactgggcgggtgcaacgccgagcgccattagtggtcagggatctttactgggtgcgatggcggtattcggtgcggttctgcctgcggcgctgttgttgattttcgcctgcgtcaccggtaacgcgggcaatatgttccagggcacgctggtggtttccacactgcttacccgctttcccaaatggcagattaccgtggcgctgggtatcctttccgccatcgtaggcagtatggatattatggcgtggtttattccgtttctgctgttcctgggtatcgccacgccacccgttgccggaatttatatcgctgactttttcctttatcgccgtaatggctatcaagagtcagtgttagcccaggagtcacagattaaagtgctgacattcgcagcatggatcataggcgcagcggttggctttatgaccgtaaaaggcttattcaccctgacgacgatcccttcggtagactcgattctggtggcatgtatcgcgtatgcgattctcagtcgggcaagtcaacaccgctaa

SEQ ID NO: 8846 - protein, 407 aa, Escherichia coli
MRKKEENLNTASGLRIAMILLGIAVTPVLLSSSSLGNQLSSGSLISVVLLGGVILTLLSAITISVGEKARLPTYGIVKYSFGEKGAIAINILMAISLFGWIAVTANMFGHSVHDLLAQHGLEVPLALLVAAGCVIFVASTAFGFAVLGKIAQVAVPVIALVLCYILYVATHTEVAVPAAIVEMNTGVAVSTVVGTIIVLVATLPDFGSFVHNRKHALIAAGVTFLVAYPLLYWAGATPSAISGQGSLLGAMAVFGAVLPAALLLIFACVTGNAGNMFQGTLVVSTLLTRFPKWQITVALGILSAIVGSMDIMAWFIPFLLFLGIATPPVAGIYIADFFLYRRNGYQESVLAQESQIKVLTFAAWIIGAAVGFMTVKGLFTLTTIPSVDSILVACIAYAILSRASQHR

SEQ ID NO: 8847 - DNA, 390 bp, Escherichia coli
atgactacaacgcttttagccgttaacggaacgctgatgcgcggcctggaactcaacccaaatatgcaaaaagcgggcggtatttttgtccgtgaagaccgaactgacgcccattaccggttgtggagtattaatgatcgccatccgggaatgattcgcgtgaatgaaggaggaacacacgtcgacgtagaaatttggcaattaccgctggccagttttgccgctctgttaatgagcgaacccgctgggctggcaattggcaaaatcaaacttgccgatggtagcgaagtgctgggcgtactggcagaaaactggctgaccgaaggccaacgggaaattacagaactgggtagctggcgcaaatacaccgggcattttcatactgtgtaa

SEQ ID NO: 8848 - protein, 129 aa, Escherichia coli
MTTTLLAVNGTLMRGLELNPNMQKAGGIFVREDRTDAHYRLWSINDRHPGMIRVNEGGTHVDVEIWQLPLASFAALLMSEPAGLAIGKIKLADGSEVLGVLAENWLTEGQREITELGSWRKYTGHFHTV

SEQ ID NO: 8849 - DNA, 957 bp, Escherichia coli
atggttaagccactggctgtcgtcgcggttggcggcaatgcgctcattcaggacgagcaacgcaatagtattcccgatcaatatgttgcagtgatggaaagcgtgcaacatatcgttgatatggttgaagccggatgggacctggtactaacccacggtaatggcccgcaggtgggctttattctgcgccgctctgaactcgccagtaacgaagtttctccggttccacttgattacgccgtgggtgatacacaaggtgcaattggctacatgttccagaaagcgctgcataacgaattggctcgccgtggcataaacaaaccggtaattgccctggtgacacaaacgcgagtcagcccacatgacgatgctttcgccagccccagtaaaccaattggcgcgtttctcgatgaagcaacggcccaacaacgccaacaacaactcggctggacgctgatggaggacgccgggcgtggttggcggcgtacagttccctctcctgcaccactggaaattattgagcacgacaccatcgctcacctggtgcgccagggatatctggttattgcctgcggcggcggcggtattccggtggtgcgagacgggcaacaactgaaaggtgtagaagccgtgatcgataaagatctggcctccgcgctgctcgccagtcagttaggcgcagatctgctggtgatccccaccggtgtagaaaaagtagcgattaactttggtacaccacaacaacagtggctcgacgctatcagcgttgccgaagcgcaaacgctgttgcgggaaggtcagtttggtgtcggcagtatgcaacccaaagtggaagccattgttgatttcatcaatgccagccagcaacaaggcaaacaggccagcggcctgattacttcaccgcaaaccataaaagcagccctggcgcatcagagcggtacatggataaccctttaa

SEQ ID NO: 8850 - protein, 318 aa, Escherichia coli
MVKPLAVVAVGGNALIQDEQRNSIPDQYVAVMESVQHIVDMVEAGWDLVLTHGNGPQVGFILRRSELASNEVSPVPLDYAVGDTQGAIGYMFQKALHNELARRGINKPVIALVTQTRVSPHDDAFASPSKPIGAFLDEATAQQRQQQLGWTLMEDAGRGWRRTVPSPAPLEIIEHDTIAHLVRQGYLVIACGGGGIPVVRDGQQLKGVEAVIDKDLASALLASQLGADLLVIPTGVEKVAINFGTPQQQWLDAISVAEAQTLLREGQFGVGSMQPKVEAIVDFINASQQQGKQASGLITSPQTIKAALAHQSGTWITL

SEQ ID NO: 8851 - DNA, 1425 bp, Escherichia coli
atgaataccttatttaatcagcctttgaaggttgtgaacgcgggactacacagttttgctgacaatattcaacatgccgggggaagcgcaattgcactcaactggcagccaccagcacaaggcgatattgacgctggattggatctggcatcgttgctacgtcatcccctggtagaaaatgccaaccaaatcgccatgacacgttatctcgaagcacagcccatgctggtggatgtcatgctcgctaaagaggccattccagcaatggctgaacaaaaacgtattttgcactctggcccgccgattgcctgggaagagatgtgtggtccggtaaaaggggcgattattggtgccatgctgtacgaaggttgggccaccagccagcaagacgctgaaaaccaaataaacgcaggcgaaatcgaccttgccccttgtcatcattatcacgcggttggcccaatggcaggcatcatcagcccgtcgatgccgttatgggtggtagaaaacaaaaccaacggccatcgtacttttagcaatttcaatgaaggtctgggtaaggttctccgttttggcgccaataacgatgaagttctcaatcgtctggcctggatgcgcgatgaactggcgccggcaatgaaagcagcaatcgcacaacacggcgagctggaactcaagccattaatggcgcaggcgctgcatatgggggatgaagttcataaccgcaatgctgccgctaccggtttgctgattaagcgcctgctcccggcattgctggcctgctctcttccacaggaacatatccagcgcgtcgtggcatttatcaccggtaacgatcacttcttcctcaatctgtcgatggccgcctgtaaagcaatgatggatgccgccgccaatgtaccgttcagttcaatggttacggtgatggcgcgtaacggggtgagttttggtattcggctttccggtactagcgatcgctggttccaggctcctgccaatgccgttgaaggtctgttcttccccggatttggcgttgacgacgctgctgctgacctgggtgatagcgcaattactgaaaccgcaggtatgggtggcttcgcgatggcgtcgtctccggcgatcgtcaaatttgtgggaggcacccctgccgatgccaccaataacagccgtcggatgcaagccatcaccctcggcggtaaccccgcatttacacttccagccctcaattttgcccccaccgcagcaggaattgatgcgcgtaaagtgaccgatcgcggcattttaccggtcatcaatacgggtatcgcccacaaacaagcgggggtcgggcaaattggtgccgggatcaccactgcgccgatggcctgttttgtcgccgctgtacgtgcactggcggagatcgtcgcaaaggagaaccatcatggttaa

SEQ ID NO: 8852 - protein, 474 aa, Escherichia coli
MNTLFNQPLKVVNAGLHSFADNIQHAGGSAIALNWQPPAQGDIDAGLDLASLLRHPLVENANQIAMTRYLEAQPMLVDVMLAKEAIPAMAEQKRILHSGPPIAWEEMCGPVKGAIIGAMLYEGWATSQQDAENQINAGEIDLAPCHHYHAVGPMAGIISPSMPLWVVENKTNGHRTFSNFNEGLGKVLRFGANNDEVLNRLAWMRDELAPAMKAAIAQHGELELKPLMAQALHMGDEVHNRNAAATGLLIKRLLPALLACSLPQEHIQRVVAFITGNDHFFLNLSMAACKAMMDAAANVPFSSMVTVMARNGVSFGIRLSGTSDRWFQAPANAVEGLFFPGFGVDDAAADLGDSAITETAGMGGFAMASSPAIVKFVGGTPADATNNSRRMQAITLGGNPAFTLPALNFAPTAAGIDARKVTDRGILPVINTGIAHKQAGVGQIGAGITTAPMACFVAAVRALAEIVAKENHHG

SEQ ID NO: 8853 - DNA, 1560 bp, Escherichia coli
atgaaagttaaatataaagttttcagtaatctttatcaggactcagtttctctgatgcagatttccgcgcaaatcagcaagttgcccggtattcaacaggcctcggtcgtcatgggaacgcccaataatctcgaacaattgcgcgatgcgggtctgggtaacgaaatcaacgccagtcccaatgatttagtgattgcagtcatgggtgaagaagatatttgcaatgaagcactggtactggcccagcaacgtctgaccagcaaacccgatgatgaaacggatagtggcattaaaacaccggaaaaggtcagcctggaaatggcactggaagccgaacccgaagccaacctggcactcatttctgtaccgggagactacgccgccgccgaagcaattaaagcgttaaacctcggaatgaacgtgatgatgttcagcgataacgtcagtatcgggcaggaaaaatctatcaaaacgcttgcccgagaacgtcagcgcatcgtaatgggacctgactgtggaaccgccattgttaacggcattccgttaggcttcgctaatgtggtgaaacgcggagcaattggtgttattggcgcgtcaggcaccgggctacaggaagtgacttgccgaatcgaccagctcggagcgggtatttctcaggcgttgggaaccggtgggcatgatctcagtgaagagattggtggaatatcgatgctcttcgctttagatgcgctggcgcaagacgatgaaactcgcgtgattgtgctgatttcaaaaccgccttcaccgatcgttgcccagactattctggagcgcgccgaggcttgtggaaaacccgtggtggtgaatttcctcggtgcgaatccgcatgatctggcacgtcccaatatcaccgcggccaccacacttgccagcgccgcaaatatcgccgtagcgttactgaatgctcagccacttccggctgtcgagaccgagatttcctgcgccgatctcacaatgttacaaaacgcctgtcagcgcctgccagcccatcgccaggcgatacgcggtgttttcgccggaggaaccttctgctacgaagcgcaacttatctgccaacaaaagggattcagcgcagcttccaatacgccagttgcgggtaatcgtgctctggcaaatatctggcaaagcgaagatcacacgttgatcgatatgggcgacgatgatttcacccgtggcaaaccgcatccaatgatcgacccgactctgcgcaatcaacgtctgctcaacgaactcaacgactcacacactgccgtcgtgttattcgacctggtacttggttatggcgcttccacggcgcctgccagcgaattactggaccaactttcacacatcgacatgaataacgcaccgttgctgattgcgcacgtttgcggaacggaagctgatccgcaaatacgcagtcagcagataagagcactacaaaatgcaggggtcatcatcgccagcagcaatgcacaggcggcgctatgggccagcaccgttgcacagactcagttgcagaaaaaggggctaaacgcatga

SEQ ID NO: 8854 - protein, 519 aa, Escherichia coli
MKVKYKVFSNLYQDSVSLMQISAQISKLPGIQQASVVMGTPNNLEQLRDAGLGNEINASPNDLVIAVMGEEDICNEALVLAQQRLTSKPDDETDSGIKTPEKVSLEMALEAEPEANLALISVPGDYAAAEAIKALNLGMNVMMFSDNVSIGQEKSIKTLARERQRIVMGPDCGTAIVNGIPLGFANVVKRGAIGVIGASGTGLQEVTCRIDQLGAGISQALGTGGHDLSEEIGGISMLFALDALAQDDETRVIVLISKPPSPIVAQTILERAEACGKPVVVNFLGANPHDLARPNITAATTLASAANIAVALLNAQPLPAVETEISCADLTMLQNACQRLPAHRQAIRGVFAGGTFCYEAQLICQQKGFSAASNTPVAGNRALANIWQSEDHTLIDMGDDDFTRGKPHPMIDPTLRNQRLLNELNDSHTAVVLFDLVLGYGASTAPASELLDQLSHIDMNNAPLLIAHVCGTEADPQIRSQQIRALQNAGVIIASSNAQAALWASTVAQTQLQKKGLNA

SEQ ID NO: 8855 - DNA, 861 bp, Escherichia coli
atggtacaggttacgctttgcgcatcgtcgttgggatatcttttcccgcagaatgaaacgcaagatttacgtctacatagcgcttttaaacatgcggtaaatctgtattcagacgcgggaacattcatcactctgttgtgtgcgcaaacgtatctgaatctccctgatgctgccagagtctggctacctgaatgttgggactggcgaagagagattgcccattcagatcccattcagttaacccaaggcttactgcggacacctcgattttgtgtggcgctcgaaaacgcaacgctctggcagtcgccatttgtggggagaatgctgacacttgaggcattccctttggttttccagcactacccaacgatggcatcgcaacggcttttattttgtctggaacataacgttcaaagcacattgcacctgccggatagtctcacgcaccagggattagcaattatggagcatccagatgcgctggaacgccaggtgccacaactgatcggctttggtaaaggcttaacgcccgatggagatgactatttgttgggctatctggcagcgctctggttatggcaactccctgcaccacttgccgatcatcaataccggttgcagcaggcaattgatcaacatgcgcacaacaccacggatatcagtcgtcattatctggagcgtgcgcttcagggacatttttcagaaccgatttgccagttactcgcacaactggttgggagcgcatcggcaatgacaatcgcatcctgtgcagaacaggtcatgcaatttggcgcaacgtcaggagtagattgccttgcaggaatgctgcatggctttcgaaccctgaacaccatgaattga

SEQ ID NO: 8856 - protein, 286 aa, Escherichia coli
MVQVTLCASSLGYLFPQNETQDLRLHSAFKHAVNLYSDAGTFITLLCAQTYLNLPDAARVWLPECWDWRREIAHSDPIQLTQGLLRTPRFCVALENATLWQSPFVGRMLTLEAFPLVFQHYPTMASQRLLFCLEHNVQSTLHLPDSLTHQGLAIMEHPDALERQVPQLIGFGKGLTPDGDDYLLGYLAALWLWQLPAPLADHQYRLQQAIDQHAHNTTDISRHYLERALQGHFSEPICQLLAQLVGSASAMTIASCAEQVMQFGATSGVDCLAGMLHGFRTLNTMN

SEQ ID NO: 8857 - DNA, 669 bp, Escherichia coli
atgacgcaatccatttttcaggctcaaccctttgaattaccttttgatccgcgcacaactgcactggtcatgatcgacatgcagcgtgactttgtcgaagcagggggcttcggtgaggctctgggcaatgatgtttcactggtacgcacggctatcgcaccatgtacagaggtgctggcagccgcacgtcaaaaaggaattatggttattcatactcgtgaaggccatcgtgcagacttaagcgactgcccgccagccaaactgacgcgcggcggaaaaacctttattggtgaaccaggaccgatgggacgcattctggtcagaggtgaagcaggtcatgacatcattcctgaactgtacccggtggcaggcgaaccggtgattgataagcctggcaaaggcgcgttttatcaaaccgacttacatctgattttgcaaaaccacggtatcaagacgctgatagtttgtggtgtaacaaccgaagtttgcgtaaccaccaccgtgcgcgaagcaaatgatcgtggctatgaatgcattatcccggaagattgtgtcggctcctatttcccggaattccagaaatacgccctcgagatgatcaaagcacaaggtgccattttcggttgggttactgattccaaagccattattgcaggtctggaaggctaa

SEQ ID NO: 8858 - protein, 222 aa, Escherichia coli
MTQSIFQAQPFELPFDPRTTALVMIDMQRDFVEAGGFGEALGNDVSLVRTAIAPCTEVLAAARQKGIMVIHTREGHRADLSDCPPAKLTRGGKTFIGEPGPMGRILVRGEAGHDIIPELYPVAGEPVIDKPGKGAFYQTDLHLILQNHGIKTLIVCGVTTEVCVTTTVREANDRGYECIIPEDCVGSYFPEFQKYALEMIKAQGAIFGWVTDSKAIIAGLEG

SEQ ID NO: 8859 - DNA, 117 bp, Escherichia coli
ttgcattcagcaggtggtgtgatgacgaatgtgaagggagtcaaagagtggcatacagcaacaaattttttgatgctgtatggttttgagattaaaaaaatcgttgaaattgtgtga

SEQ ID NO: 8860 - protein, 38 aa, Escherichia coli
MHSAGGVMTNVKGVKEWHTATNFLMLYGFEIKKIVEIV

SEQ ID NO: 8861 - DNA, 810 bp, Escherichia coli
atggcaacaacacaacaatctggatttgcacctgctgcatcgcctctcgcttcgaccatcgttcagactccggacgacgcgattgtggcgggcttcacctctatcccttcacaaggggataacatgcctgcttaccatgccagaccaaagcaaagcgatggcccactgccagtggtcattgtagtgcaggaaatttttggcgtgcatgaacatatccgcgacatttgtcgccgtctggcgctggaggggtatctggctatcgcacctgaactttacttccgcgaaggcgatccgaatgattttgccgatatccccacgttgcttagcggtctggtagcaaaagtgcctgactcgcaggtgctggccgatctcgatcatgtcgccagttgggcttcccgcaacggcggcgatgttcatcgtttaatgatcaccggattctgctggggtggacgtatcacctggctgtatgccgcgcataatccacagctaaaagccgcagtggcgtggtacggcaaactgacgggcgataagtcgctgaattcaccgaaacaacctgttgatatcgcaaccgatcttaacgctccggttctcggcttatatggcggccaggataacagcattccgcaagagagcgtggaaacgatgcgccaggcgctgcgggcagcaaacgcgaaagcagagattatcgtgtacccggatgcagggcatgcgttcaacgccgattatcgtccgagctatcatgccgaatctgcgaaagacggctggcagcgaatgttggaatggtttacacagtatggtgttaaaaagtaa

SEQ ID NO: 8862 - protein, 269 aa, Escherichia coli
MATTQQSGFAPAASPLASTIVQTPDDAIVAGFTSIPSQGDNMPAYHARPKQSDGPLPVVIVVQEIFGVHEHIRDICRRLALEGYLAIAPELYFREGDPNDFADIPTLLSGLVAKVPDSQVLADLDHVASWASRNGGDVHRLMITGFCWGGRITWLYAAHNPQLKAAVAWYGKLTGDKSLNSPKQPVDIATDLNAPVLGLYGGQDNSIPQESVETMRQALRAANAKAEIIVYPDAGHAFNADYRPSYHAESAKDGWQRMLEWFTQYGVKK

SEQ ID NO: 8863 - DNA, 735 bp, Escherichia coli
ttggggagcgtttttttatttcagcagacgacgcgccgcttccaccacgattttcaccgcatggctttcggtttgtttcatcgtctcagcattcgggatctcttgctgggtgcggttaacgataacccccgctaccataccggcacgcaggccctgacttgcacacatggtcagcagggttgcagattccatttcatagttcattacgcccatcgcctgccactcttccatagaacctttaaagtgacgaactacgcgaccagagtaagtatcgtaacgttcctgacctgggtagaaggtatcagaagaagctgtcacgccaacgtgagtcgtcgcgccaatggatttcgcagcttcaaccagcgcagtcgtacattcgaaatcagcgacagccgggaattccagcggtgcgaagtgcaggctcgcgccatccagacgaacagacgccgtggtaaccaggacatcacccacattaatatgcggctgaatagcgcccgttgtaccgatacgcaggaaggtgcgaatgcccagctgtgccagctcttcaacagcaatagaggtagacgggccgccgataccggtagagcagacgataacaggtttaccatccagctctgcacgccaggtggtgaattcgcggtgagatgccagcttaaccggcttatccatcagcgcggcgatcttttccacacgatccgggtcgccagggacgatggcaagcgtagccccttgtaa

SEQ ID NO: 8864 - protein, 244 aa, Escherichia coli
MGSVFLFQQTTRRFHHDFHRMAFGLFHRLSIRDLLLGAVNDNPRYHTGTQALTCTHGQQGCRFHFIVHYAHRLPLFHRTFKVTNYATRVSIVTFLTWVEGIRRSCHANVSRRANGFRSFNQRSRTFEISDSREFQRCEVQARAIQTNRRRGNQDITHINMRLNSARCTDTQEGANAQLCQLFNSNRGRRAADTGRADDNRFTIQLCTPGGEFAVRCQLNRLIHQRGDLFHTIRVARDDGKRSPL

SEQ ID NO: 8865 - DNA, 765 bp, Escherichia coli
atgtccaagtctgatgtttttcatctcggcctcactaaaaacgatttacaaggggctacgcttgccatcgtccctggcgacccggatcgtgtggaaaagatcgccgcgctgatggataagccggttaagctggcatctcaccgcgaattcaccacctggcgtgcagagctggatggtaaacctgttatcgtctgctctaccggtatcggcggcccgtctacctctattgctgttgaagagctggcacagctgggcattcgcaccttcctgcgtatcggtacaacgggcgctattcagccgcatattaatgtgggtgatgtcctggttaccacggcgtctgttcgtctggatggcgcgagcctgcacttcgcaccgctggaattcccggctgtcgctgatttcgaatgtacgactgcgctggttgaagctgcgaaatccattggcgcgacgactcacgttggcgtgacagcttcttctgataccttctacccaggtcaggaacgttacgatacttactctggtcgcgtagttcgtcactttaaaggttctatggaagagtggcaggcgatgggcgtaatgaactatgaaatggaatctgcaaccctgctgaccatgtgtgcaagtcagggcctgcgtgccggtatggtagcgggggttatcgttaaccgcacccagcaagagatcccgaatgctgagacgatgaaacaaaccgaaagccatgcggtgaaaatcgtggtggaagcggcgcgtcgtctgctgaaataa

SEQ ID NO: 8866 - protein, 254 aa, Escherichia coli
MSKSDVFHLGLTKNDLQGATLAIVPGDPDRVEKIAALMDKPVKLASHREFTTWRAELDGKPVIVCSTGIGGPSTSIAVEELAQLGIRTFLRIGTTGAIQPHINVGDVLVTTASVRLDGASLHFAPLEFPAVADFECTTALVEAAKSIGATTHVGVTASSDTFYPGQERYDTYSGRVVRHFKGSMEEWQAMGVMNYEMESATLLTMCASQGLRAGMVAGVIVNRTQQEIPNAETMKQTESHAVKIVVEAARRLLK

SEQ ID NO: 8867 - DNA, 1491 bp, Escherichia coli
atgtttgaaagtgaacttttaactcagggtttttcgacattactcaataatcctcaggcgctgctgtttgccacttttggggtgatgctgggtattgtgattggcgctttgcctggtctgacagcgaccatgggtgtggcgattttgctgcctttcacctacggcatggagcctgtttctggattgttgatgatttgcggcgtcttttttggtggcgtctacggtggttctatcaccgcaattttgctcaaaattcccggaacacctgccgccgcagccaccgctattgatggttatgagctgacgaaacagggaaaagcagggctggcattgagtgccgccacgttctcttcctttagtggcggaacgctcagcattatcgtgctgatgtttctctctccggtacttgccagttgggcgctgaaatttagtgcctcggagtccttcgccctggcaaccttcggactgagcattattgccagtatttccggtgagtcgctgattaaggggctgattgccggggttggcggattgctgatcgcaacgataggccttgatccaatgggcggttttccacggtttacaggtggatttgtggagctgatgaatgtgccatttatcccggtgatgattggtttatttgctgcttcagaagcattccgctctatggagcaaaaccagcaaattcgtcggggcgcgaaggtggctatcggcagtctgttactgccctggcaaacactacgccgcatcgcattaaccattttgcgctcatcaggattaggggtttttatcggcatgatccccggtgcgggggcggatattgcagcttttgttgcctataacgaaactcgtcgtttcagtaagacaccagaaaactttggtaagggtgaaattaaagctgtggcctcctgtgaggcaggcgcgaatggctgcaccggtggcgcattgttacctatgctgacgctggggatccctggcgatgcggtaaccgccatcatgctgggcgcgttaacgttacagggaatgcaaccaggcccgctgatgtttaccgaccacggtgatatggtttatacgctgtttgtcggcatgatcttctgttacttcatgctactagttcttggactgctctctttgaaagtcatcggtaatgtggtgaaaattcccggcaatattctcacaccgatgatcctcgcactttgtgtggtcgggacttatgcactgaacaacagcctgtttgatgtcggcattatgttgattgcgggcgtagtgggctatttcatgcagaaagggggatatccggcgtcgccagtggtcctggcattgattatggggccaatggcggaaagtaattttcgccgtgcgctgtcgctttcagggggttcactcgactttctgtatacccgaccgatcactctggcattgctgactctggccgcctttacgctactgacgccaataatccgcaaaataatgcgtttacggcgtcaataa

SEQ ID NO: 8868 - protein, 496 aa, Escherichia coli
MFESELLTQGFSTLLNNPQALLFATFGVMLGIVIGALPGLTATMGVAILLPFTYGMEPVSGLLMICGVFFGGVYGGSITAILLKIPGTPAAAATAIDGYELTKQGKAGLALSAATFSSFSGGTLSIIVLMFLSPVLASWALKFSASESFALATFGLSIIASISGESLIKGLIAGVGGLLIATIGLDPMGGFPRFTGGFVELMNVPFIPVMIGLFAASEAFRSMEQNQQIRRGAKVAIGSLLLPWQTLRRIALTILRSSGLGVFIGMIPGAGADIAAFVAYNETRRFSKTPENFGKGEIKAVASCEAGANGCTGGALLPMLTLGIPGDAVTAIMLGALTLQGMQPGPLMFTDHGDMVYTLFVGMIFCYFMLLVLGLLSLKVIGNVVKIPGNILTPMILALCVVGTYALNNSLFDVGIMLIAGVVGYFMQKGGYPASPVVLALIMGPMAESNFRRALSLSGGSLDFLYTRPITLALLTLAAFTLLTPIIRKIMRLRRQ

SEQ ID NO: 8869 - DNA, 510 bp, Escherichia coli
ttgatgaacacaaaacagtctgttgctcaactcgccgtaccgcaccgcaagcgcctttcatcaacgatggtggtggcgctgttactttgtgtggttgctggcgcggtgatgattaatgccgctgattttccagcaactgccattgaaacggatcccggtgcaagtgccttccctaccttctatgcctgtgccctgattgtgctcgctgtcttgctggtgatacgcgatcttttgcaggcaaaaccagcctcttgcgccaacgcacaggaaaaaccggcattcaggaaaacagcaacaggaattgcggcaaccgcgttttatattgtggcgatgagctactgcggttatctcattactactcctgttttcctcatcgtcattatgacgttgatgggctacaggcgatgggtactcacaccgggtattgcgctgctgttaacggcaatcctctggttgctgtttgtcgaagcgttacaggtgccattgcctgtcggcacatttttcgaataa

SEQ ID NO: 8870 - protein, 169 aa, Escherichia coli
MMNTKQSVAQLAVPHRKRLSSTMVVALLLCVVAGAVMINAADFPATAIETDPGASAFPTFYACALIVLAVLLVIRDLLQAKPASCANAQEKPAFRKTATGIAATAFYIVAMSYCGYLITTPVFLIVIMTLMGYRRWVLTPGIALLLTAILWLLFVEALQVPLPVGTFFE

SEQ ID NO: 8871 - DNA, 975 bp, Escherichia coli
atgataaaacatcttaccttaccgaaaaaaatggctgcaatggtacttcttgcaggcgctgccctcagcattgcgcctgtacaggcagcctcctacccaaccaaacagatcgagttagtcgttccctacgctgccggaggcggtacggatctggttgcccgtgcctttgctgatgccgccaaaaaccatttacccgtcagcatcggggttatcaataaacctggcggaggcggtgctatcggcctgagtgaaatcgccgctgcccgccctaacggttacaaaattggtttaggcacggttgaactaaccacccttcccagcctcggaatggtgcgttttaaaaccagcgactttaaacccattgcccgtctgaatgcggatccggctgctatcacagtccgtgccgatgcgccgtggaatagctatgaagaatttatgacttacgccaaagcgaatcccggaaaagtacgcattggtaactcaggcaccggagctatctggcatctggcggcagctgcactggaagacaaaacgggcgcaaagttttctcatgtcccgtatgacggcgcagcccctgccattacaggcctgttaggtgggcacattgaagcggtttccgtaagcccaggagaagttatcaaccatgtgaatggcggcaagctgaagacactggtagtgatggcggatgagcgaatgaaaaccatgcctgacgtcccgacgttaaaagagaaaggcgttgatctctccatcggcacctggcgcggcctgattgtgtcgcaaaaaacgcagcaggatgtggtggatgttctggcaaaggcagcaaaagagacggctgaagagcctgcattccaggatgcactgcaaaagttgaatctcaactatgcatggcttgacgctgccagcttccagacccaaatcagcgaacaggaaaagtactttgacgagttgctgactcgcctgggcctgaaaaaataa

SEQ ID NO: 8872 - protein, 324 aa, Escherichia coli
MIKHLTLPKKMAAMVLLAGAALSIAPVQAASYPTKQIELVVPYAAGGGTDLVARAFADAAKNHLPVSIGVINKPGGGGAIGLSEIAAARPNGYKIGLGTVELTTLPSLGMVRFKTSDFKPIARLNADPAAITVRADAPWNSYEEFMTYAKANPGKVRIGNSGTGAIWHLAAAALEDKTGAKFSHVPYDGAAPAITGLLGGHIEAVSVSPGEVINHVNGGKLKTLVVMADERMKTMPDVPTLKEKGVDLSIGTWRGLIVSQKTQQDVVDVLAKAAKETAEEPAFQDALQKLNLNYAWLDAASFQTQISEQEKYFDELLTRLGLKK

SEQ ID NO: 8873 - DNA, 630 bp, Escherichia coli
atgccatttaatacgcttttgcaaaaaaccgggttagtcgccattttacgcggtgtgaaaccggatgagattgtcgccatcggtgaaaaactgtacgccgccggattccgcctgattgagattcctatgaactcgccggaggcgttgcaaagtatcagtttactgcgcgacgccctgcctaaggactgcctggtcggagccggaactgtgctttcggtagagcaggtggttgcggttaaagaggctgggggccagattatcgtgatgccgcattgcgatactgcggtgatccgtcgcgcccgtgcgctgggtatgtattgtgcgcctggcgtcgccacgcccaccgaagcctttgctgccattgaacatggtgctaatgccatcaagctgttcccggctgaacaaattacgccagaagttaccaaagcctggcgtgcggttattccacaatccgttccgatgttaccggttggcggtatcacaccggaaaccatggcgcgttatctgagccacggcgcaaacggctttggcctcggttctgcgctatatcgccccggcatgacgccagagcaagtctatgaaaatgcagtactgtttatgaacgcatggaacaatttaaatagcaactaa

SEQ ID NO: 8874 - protein, 209 aa, Escherichia coli
MPFNTLLQKTGLVAILRGVKPDEIVAIGEKLYAAGFRLIEIPMNSPEALQSISLLRDALPKDCLVGAGTVLSVEQVVAVKEAGGQIIVMPHCDTAVIRRARALGMYCAPGVATPTEAFAAIEHGANAIKLFPAEQITPEVTKAWRAVIPQSVPMLPVGGITPETMARYLSHGANGFGLGSALYRPGMTPEQVYENAVLFMNAWNNLNSN

SEQ ID NO: 8875 - DNA, 1005 bp, Escherichia coli
atgccgggagcaccctcatttattgccctggactggggaacgtcatcgcttcgggcatggcgttttggcgaatcaccaaatccacaagaaaaacgtgaattcccctgggggatcatgaaattaccctcccaggcagcaacacgtgaggacactttccacgatacgtttttacgtgtctgcagcgactggctggcacaaaccccatgcccggtactggcttgcggcatgctcggcagtgcgcaagggtggcaaccagcagcttatttaccttgcccggtcactctcgagggtctggcgaagcagttgacgcctgttatccaccagcagcagacaatgctgcacatcattcctggcgtgattaaagaaggtgaaatgcccgaagtgatgcgtggcgaagagacacaaatcttcggtgctatctcgatggaaccggccctgcaaaacgcaatccatcagggtatgccagtgctgataggcttacccggcacacatgcgaaatgggcagtagttgaaaacaacaccattaccgatttccgaacctttatgacgggcgagttatttgatgttttatcccgccattcgattctcggtgccaccatgcatcctggagatgaaccgcactgggatgccttcacccacgggctgacagcagcacaagagcatcatcagaccggattattatcgacgctgttttcgacccgttcgcgcctgctgaccagtaatcttacgtcgtcctcgcagggggattacctttccggattactgataggccatgaattatgtggtctggcatccagtttgctacgtgatttacccgccacaacaccgatcgccttaatcggtagcgcaaatctgaacagccgctattcacaagcattcagccacgtttttcccgacagacagatacacgccattcccaatgccactgaacagggattatggcgaatcgcccacgctgccgggttactgtccaccaacgccagggaatgtacccatgccatttaa

SEQ ID NO: 8876 - protein, 334 aa, Escherichia coli
MPGAPSFIALDWGTSSLRAWRFGESPNPQEKREFPWGIMKLPSQAATREDTFHDTFLRVCSDWLAQTPCPVLACGMLGSAQGWQPAAYLPCPVTLEGLAKQLTPVIHQQQTMLHIIPGVIKEGEMPEVMRGEETQIFGAISMEPALQNAIHQGMPVLIGLPGTHAKWAVVENNTITDFRTFMTGELFDVLSRHSILGATMHPGDEPHWDAFTHGLTAAQEHHQTGLLSTLFSTRSRLLTSNLTSSSQGDYLSGLLIGHELCGLASSLLRDLPATTPIALIGSANLNSRYSQAFSHVFPDRQIHAIPNATEQGLWRIAHAAGLLSTNARECTHAI

SEQ ID NO: 8877 - DNA, 768 bp, Escherichia coli
atggcagaaacctcttcaaccaccgcaggcgcacaaacgttattacgtggactggcggttcttaatgctgtttataacggctgccatgacctaaaaagtatcggcgagttcaccggcacgacccggagcacaacccatcgtttagtcaccgttctggtggaacaacgctacctgcgccatgtcccaacgcagggctaccaactgggtgccaaactgatcgaattcggtgccagagcactggaaagcacctcgctgtacgaaattgcccagcccgttttgcaacgccttgcccgttacaccctggacaccgtgcatctggggatcgttgaaggcgacgaagtgctgtatctggagaagatcaacagtcagcgcgggctggaaatgcgctcacgcccaggccatcgcatgccactggcaatcaccggcatcggcaaggcattgatcctcaaccgaacagaagaagagtggcgcacgctgtttaagacctgtggtgatgaaacaaaactgggcgcatttattcagaacatgcgtcgttatgccgccagtggttttgcttttgatctggaagagaacgagccgactatccgttgcgttgcagcgccggtttacaacgcccgggatgaaattgtggcggctatttctgtcgccagtaccaccacgtatatgtcgctggcgcgtctggaagaactggcaccttacgtcaaatcctgtgcagaagagatatccgctgaactgggctggggtaagcacgtccgcaaagataaataa

SEQ ID NO: 8878 - protein, 255 aa, Escherichia coli
MAETSSTTAGAQTLLRGLAVLNAVYNGCHDLKSIGEFTGTTRSTTHRLVTVLVEQRYLRHVPTQGYQLGAKLIEFGARALESTSLYEIAQPVLQRLARYTLDTVHLGIVEGDEVLYLEKINSQRGLEMRSRPGHRMPLAITGIGKALILNRTEEEWRTLFKTCGDETKLGAFIQNMRRYAASGFAFDLEENEPTIRCVAAPVYNARDEIVAAISVASTTTYMSLARLEELAPYVKSCAEEISAELGWGKHVRKDK

SEQ ID NO: 8879 - DNA, 1413 bp, Escherichia coli
atggtttacgcagttattgcattggtgggtgtggcaattggctggctgtttgccagttatcaacatgcgcagcaaaaagccgagcaattagctgaacgtgaagagatggtcgcggagttaagcgcggcaaaacaacaaattacccaaagcgagcactggcgcgcagagtgtgaattgctcaataacgaagtgcgcagcctgcaaagtattaacacctcgctggaggccgatctgcgtgaagtgaccacgcggatggaagccgcacagcaacacgctgacgataaaattcgccagatgatcaacagcgaacagcgcctcagtgagcaatttgaaaaccttgccaaccgtatttttgaacacagtaatcgtcgggttgatgagcaaaatcgccagagtctgaacagtcttttgtcgccgttgcgtgaacaactggatggtttccgccgtcaggtccaggacagctttggtaaagaagcccaagaacgtcataccctgactcacgaaatccgcaacctccagcaactcaacgcccagatggcccaggaagcgatcaacctgacgcgtgcgctgaaaggcgacaataaaacccagggcaactggggcgaggtagtattgacgcgggtgctggaggcttccggtctgcgtgaagggtatgaatatgaaacccaggtcagcatcgaaaatgacgcccgctcgcggatgcagccggatgtcatcgtgcggttgccgcagggaaaagatgtggtgatcgacgccaaaatgacgctggtcgcctatgaacgctatttcaacgccgaagatgactacacccgcgaaagcgcgctacaggaacatatcgcgtcggtacgtaaccatatccgtttgctgggacgcaaagattatcaacagctgccggggctgcgaactctggattacgtgctgatgtttattcccgttgaacccgcttttttactggcgcttgaccgtcagccggagctgatcaccgaagcgttgaaaaacaatatcatgctggttagcccgactacgctgctggtggcgctgcgcactatcgccaacctgtggcgttatgagcatcaaagtcgtaacgcccagaaaatcgccgatcgcgccagcaagctgtacgacaaaatgcgcttgtttgtcgatgacatgtccgcgatcggtcaaagtctcgacaaagcgcaggataactatcgccaggcaatgaaaaaactctcttcaggtcgcggaaatgtgctggcgcaggcagaagcgtttcgcggtttaggggtagaaattaaacgcgagattaatccggatttggctgaacaggcggtgagccaggatgaagagtatcgacttcggtcggttccggagcagccgaatgatgaagcttatcaacgcgatgatgaatataatcagcagtcgcgctag

SEQ ID NO: 8880 - protein, 470 aa, Escherichia coli
MVYAVIALVGVAIGWLFASYQHAQQKAEQLAEREEMVAELSAAKQQITQSEHWRAECELLNNEVRSLQSINTSLEADLREVTTRMEAAQQHADDKIRQMINSEQRLSEQFENLANRIFEHSNRRVDEQNRQSLNSLLSPLREQLDGFRRQVQDSFGKEAQERHTLTHEIRNLQQLNAQMAQEAINLTRALKGDNKTQGNWGEVVLTRVLEASGLREGYEYETQVSIENDARSRMQPDVIVRLPQGKDVVIDAKMTLVAYERYFNAEDDYTRESALQEHIASVRNHIRLLGRKDYQQLPGLRTLDYVLMFIPVEPAFLLALDRQPELITEALKNNIMLVSPTTLLVALRTIANLWRYEHQSRNAQKIADRASKLYDKMRLFVDDMSAIGQSLDKAQDNYRQAMKKLSSGRGNVLAQAEAFRGLGVEIKREINPDLAEQAVSQDEEYRLRSVPEQPNDEAYQRDDEYNQQSR

SEQ ID NO: 8881 - DNA, 756 bp, Escherichia coli
atggtggataagtcacaagaaacgacgcactttggttttcagaccgtcgcgaaggaacaaaaagcggatatggtcgcccacgttttccattccgtggcatcaaaatacgatgtcatgaatgatttgatgtcattcggtattcatcgtttgtggaagcgattcacgattgattgcagcggcgtacgccgtgggcagaccgtgctggatctggctggtggcaccggcgacctgacagcgaaattctctcgcctggtcggagaaactggcaaagtggtccttgctgatatcaatgaatccatgctcaaaatgggccgcgagaagctgcgtaatatcggtgtgattggcaacgttgagtatgttcaggcgaacgctgaggcgctgccgttcccggataacacctttgattgcatcaccatttcgtttggtctgcgtaacgtcaccgacaaagataaagcactgcgttcaatgtatcgcgtgctgaaacccggcggccgcctgctggtacttgagttctcgaagccaattatcgagccgctgagcaaagcctatgatgcatactccttccatgtgctgccgcgtattggctcactggtcgcgaacgacgccgacagctaccgttatctggcagaatccatccgtatgcatcccgatcaggataccctgaaaaccatgatgcaggatgccggattcgaaagtgtcgactactacaatctgacggcaggggttgtggcgctgcatcgtggttataagttctga

SEQ ID NO: 8882 - protein, 251 aa, Escherichia coli
MVDKSQETTHFGFQTVAKEQKADMVAHVFHSVASKYDVMNDLMSFGIHRLWKRFTIDCSGVRRGQTVLDLAGGTGDLTAKFSRLVGETGKVVLADINESMLKMGREKLRNIGVIGNVEYVQANAEALPFPDNTFDCITISFGLRNVTDKDKALRSMYRVLKPGGRLLVLEFSKPIIEPLSKAYDAYSFHVLPRIGSLVANDADSYRYLAESIRMHPDQDTLKTMMQDAGFESVDYYNLTAGVVALHRGYKF

SEQ ID NO: 8883 - DNA, 606 bp, Escherichia coli
atgccttttaaacctttagtgacggcaggaattgaaagtctgctcaacaccttcctgtatcgctcacccgcgctgaaaacggcccgctcgcgtctgttgggcaaagtgctgcgcgtggaggtaaaaggcttttcgacgtcattgattctggtgttcagcgaacgccaggtcgatgtactgggcgaatgggcaggcgatgctgactgcaccgttatcgcttacgccagcgtgttgccgaaacttcgcgatcgccagcagcttgccgcactgattcgcagtggtgagctggaagtgcagggtgatattcaggtggtgcaaaacttcgttgcgctggcagatctggcagagttcgaccctgcggaactgctggccccttataccggtgatatcgccgctgaaggtatcagcaaagccctgcgcggaggcgcaaagttcctgcatcacggcattaagcgccagcaatgttatgtggcggaagccattactgaagagtggcgtatggcacccggtccgcttgaagtggcctggtttgcggaagagacggctgccgtcgagcgtgctgttgatgccctgaccaaacggctggaaaaactggaggctaaatga

SEQ ID NO: 8884 - protein, 201 aa, Escherichia coli
MPFKPLVTAGIESLLNTFLYRSPALKTARSRLLGKVLRVEVKGFSTSLILVFSERQVDVLGEWAGDADCTVIAYASVLPKLRDRQQLAALIRSGELEVQGDIQVVQNFVALADLAEFDPAELLAPYTGDIAAEGISKALRGGAKFLHHGIKRQQCYVAEAITEEWRMAPGPLEVAWFAEETAAVERAVDALTKRLEKLEAK

SEQ ID NO: 8885 - DNA, 1641 bp, Escherichia coli
atgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacctttaggtgagcgactacgactggccctgcaagaactgggaccggtatggatcaagttcgggcagatgttatcaacccgccgcgatctttttccgccgcatattgccgatcagctggcgttattgcaggacaaagtcgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagttatccgcccggatattttgccggtcattaaagcggatctgaaacttatttaccgtctggctcgctgggtgccgcgtttgctgccggatggtcgccgtctgcgcccaaccgaagtggtgcgcgagtacgaaaagaccttgattgatgaactgaatttgctgcgggaatctgccaacgccattcagcttcgacgcaattttgaagacagcccgatgctctacatcccggaagtttaccctgactattgtagtgaagggatgatggtgatggagcgtatttacggcattccggtgtctgatgttgcgacgctggagaaaaacggcaccaacatgaaattgctggcggaacgcggcgtgcaggtgttcttcactcaggtctttcgcgacagctttttccatgctgatatgcaccctggcaacatcttcgtaagctatgaacacccggaaaacccgaaatatatcggcattgattgcgggattgttggctcgctaaacaaagaagataaacgctatctggcggaaaactttatcgccttctttaatcgcgactatcgcaaagtggcagagctacacgtcgattctggttgggtgccaccagataccaacgttgaagagttcgaatttgccattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcctgaactggtttacgacagtttgcgccagggcaagtatttacagcatagtgttgataagattgcccgcgagcttcagtcaaatcatgtacgtcagggacaatcgcgttattttctcggaattggcgctacgttagtattaagtggcacattcttgttggtcagccgacctgaatgggggctgatgcccggctggttaatggcaggtggtctgatcgcctggtttgtcggttggcgcaaaacacgctga

SEQ ID NO: 8886 - protein, 546 aa, Escherichia coli
MTPGEVRRLYFIIRTFLSYGLDELIPKMRITLPLRLWRYSLFWMPNRHKDKPLGERLRLALQELGPVWIKFGQMLSTRRDLFPPHIADQLALLQDKVAPFDGKLAKQQIEAAMGGLPVEAWFDDFEIKPLASASIAQVHTARLKSNGKEVVIKVIRPDILPVIKADLKLIYRLARWVPRLLPDGRRLRPTEVVREYEKTLIDELNLLRESANAIQLRRNFEDSPMLYIPEVYPDYCSEGMMVMERIYGIPVSDVATLEKNGTNMKLLAERGVQVFFTQVFRDSFFHADMHPGNIFVSYEHPENPKYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKEKAPFWVEKMPELPELVYDSLRQGKYLQHSVDKIARELQSNHVRQGQSRYFLGIGATLVLSGTFLLVSRPEWGLMPGWLMAGGLIAWFVGWRKTR

SEQ ID NO: 8887 - DNA, 312 bp, Escherichia coli
atgcggctttgtttaatcatcatctaccacagaggaacatgtatgggtggtatcagtatttggcagttattgattattgccgtcatcgttgtactgctttttggcaccaaaaagctcggctccatcggttccgatcttggtgcgtcgatcaaaggctttaaaaaagcaatgagcgatgatgaaccaaagcaggataaaaccagccaggatgctgattttactgcgaaaactatcgccgataagcaggcggatacgaatcaggaacaggctaaaacagaagacgcgaagcgccacgataaagagcaggtgtaa

SEQ ID NO: 8888 - protein, 103 aa, Escherichia coli
MRLCLIIIYHRGTCMGGISIWQLLIIAVIVVLLFGTKKLGSIGSDLGASIKGFKKAMSDDEPKQDKTSQDADFTAKTIADKQADTNQEQAKTEDAKRHDKEQV

SEQ ID NO: 8889 - DNA, 516 bp, Escherichia coli
gtgtttgatatcggttttagcgaactgctattggtgttcatcatcggcctcgtcgttctggggccgcaacgactgcctgtggcggtaaaaacggtagcgggctggattcgcgcgttgcgttcactggcgacaacggtgcagaacgaactgacccaggagttaaaactccaggagtttcaggacagtctgaaaaaggttgaaaaggcgagcctcactaacctgacgcccgaactgaaagcgtcgatggatgaattacgccaggctgcggagtcgatgaagcgttcctacgttgcaaacgatcctgaaaaggcgagcgatgaagcgcacaccatccataacccggtggtgaaagacaatgaaactgcgcatgaaggcgtaacgcctgctgctgcacaaacgcaggccagttcgccggaacagaagccagaaaccacgccagagccggtggtaaaacctgctgcggacgctgaaccgaaaaccgctgcaccttccccttcgtcgagtgataaaccgtaa

SEQ ID NO: 8890 - protein, 171 aa, Escherichia coli
MFDIGFSELLLVFIIGLVVLGPQRLPVAVKTVAGWIRALRSLATTVQNELTQELKLQEFQDSLKKVEKASLTNLTPELKASMDELRQAAESMKRSYVANDPEKASDEAHTIHNPVVKDNETAHEGVTPAAAQTQASSPEQKPETTPEPVVKPAADAEPKTAAPSPSSSDKP

SEQ ID NO: 8891 - DNA, 777 bp, Escherichia coli
atgtctgtagaagatactcaaccgcttatcacgcatctgattgagctgcgtaagcgtctgctgaactgcattatctcggtgatcgtgatattcctgtgtctggtctatttcgccaatgacatctatcacctggtatccgcgccactgatcaagcagttgccgcaaggttcaacgatgatcgccaccgacgtggcctcgccgttctttacgccgatcaagctgacctttatggtgtcgctgattctgtcagcgccggtgattctctatcaggtgtgggcgtttatcgccccagcgctgtataagcatgaacgtcgcctggtggtgccgctgctggtttccagctctctgctgttttatatcggcatggcgttcgcctactttgtggtctttccgctggcatttggcttccttgccaataccgcgccggaaggggtacaggtatccaccgacatcgcgagctatttaagcttcgttatggcgctgtttatggcgtttggtgtctcctttgaagtgccggtggcaattgtgctgctgtgctggatggggattacctcgccagaagacttacgcaaaaaacgcccgtatgtgctggttggtgcattcgttgtcgggatgttgctgacgccgccggatgtcttctcgcaaacgctgttggcgatccctatgtactgcctgtttgaaatcggtgtcttcttctcacgcttttacgttggtaaagggcgaaaccgggaagaggaaaacgacgctgaagcagaaagcgaaaaaactgaagaataa

SEQ ID NO: 8892 - protein, 258 aa, Escherichia coli
MSVEDTQPLITHLIELRKRLLNCIISVIVIFLCLVYFANDIYHLVSAPLIKQLPQGSTMIATDVASPFFTPIKLTFMVSLILSAPVILYQVWAFIAPALYKHERRLVVPLLVSSSLLFYIGMAFAYFVVFPLAFGFLANTAPEGVQVSTDIASYLSFVMALFMAFGVSFEVPVAIVLLCWMGITSPEDLRKKRPYVLVGAFVVGMLLTPPDVFSQTLLAIPMYCLFEIGVFFSRFYVGKGRNREEENDAEAESEKTEE

SEQ ID NO: 8893 - DNA, 783 bp, Escherichia coli
atgtttgatatcggcgttaatttgaccagttcgcaatttgcgaaagaccgtgatgatgttgtagcgcgcgcttttgacgcgggagttaatgggctactcatcaccggtaccaatctgcgtgaaagccagcaggcgcaaaagctggcgcgtcagtattcgtcctgttggtcaacggcgggcgtacatcctcacgacagcagccagtggcaagctgtgactgaagaagcgattattgagctggccgcgcagccagaagtggtggcgattggtgaatgtggtctcgactttaaccgcaacttttcgacgccggaagagcaggaacgcgcttttgttgcccagctacgcattgccgcagaattaaacatgccggtatttatgcactgtcgcgatgcccacgagcggtttatgacattgctggagccgtggctggataaactgcctggtgcggttcttcattgctttaccggcacacgcgaagagatgcaggcgtgcgtggcgtgtggaatttatatcggcattaccggttgggtttgcgatgaacgacgcgggctggagctgcgggaattgttgccgttgattccggcggagaaattgctgatcgaaactgatgcgccgtatctgctccctcgcgatctcacgccaaagccatcatcccggcgcaacgagccagcccatctgccccatattttgcaacgtattgcgcactggcgtggagaagatgccgcatggctggctgccaccacggatgccaatgtcaaaacactgtttgggattgcgttttag

SEQ ID NO: 8894 - protein, 260 aa, Escherichia coli
MFDIGVNLTSSQFAKDRDDVVARAFDAGVNGLLITGTNLRESQQAQKLARQYSSCWSTAGVHPHDSSQWQAVTEEAIIELAAQPEVVAIGECGLDFNRNFSTPEEQERAFVAQLRIAAELNMPVFMHCRDAHERFMTLLEPWLDKLPGAVLHCFTGTREEMQACVACGIYIGITGWVCDERRGLELRELLPLIPAEKLLIETDAPYLLPRDLTPKPSSRRNEPAHLPHILQRIAHWRGEDAAWLAATTDANVKTLFGIAF

SEQ ID NO: 8895 - DNA, 489 bp, Escherichia coli
atgcaatcctggtatttactgtactgcaagcgcgggcaacttcaacgtgcccaggaacacctcgaaagacaggctgtgaattgcctggcaccgatgatcaccctggaaaaaatcgtgcgtggcaaacgtactgcagtcagtgagccattgttccccaactacttgtttgtggagttcgatccggaagtgattcataccacgactatcaacgcgactcgtggtgtcagccacttcgtgcgctttggcgcgtcgccagcgatagtcccatcggcggtgattcatcagttatcagtgtataaaccgaaagatattgtcgatccatcgacgccgtatcctggtgataaagtgattattactgaaggcgcattcgaaggttttcaggccattttcaccgagcccgatggcgaggctcgctccatgctattgctgaatcttattaataaagagattaagcacagtgtgaagaacaccgagttccgcaaactctaa

SEQ ID NO: 8896 - protein, 162 aa, Escherichia coli
MQSWYLLYCKRGQLQRAQEHLERQAVNCLAPMITLEKIVRGKRTAVSEPLFPNYLFVEFDPEVIHTTTINATRGVSHFVRFGASPAIVPSAVIHQLSVYKPKDIVDPSTPYPGDKVIITEGAFEGFQAIFTEPDGEARSMLLLNLINKEIKHSVKNTEFRKL

SEQ ID NO: 8897 - DNA, 1494 bp, Escherichia coli
atggacgccatgaaatataacgatttacgcgacttcttgacgctgcttgaacagcagggtgagctaaaacgtatcacgctcccggtggatccgcacctggaaatcactgaaattgctgaccgcactttgcgtgccggtgggcctgcgctgttgttcgaaaaccctaaaggctactcaatgccggtgctgtgcaacctgttcggtacgccaaagcgcgtggcgatgggcatggggcaggaagatgtttcggcgctgcgtgaagttggtaaattattggcgtttctgaaagagccggagccgccaaaaggtttccgcgacctgtttgataaactgccgcagtttaagcaagtattgaacatgccgacaaagcgactgcgtggtgcaccctgccaacaaaaaatcgtctctggcgatgacgtcgatctcaatcgcattcccattatgacctgctggccggaagatgccgcgccgctgattacctgggggctcaccgtaacgcgcggcccgcataaagagcggcagaatctgggcatttatcgccagcagctaattggtaaaaacaaactgattatgcgctggctgtcgcatcgcggcggcgcgttggattatcaggagtggtgtgcggcgcatccgggcgaacgtttcccggtttctgtggcgctgggtgccgatcctgccacgattctcggtgcagtcacccccgttccggatacgctttcagagtatgcgtttgccggattgctgcgcggtaccaagaccgaagtggtgaagtgtatctccaatgaccttgaagtgcccgccagtgcggagattgtgctggaagggtatatcgaacaaggcgaaactgcgccggaagggccgtatggcgaccacaccggttactataacgaagtcgatagttttccggtatttaccgtgacgcatattacccagcgtgaagatgcgatttatcattccacctataccgggcgtccgccagatgaacctgcggtactgggtgtagcactgaacgaagtgttcgtgccgattctgcaaaaacagttcccggaaattgtcgatttttatctgccgccggaaggctgttcttatcgtctggcggtagtgacgatcaaaaaacagtacgccggacacgcgaagcgcgtcatgatgggcgtctggtcgttcttacgccagtttatgtacactaaatttgtgatcgtttgcgatgatgacgtcaacgcccgcgactggaacgatgtgatttgggcgattaccacccgtatggacccggcgcgggatactgttctggtagaaaatacgcctattgattatctggattttgcctcgcctgtctccgggctgggttcaaaaatggggctggatgccacgaataaatggccgggtgaaacccagcgtgaatggggacgtcccatcaaaaaagatccagatgttgtcgcgcatattgacgccatttgggatgaactggctatttttaacaacggtaaaagcgcctga

SEQ ID NO: 8898 - protein, 497 aa, Escherichia coli
MDAMKYNDLRDFLTLLEQQGELKRITLPVDPHLEITEIADRTLRAGGPALLFENPKGYSMPVLCNLFGTPKRVAMGMGQEDVSALREVGKLLAFLKEPEPPKGFRDLFDKLPQFKQVLNMPTKRLRGAPCQQKIVSGDDVDLNRIPIMTCWPEDAAPLITWGLTVTRGPHKERQNLGIYRQQLIGKNKLIMRWLSHRGGALDYQEWCAAHPGERFPVSVALGADPATILGAVTPVPDTLSEYAFAGLLRGTKTEVVKCISNDLEVPASAEIVLEGYIEQGETAPEGPYGDHTGYYNEVDSFPVFTVTHITQREDAIYHSTYTGRPPDEPAVLGVALNEVFVPILQKQFPEIVDFYLPPEGCSYRLAVVTIKKQYAGHAKRVMMGVWSFLRQFMYTKFVIVCDDDVNARDWNDVIWAITTRMDPARDTVLVENTPIDYLDFASPVSGLGSKMGLDATNKWPGETQREWGRPIKKDPDVVAHIDAIWDELAIFNNGKSA

SEQ ID NO: 8899 - DNA, 735 bp, Escherichia coli
ttgccctatttatcgatccgacagagaaagcgcatgacaaccttaagctgtaaagtgacctcggtagaagctatcacggataccgtatatcgtgtccgcatcgtgccagacgcggccttttcttttcgtgctggtcagtatttgatggtagtgatggatgagcgcgacaaacgtccgttctcaatggcttcgacgccagatgaaaaagggtttatcgagctgcatattggcgcttctgaaatcaacctttacgcgaaagcagtcatggaccgcatcctcaaagatcatcaaatcgtggtcgatattccccacggagaagcgtggctgcgcgatgatgaagagcgtccgatgattttgattgcgggcggcaccgggttctcttatgcccgctcgattttgctgacagcgttggcgcgtaacccaaaccgtgatatcaccatttactggggcgggcgtgaagagcagcatctgtatgatctctgcgagcttgaggcgctttcgttgaagcatcctggtctacaagtggtgccggtggttgaacaaccggaagcgggctggcgtgggcgtactggcaccgtgttaacggcggtattgcaggatcatggtacgctggcagagcatgatatctatattgccggacgttttgagatggcgaaaattgcccgtgacctgttttgcagtgagcgtaatgcgcgggaagatcgcctgtttggcgatgcgtttgcatttatctga

SEQ ID NO: 8900 - protein, 244 aa, Escherichia coli
MPYLSIRQRKRMTTLSCKVTSVEAITDTVYRVRIVPDAAFSFRAGQYLMVVMDERDKRPFSMASTPDEKGFIELHIGASEINLYAKAVMDRILKDHQIVVDIPHGEAWLRDDEERPMILIAGGTGFSYARSILLTALARNPNRDITIYWGGREEQHLYDLCELEALSLKHPGLQVVPVVEQPEAGWRGRTGTVLTAVLQDHGTLAEHDIYIAGRFEMAKIARDLFCSERNAREDRLFGDAFAFI

SEQ ID NO: 8901 - DNA, 96 bp, Escherichia coli
gtgcccgatgcgacgctgccgcgtcttatcgggcctacaaaagttctgaaccgtaggccggataaggcgttcacgccgcatccggcaagtggttaa

SEQ ID NO: 8902 - protein, 31 aa, Escherichia coli
MPDATLPRLIGPTKVLNRRPDKAFTPHPASG

SEQ ID NO: 8903 - DNA, 1164 bp, Escherichia coli
atggaacaggttgtcattgtcgatgcaattcgcaccccgatgggccgttcgaagggcggtgcttttcgtaacgtgcgtgcggaagatctctccgctcatttaatgcgtagcctgctggcgcgtaacccggcgctggaagcagcggccctcgacgatatttactggggttgtgtgcagcaaacactggagcagggttttaacatcgcccgtaacgcggcactgttggctgaagtgccgcactctgtcccggcggttaccgttaatcgcttgtgtggttcatccatgcaggcactgcatgacgcagcacgaatgatcatgaccggcgatgcgcaggcatgtctggttggcggcgtggagcatatgggccatgtgccaatgagtcacggcgtcgattttcaccccggccttagccgtaatgtcgccaaagcggcgggcatgatgggcttaacggcagaaatgctggcgcgtatgcatggtatcagccgtgaaatgcaggatgcctttgccgcgcggtcacacgcccgcgcgtgggccgccacgcagtcaggcgcatttaaaaatgaaatcatcccgaccggtggtcacgatgccgacggcgtattgaagcagtttaattacgacgaagtgattcgcccggaaaccaccgtggaagccctcgccacactgcgtccggcgtttgatcccgtcagcggtacggtaacggcgggtacatcttctgcgctttccgatggcgcagctgccatgctggtgatgagtgaaagccgcgcccgtgaattaggtcttaagccgcgcgcccgcgtgcgttcgatggcggttgtgggttgtgacccatctattatgggttatggtccggttccggcctcgaagctggcgctgaaaaaagcggggctttctgccagcgatatcggcgtattcgagatgaacgaagcctttgccgcgcagatcctgccgtgtattaaagatctcgggctaatggagcagattgacgagaagatcaacctcaacggtggcgcgatcgcgctgggtcatccgctgggttgttccggtgcgcgtatcagcaccacgctgctgaatctgatggaacacaaagacgtccagtttggtctggcgacgatgtgtatcggtctgggtcagggcattgcaacggtgtttgagcgggtttaa

SEQ ID NO: 8904 - protein, 387 aa, Escherichia coli
MEQVVIVDAIRTPMGRSKGGAFRNVRAEDLSAHLMRSLLARNPALEAAALDDIYWGCVQQTLEQGFNIARNAALLAEVPHSVPAVTVNRLCGSSMQALHDAARMIMTGDAQACLVGGVEHMGHVPMSHGVDFHPGLSRNVAKAAGMMGLTAEMLARMHGISREMQDAFAARSHARAWAATQSGAFKNEIIPTGGHDADGVLKQFNYDEVIRPETTVEALATLRPAFDPVSGTVTAGTSSALSDGAAAMLVMSESRARELGLKPRARVRSMAVVGCDPSIMGYGPVPASKLALKKAGLSASDIGVFEMNEAFAAQILPCIKDLGLMEQIDEKINLNGGAIALGHPLGCSGARISTTLLNLMEHKDVQFGLATMCIGLGQGIATVFERV

SEQ ID NO: 8905 - DNA, 2190 bp, Escherichia coli
atgctttacaaaggcgacaccctttaccttgactggctggaagatggcattgccgaactggtatttgataccccaggttcagttaataaactcgacactgcgaccgtcgccagcctcggcgaggccatcggcgtgctggaacagcaatcagatctaaaaggactgctgctacgttcgaacaaagcagcctttatcgtcggtgctgatatcaccgaatttttgtccctgttcctcgttcctgaagaacagttaagtcagtggctgcactttgccaatagcgtgtttaatcgcctggaagatctgccggtgccgaccattgctgccgtcaacggctatgcgctgggcggtggctgcgaatgcgtgctggcgaccgattatcgtctggcgacgccggatctgcgcatcggtctgccggaaaccaaattgggcatcatgccgggctttggcggttctgtacgtatgccacgtatgctgggcgctgacagtgcgctggaaatcattgccgccggtaaagatgtcggcgcggatcaggcgctgaaaatcggtctggtggatggcgtagtcaaagcagaaaaactggttgaaggggcgatagcgattttacgccaggccattaacggcgacctcgactggaaagcaaaacgtcagccgaagctggaaccgctaaaactgagcaagattgaagccgccatgagcttcaccatcgctaaagggatggtcgcgcaaacggcggggaaacattatccggcccccatcaccgcagtaaaaaccattgaagctgcggcccgttttggtcgtgaagaagccttaaacctggaaaacaaaagttttgtcccgctggcgcataccaacgaagcccgcgcactggtcggcattttccttaacgatcaatatgtaaaaggtaaagcgaagaaactcaccaaagatgttgaaaccccgaaacaggccgctgtgctgggcgcaggcattatgggcggcggcatcgcctaccagtctgcgtggaaaggcgtgccggttgtcatgaaagatatcaacgacaagtcgttaaccctcggcatgaccgaagccgcgaaactgctgaacaagcagcttgagcgcggcaagatcgatggtctgaaactggctggcgtgatctccacaattcacccaacgctcgactacgccgggtttgaccgcgtggatgttgtggtagaagcggttgttgaaaacccgaaagtgaaaaaagccgtgctggcagaaaccgagcagaaagtacgcccggataccgtgctggcgtctaacacttcaaccattcctatcagcgaactggccaacgcgctggaacgtccggaaaacttctgcgggatgcacttctttaacccggtgcaccggatgccgttggtggaaattattcgcggcgagaaaagctccgacgaaaccatcgcgaaagtcgtcgcctgggcgagcaagatgggcaagacgccgattgtggtcaacgactgccccggcttcttcgtcaaccgtgtgctgttcccctatttcgccggtttcagccagttgctgcgcgacggcgcgggtttccgcaagatcgacaaagtgatggaaaaacagtttggctggccgatgggtccggcatatctgctggatgttgtgggcattgacaccgcgcatcacgctcaggctgtcatggcagcaggcttcccgcagcggatgcagaaagattatcgcgatgccatcgacgcgctgtttgatgccaaccgctttggtcagaagaacggcctcggtttctggcgttataaagaagacagcaaaggtaagccgaagaaagaagaagatgtcgtcgttgacgacctgctggcaaaagtgagccagccgaagcgcgatttcagcgaggaagagattatcgcccgcatgatgatcccgatggtcaacgaagtggtccgctgtctggaagagggcattatcgccactccggcagaagcggatatggcgctggtctacggcctgggcttccctccgttccacggcggcgcgttccgctggctggacaccctcggcagcgcaaaatacctcgatatggcacagcaatatcagcacctcggcccgctgtatgaagtaccggaaggtctgcgtaataaagcacgtcataacgaaccgtactatcccccggttgagccagcccgtccggttggcgacctgaaaacggcttaa

SEQ ID NO: 8906 - protein, 729 aa, Escherichia coli
MLYKGDTLYLDWLEDGIAELVFDTPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAIAILRQAINGDLDWKAKRQPKLEPLKLSKIEAAMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDVVVEAVVENPKVKKAVLAETEQKVRPDTVLASNTSTIPISELANALERPENFCGMHFFNPVHRMPLVEIIRGEKSSDETIAKVVAWASKMGKTPIVVNDCPGFFVNRVLFPYFAGFSQLLRDGAGFRKIDKVMEKQFGWPMGPAYLLDVVGIDTAHHAQAVMAAGFPQRMQKDYRDAIDALFDANRFGQKNGLGFWRYKEDSKGKPKKEEDVVVDDLLAKVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 8907 - DNA, 1332 bp, Escherichia coli
atggaatcactggcctcgctctataaaaatcatatagctaccttacaggaacggactcgcgatgcgctggcgcgcttcaagctggatgcgttacttattcactccggcgaactgttcaacgtttttctcgacgatcatccctatccgtttaaagtgaacccgcaattcaaagcgtgggtgccggtaactcaggtgccaaactgctggctgctggtggatggcgtgaataagccgaaactgtggttttatctgccggttgattactggcacaacgtcgaaccgctgccgaactccttctggactgaagatgtagaagtgatcgcgctgccaaaagccgatggcattggtagtctgttgcctgctgcgcgcggcaatatcggttatatcggtccggtgccagaacgtgcgctgcaactgggtattgaggccagcaatatcaacccgaaaggggtgatcgactacctgcattactatcgctccttcaaaaccgagtacgaactggcctgtatgcgtgaagcgcagaaaatggcggtcaacggtcatcgcgcggcagaagaagcgttccgttctggcatgagcgagttcgatatcaacattgcctatctgaccgcgaccggtcatcgtgataccgacgtaccttatagcaacattgtggcgcttaacgaacacgctgcggtgttgcattacaccaaactggaccaccaggcaccggaagagatgcgcagcttcctgctggatgccggggccgaatataacggctatgcggctgatctaacccgtacctggtcggcaaaaagcgacaacgactacgcacagctggtgaaagacgtaaatgatgagcaactggcgctgatcgccaccatgaaagcaggcgtcagctatgtggattaccatatccagttccatcagcgcatcgccaaactgctgcgtaaacatcaaatcatcaccgatatgagtgaagaagcgatggtcgaaaacgatctcaccggaccgtttatgccgcacggtatcggccatccgctgggcctgcaggtgcatgacgtagccggttttatgcaggatgatagcggtacgcacctcgcggcaccggcaaaatatccgtacctgcgctgcactcgtattctccagccgggcatggtgttaaccatcgaaccgggtatctacttcatcgaatcgcttctggcaccgtggcgtgaagggcagttcagcaaacacttcaactggcagaaaattgaagcactgaaaccgttcggcggcattcgtatcgaagacaacgtggtgattcacgaaaacaacgtggaaaacatgacccgggatctgaaactggcgtga

SEQ ID NO: 8908 - protein, 443 aa, Escherichia coli
MESLASLYKNHIATLQERTRDALARFKLDALLIHSGELFNVFLDDHPYPFKVNPQFKAWVPVTQVPNCWLLVDGVNKPKLWFYLPVDYWHNVEPLPNSFWTEDVEVIALPKADGIGSLLPAARGNIGYIGPVPERALQLGIEASNINPKGVIDYLHYYRSFKTEYELACMREAQKMAVNGHRAAEEAFRSGMSEFDINIAYLTATGHRDTDVPYSNIVALNEHAAVLHYTKLDHQAPEEMRSFLLDAGAEYNGYAADLTRTWSAKSDNDYAQLVKDVNDEQLALIATMKAGVSYVDYHIQFHQRIAKLLRKHQIITDMSEEAMVENDLTGPFMPHGIGHPLGLQVHDVAGFMQDDSGTHLAAPAKYPYLRCTRILQPGMVLTIEPGIYFIESLLAPWREGQFSKHFNWQKIEALKPFGGIRIEDNVVIHENNVENMTRDLKLA

SEQ ID NO: 8909 - DNA, 618 bp, Escherichia coli
gtgatggaaagctggttaattcctgcggcaccggtcacggtcgttgaagagatcaaaaagagccgcttcattacgctgttggcgcataccgatggcgttgaggcggcaaaagcgtttgttgaatcggtgcgggcagaacaccccgatgcccggcaccattgcgtggcgtgggtggcgggtgcgccggatgattctcaacagctgggtttctctgacgacggggagccggcgggaacggcaggtaaaccgatgctcgcccaactaatgggcagcggcgtcggggaaattaccgctgtggtggtgcgctactacggcggcatattgcttggcaccggtgggttagtgaaagcgtatggcggcggcgtgaatcaggcgctgcgccagctaacgacccaacgcaagacaccattaaccgaatatactttgcaatgtgaatatagtcagttaaccggcattgaagcgttgctggggcagtgtgacggcaaaattattaacagtgattatcaggcattcgttctgctgcgggtggcgcttccggcggcgaaagtggctgaattttccgcaaagctggcggattttagccgtggttcattgcaattgttagcgattgaagaataa

SEQ ID NO: 8910 - protein, 205 aa, Escherichia coli
MMESWLIPAAPVTVVEEIKKSRFITLLAHTDGVEAAKAFVESVRAEHPDARHHCVAWVAGAPDDSQQLGFSDDGEPAGTAGKPMLAQLMGSGVGEITAVVVRYYGGILLGTGGLVKAYGGGVNQALRQLTTQRKTPLTEYTLQCEYSQLTGIEALLGQCDGKIINSDYQAFVLLRVALPAAKVAEFSAKLADFSRGSLQLLAIEE

SEQ ID NO: 8911 - DNA, 1452 bp, Escherichia coli
atgcattttcgcgccattacccgaatcgttggactactggtcatcttattttcagggaccatgattatccctgggctggtagcactcatctaccgggatggagcgggccgcgcttttacccagaccttttttgtcgccctcgccattggctctatgctttggtggccgaaccgcaaagagaagggcgaactgaaatcccgtgaggggtttctgatagtggtgctgttctggaccgtgctgggtagcgtcggtgcgctcccttttatcttctcggaaagcccgaacctcacgattaccgatgcgttttttgaatctttctctggcctgaccaccacgggggccactacgctggtggggctggattcgctccctcatgccatcctcttttatcgccagatgctgcaatggtttggcggtatggggatcatcgtgctggcggttgcgatactgcctatcctcggcgtgggtgggatgcagctctatcgcgcagaaatgcccggcccgctgaaagataacaaaatgcgcccgcgaattgcggaaacggcgaaaaccctgtggttgatttatgtcttgctgaccgtcgcctgtgcgctggcgttgtggtttgctggaatggatgcctttgatgccatcggccatagctttgcgaccatcgctattggcggcttctcgacacatgatgccagtatcggttatttcgacagcccgactattaacactatcattgctatcttcctgctgatctctggctgtaactacggtctgcacttttcactgttaagtgggcgtagtctgaaggtttattggcgcgatccggaatttcgcatgtttatcggcgtacagttttcactggtggttatttgtacactcgtactgtggtttcataatgtctacagttcggcgctgatgacaattaaccaggcgtttttccaggtggtgtcgatggcgacaaccgccgggtttacaactgacagcattgcccgctggccgctctttttgccggtactgcttttatgttcagcttttatcggcggttgcgccgggtcaacgggcggtggcctgaaagtgatccgcatcctgctgctgtttaagcaggggaaccgtgagctgaaacgactggtgcatccgaacgccgtctatagcattaagctggggaatcgcgcactgccggaacgtatcctcgaagccgtttggggatttttctccgcctatgcattggtgtttattgtcagtatgctggcgattatcgccacgggcgtggatgacttttctgcctttgcctcggttgttgcaacattgaataacctggggccagggcttggcgtggttgctgataactttaccagtatgaacccggtggctaaatggatcctgattgccaacatgctgtttggtcgtctcgaggtctttacattgctggtgctctttaccccgactttctggcgtgaatga

SEQ ID NO: 8912 - protein, 483 aa, Escherichia coli
MHFRAITRIVGLLVILFSGTMIIPGLVALIYRDGAGRAFTQTFFVALAIGSMLWWPNRKEKGELKSREGFLIVVLFWTVLGSVGALPFIFSESPNLTITDAFFESFSGLTTTGATTLVGLDSLPHAILFYRQMLQWFGGMGIIVLAVAILPILGVGGMQLYRAEMPGPLKDNKMRPRIAETAKTLWLIYVLLTVACALALWFAGMDAFDAIGHSFATIAIGGFSTHDASIGYFDSPTINTIIAIFLLISGCNYGLHFSLLSGRSLKVYWRDPEFRMFIGVQFSLVVICTLVLWFHNVYSSALMTINQAFFQVVSMATTAGFTTDSIARWPLFLPVLLLCSAFIGGCAGSTGGGLKVIRILLLFKQGNRELKRLVHPNAVYSIKLGNRALPERILEAVWGFFSAYALVFIVSMLAIIATGVDDFSAFASVVATLNNLGPGLGVVADNFTSMNPVAKWILIANMLFGRLEVFTLLVLFTPTFWRE

SEQ ID NO: 8913 - DNA, 546 bp, Escherichia coli
gtgaaaacattaattcttttctcaacaagggacggacaaacgcgcgagattgcctcctacctggcttcggaactgaaagaactggggatccaggcggatgtcgccaatgtgcaccgcattgaagaaccacaatgggaaaactatgaccgtgtggttattggcgcttctattcgctatggtcactaccattctgcgttccaggaatttgtcaaaaagcatgcgacgcggttgaattcgatgccgagtgccttttactccgtaaatctggtggcgcgtaaaccggagaagcgtactccacagaccaacagctacgcgcggaagtttctgatgaactcgcaatggcgtcccgatcgctgtgccgtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataa

SEQ ID NO: 8914 - protein, 181 aa, Escherichia coli
MKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 8915 - DNA, 126 bp, Escherichia coli; identical to SEQ ID NO: 637

SEQ ID NO: 8916 - protein, 41 aa, Escherichia coli; identical to SEQ ID NO: 638

SEQ ID NO: 8917 - DNA, 528 bp, Escherichia coli
atggcaggaaaaacgatgataccgttactcgcctttgctgcatggagtggcaccggaaaaacaacgctgctgaaaaaattgatcccggcattatgcgccagagggatccgtccggggctgattaagcatacgcaccatgatatggatgttgataaaccgggcaaagatagctatgagctgcgcaaggctggcgcggcgcaaaccatcgttgccagccaacagcgatgggccttgatgacggaaacaccagacgaagaagagctggatctacattttctcgcaagtcgaatggatacctcaaagctggatttgattctggtcgaagggtttaagcatgaagagatcgcaaagattgtgctgtttcgcgatggagccggacatcgaccggaagaattagtgatagacaggcatgttattgctgtagccagtgatgtgccgcttaatcttgatgtcgcgttactggatattaatgatgttgaggggctggctgattttgtggtggagtggatgcaaaagcaggacggatag

SEQ ID NO: 8918 - protein, 175 aa, Escherichia coli
MAGKTMIPLLAFAAWSGTGKTTLLKKLIPALCARGIRPGLIKHTHHDMDVDKPGKDSYELRKAGAAQTIVASQQRWALMTETPDEEELDLHFLASRMDTSKLDLILVEGFKHEEIAKIVLFRDGAGHRPEELVIDRHVIAVASDVPLNLDVALLDINDVEGLADFVVEWMQKQDG

SEQ ID NO: 8919 - DNA, 576 bp, Escherichia coli
atgacgatgataacaggcgttgtgctggcgggcggtaaagccagacgaatgggcggcgtagataaaggattgcttgaattaaacggcaaaccattatggcagtatgtcgctgacgcgcttatgacgcagctttctcacgtcgtgattaatgctaatcgtcatcaggaaatctatcaggtaagcggtctgaaagtgattgaagattcactggcggattaccctggtcctctggcaggaatgctttcagtaatgcagcaggaagcgggtgagtggtttttgttttgcccgtgcgatacgccttacattccccatgatttagccgcccggcttactcatcagcgcaaagatgcgcctgtcgtgtgggtccacgacggtgaacgcgatcacccgactattgctctggtaaaccgcgcaattgagcctttattactggaatatctgcaagcaggagaacgccgggttatggcatttatgcgtctggctggcggtcatgcggttgatttcagcgatcgtaaagaggcatttataaacgtgaatacgccagaggagcttgcccgatggcaggaaaaacgatga

SEQ ID NO: 8920 - protein, 191 aa, Escherichia coli
MTMITGVVLAGGKARRMGGVDKGLLELNGKPLWQYVADALMTQLSHVVINANRHQEIYQVSGLKVIEDSLADYPGPLAGMLSVMQQEAGEWFLFCPCDTPYIPHDLAARLTHQRKDAPVVWVHDGERDHPTIALVNRAIEPLLLEYLQAGERRVMAFMRLAGGHAVDFSDRKEAFINVNTPEELARWQEKR

SEQ ID NO: 8921 - DNA, 270 bp, Escherichia coli
atgaaatgtaaacgtctgaatgaagttattgaactcctccagccagcctggcaaaaagagccagaccttaacctgctgcaatttttgcagaaactggcgaaagagtcaggttttgacggcgaactggcggatttgacggatgacattctgatctatcacctgaaaatgcgtgattccgcgaaagatgcggtgatcccgggtttgcagaaagattatgaagaagatttcaaaacggcgctattacgcgcacgtggcgtaattaaagagtaa

SEQ ID NO: 8922 - protein, 89 aa, Escherichia coli
MKCKRLNEVIELLQPAWQKEPDLNLLQFLQKLAKESGFDGELADLTDDILIYHLKMRDSAKDAVIPGLQKDYEEDFKTALLRARGVIKE

SEQ ID NO: 8923 - DNA, 987 bp, Escherichia coli
atgaacaacagcgcttttactttccagacactacacccggataccatcatggacgctctgtttgagcatgggattcgggtggattccggtcttaccccgcttaacagctatgaaaaccgtgtctatcaatttcaggacgaagatcgtcgacgttttgtcgtcaaattttatcgccctgaacgttggacagccgatcaaatcctcgaagaacatcaatttgcgttgcagctggttaacgatgaagttccggtcgcagcacctgtggcctttaatggtcagactttattgaaccatcagggattttatttcgctgtttttccaagcgtcggtggtcgccagttcgaagctgataatatcgatcagatggaagcggttgggcgttatttagggcgtatgcaccagacggggcgcaaacagctttttatccatcgcccgaccatcggtttgaatgaatatctcattgagccacgcaagctgtttgaggacgctacactgataccttccgggttgaaagcggcattcctgaaagcgacagatgagctgattgccgccgttacagcacactggcgggaagatttcaccgttctgcggctacatggagactgccacgccgggaatattctctggcgcgatggtccaatgtttgttgatctggatgatgcacgtaatggtccagccgttcaggatttgtggatgttgctcaatggtgataaagccgagcagcggatgcaactggaaactattattgaggcttatgaagaatttagcgagttcgacaccgctgaaatcggactgattgaacctttacgcgccatgcgtttggtttattatcttgcctggctaatgcggcgttgggctgatcccgcgttcccgaaaaatttcccgtggttaaccggggaagattactggctacgacagacggtgacttttatagaacaggcaaaagttctacaagaaccccctttgcaattaacacctatgtattaa

SEQ ID NO: 8924 - protein, 328 aa, Escherichia coli
MNNSAFTFQTLHPDTIMDALFEHGIRVDSGLTPLNSYENRVYQFQDEDRRRFVVKFYRPERWTADQILEEHQFALQLVNDEVPVAAPVAFNGQTLLNHQGFYFAVFPSVGGRQFEADNIDQMEAVGRYLGRMHQTGRKQLFIHRPTIGLNEYLIEPRKLFEDATLIPSGLKAAFLKATDELIAAVTAHWREDFTVLRLHGDCHAGNILWRDGPMFVDLDDARNGPAVQDLWMLLNGDKAEQRMQLETIIEAYEEFSEFDTAEIGLIEPLRAMRLVYYLAWLMRRWADPAFPKNFPWLTGEDYWLRQTVTFIEQAKVLQEPPLQLTPMY

SEQ ID NO: 8925 - DNA, 627 bp, Escherichia coli
atgaaaaagatttggctggcgctggctggtttagttttagcgtttagcgcatcggcggcgcagtatgaagatggtaaacagtacactaccctggaaaaaccagttgctggcgcgccgcaagtgctggagtttttctctttcttctgcccgcactgctatcagtttgaagaagttctgcatatttctgataacgtgaagaaaaaactgccggaaggcgtgaagatgactaaataccacgtcaacttcatggggggtgacctgggcaaagagctgactcaggcatgggctgtggcgatggcgctgggcgtggaagacaaagtcacagttccgctgtttgaaggcgtacaaaaaacccagaccattcgttcagcatctgatatccgcgatgtatttatcaacgcaggtattaaaggtgaagagtacgacgcggcgtggaacagcttcgtggtgaaatctctggtcgctcagcaggaaaaagctgcagctgacgtgcaattgcgtggtgttccggcgatgtttgttaacggtaaatatcagctgaatccgcagggtatggataccagcaatatggatgtttttgttcagcagtatgctgatactgtgaaatatctgtccgagaaaaaataa

SEQ ID NO: 8926 - protein, 208 aa, Escherichia coli
MKKIWLALAGLVLAFSASAAQYEDGKQYTTLEKPVAGAPQVLEFFSFFCPHCYQFEEVLHISDNVKKKLPEGVKMTKYHVNFMGGDLGKELTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKK

SEQ ID NO: 8927 - DNA, 1431 bp, Escherichia coli
atgatacgtaagtcagctacaggtgccattgttgcgttagccgtaatctggggtggtggcacatggtacacaggtacgcaaattcagcctggtgtcgaaaagtttattaaaggttttaacgatgctaaaaagaaaggtgaacatgcctacgatatgacgttaagttataaaaattttgacaaaggcttttttaattcccgttttcaaatgcaaatgacatttgataacggtgcacccgatctcaatatcaagccaggccagaaaattgtatttgatgtggatgttgagcacggtccgttgcccatcacaatgttaatgcatggtaatgtcatcccagcactggcagcggcaaaagtgaacttagtgaataatgagctgacacaaccgctatttatcgccgcgaaaaataaatcgcccgtggaagcgacattgcgattcgcgtttggtggcccattctccacgacattagatgttgcccctgcagagtatggaaagttttcttttggtgaaggccagtttacttttaatggtgatgatagttcattgtctaacctggatattgaaggcaaagtcgaagatattgttctgcaattttcaccaatgaacaaagtaacggcgaaaagttttaccattgattctctgacacgattagaagaaaagaaatttccggttggtgaaagcgagtcgaaatttaatcaggttaatattatcaaccagggggaagtcgttgcccaaatcgatgctttcgttgcaaaaaccaggctggatcgcgttaaagacaaagattatatcaatgtcaatctgacctacgaacttgataagttaacaaaagggaatcagcaactcggtagtggtgagtggtcattgattgctgaatctattgatccctcagcggtgcgccaatttatcatccagtataacattgcgatgcagaagcagcttgctgcacaccctgagttagcaaacgatgaagttgctctgcaagaagtgaatgctgcattgttcaaagagtatttaccgttattacaaaaaagtgagccgacgattaaacaaccagtaagatggaagaacgcactcggcgaactaaatgccaatctggatatcagtattgccgacccagccaaatcttcatcatccacaaacaaagatattaaatcgctcaattttgatatgaagttaccgcttaatgtcgctacagaaaccgcaaaacagcttaatttatctgaagggatggatgcggaaaaagcgcaaaagcgggctgataagcaaatcagtgggatgatgacattaggtctgatgttacagttaatcacgattgacaacaataccgcctcgctgcaactgcgttatacaccgggtaaagttgtttttaacggacaggagatgagcgaagaagaatttatgtctcgtgccggacgttttgttcattaa

SEQ ID NO: 8928 - protein, 476 aa, Escherichia coli
MIRKSATGAIVALAVIWGGGTWYTGTQIQPGVEKFIKGFNDAKKKGEHAYDMTLSYKNFDKGFFNSRFQMQMTFDNGAPDLNIKPGQKIVFDVDVEHGPLPITMLMHGNVIPALAAAKVNLVNNELTQPLFIAAKNKSPVEATLRFAFGGPFSTTLDVAPAEYGKFSFGEGQFTFNGDDSSLSNLDIEGKVEDIVLQFSPMNKVTAKSFTIDSLTRLEEKKFPVGESESKFNQVNIINQGEVVAQIDAFVAKTRLDRVKDKDYINVNLTYELDKLTKGNQQLGSGEWSLIAESIDPSAVRQFIIQYNIAMQKQLAAHPELANDEVALQEVNAALFKEYLPLLQKSEPTIKQPVRWKNALGELNANLDISIADPAKSSSSTNKDIKSLNFDMKLPLNVATETAKQLNLSEGMDAEKAQKRADKQISGMMTLGLMLQLITIDNNTASLQLRYTPGKVVFNGQEMSEEEFMSRAGRFVH

SEQ ID NO: 8929 - DNA, 957 bp, Escherichia coli
ttgcgcttctttagcgcactgtctatggctaaccttttgaataaattcattatgacgagaatactcgctgcgataacccttttgctgagtatcgtattgaccattttggtcactattttttgttccgtcccgatcatcattgccgggattgtaaaactattgctacctgtgccagtcatttggcgaaaggtttcgcgtttttgtgattttatgatgtattgctggtgtgaaggtctggcggtattactgcatctgaacccacacctgcaatgggaagttcacgggctggaagggttaagtaagaagaactggtatctgcttatttgtaaccaccgtagttgggcagatattgtcgtactgtgcgtgctgtttcgtaagcacattccgatgaataaatatttcctcaagcagcagctggcctgggtgccttttcttggcctggcgtgctgggcgctggatatgccgtttatgaagcgttattcccgcgcttatttattacgtcatccggagcgacgtggtaaagatgttgaaaccactcggcgttcttgtgaaaagtttcgcctgcaccccaccactattgtcaatttcgttgaaggctcccgtttcacgcaagaaaaacatcagcaaacccactcctcttttcaaaacttgttgccaccaaaggcggcaggcattgcgatggcgctaaatgtactgggtaaacaattcgataaactgcttaatgttacgctgtgttatccggacaataaccgtcagccgttcttcgatatgttaagcggtaaactgacgcgaattgtcgtacatgtggatttacagcctattgccgatgagttacatggcgactacatcaatgacaaaagctttaagcgccattttcagcaatggctgaactcattgtggcaggaaaaagaccggcttctgacatcgttgatgtcatcacagcggcaggaaaagtaa

SEQ ID NO: 8930 - protein, 318 aa, Escherichia coli
MRFFSALSMANLLNKFIMTRILAAITLLLSIVLTILVTIFCSVPIIIAGIVKLLLPVPVIWRKVSRFCDFMMYCWCEGLAVLLHLNPHLQWEVHGLEGLSKKNWYLLICNHRSWADIVVLCVLFRKHIPMNKYFLKQQLAWVPFLGLACWALDMPFMKRYSRAYLLRHPERRGKDVETTRRSCEKFRLHPTTIVNFVEGSRFTQEKHQQTHSSFQNLLPPKAAGIAMALNVLGKQFDKLLNVTLCYPDNNRQPFFDMLSGKLTRIVVHVDLQPIADELHGDYINDKSFKRHFQQWLNSLWQEKDRLLTSLMSSQRQEK

SEQ ID NO: 8931 - DNA, 2787 bp, Escherichia coli
atggttcagatcccccaaaatccacttatccttgtagatggttcatcttatctttatcgcgcatatcacgcgtttcccccgctgactaacagcgcaggcgagccgaccggtgcgatgtatggtgtcctcaacatgctgcgcagtctgatcatgcaatataaaccgacgcatgcagcggtggtctttgacgccaagggaaaaacctttcgtgatgaactgtttgaacattacaaatcacatcgcccgccaatgccggacgatctgcgagcacaaatcgaacctctgcacgcgatggttaaagcgatgggactgccgctgctggcggtttctggcgtagaagcggacgacgttattggtactctggcgcgcgaagccgaaaaaaccgggcgtccggtgctgatcagcactggcgataaagatatggcgcagctggtgacaccaaatatcacgcttatcaacaccatgacgaataccatcctcggaccggaagaggtggtgaataagtacggcgtgccgccagaactgatcatcgatttcttggcgctgatgggtgactcctctgataacattcctggcgtaccgggcgtcggtgaaaaaaccgcgcaggcattgctgcaaggtcttggcgggctggatacgctgtatgccgagccagaaaaaattgctgggttgagcttccgtggcgcgaaaacaatggcagcgaagctcgagcaaaacaaagaagttgcttatctctcataccagctggcgacgattaaaaccgacgttgaactggagctgacctgtgaacaactggaagtgcagccaccggcggcggaagagttgttagggctgttcaaaaagtatgagttcaaacgctggactgctgatgtcgaagcgggcaaatggctacaggctaaaggggcgaaacccgcagccaggccgcaggaaaccagtgttgcagacgaagcgccagaagtgacggcaacggtgatttcttatgacaactacgtcactatccttgatgaagaaacactgaaagagtggattgcgaagctggaaaaagcgccggtatttgcatttgataccgaaacagacagccttgataacatctctgctaacctggtcgggctttcttttgctatcgagccaggcgtagcggcatatattccggttgctcatgattatcttgatgcgcccgatcaaatctctcgcgagcgtgcactcgagttgctaaaaccgctgctggaagatgaaaaggcgctgaaggtcgggcaaaacctgaaatacgatcgcggtattctggcgaactacggcattgaactacgtgggattgcgtttgataccatgctggagtcctacattctcaatagcgttgccggacgtcacgatatggacagcctcgcggaacgttggttgaagcacaaaaccatcacttttgaagagattgcgggtaaaggcaaaaatcaactgacctttaaccagattgccctcgaagaggccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgaagctgaaatcgacctacaccgacaagctgccgttgatgatcaacccgaaaaccgggcgtgtacatacctcttatcaccaggcagtaaccgcaacgggacgtttatcgtcaaccgatcctaacctgcaaaacattccggtgcgtaacgaagaaggtcgccgtatccgccaggcgtttattgcgccagaggattatgtgattgtctcagcggactactcgcagattgaactgcgcattatggcgcatctctcgcgtgacaaaggcttgctgaccgcattcgccgaaggaaaagatatccaccgtgcaacggcggcagaagtgtttggtttgccactggaaaccgtcaccagcgagcaacgtcgtagcgcgaaagcgatcaactttggtctgatttatggcatgagtgctttcggtctggcgcggcaattgaacattccgcgtaaagaagcgcagaagtacatggacctttacttcgaacgctaccctggcgtgctggagtatatggaacgcacccgtgctcaggcgaaagagcagggctacgttgaaacgctggacggacgccgtctgtatctgccggatatcaaatccagcaatggtgctcgtcgtgcagcggctgaacgtgcagccattaacgcgccaatgcagggaaccgccgccgacattatcaaacgggcgatgattgccgttgatgcgtggctacaggctgagcaaccgcgtgtgcgtatgatcatgcaggtacacgatgaactggtatttgaagtccataaagatgatgtcgatgccgtcgcgaagcagattcatcaactgatggaaaactgtacccgtctggatgtgccgttgctggtggaagtggggcgtggcgaaaactgggatcaggcgcactaa

SEQ ID NO: 8932 - protein, 928 aa, Escherichia coli
MVQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKTGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQPPAAEELLGLFKKYEFKRWTADVEAGKWLQAKGAKPAARPQETSVADEAPEVTATVISYDNYVTILDEETLKEWIAKLEKAPVFAFDTETDSLDNISANLVGLSFAIEPGVAAYIPVAHDYLDAPDQISRERALELLKPLLEDEKALKVGQNLKYDRGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQIELRIMAHLSRDKGLLTAFAEGKDIHRATAAEVFGLPLETVTSEQRRSAKAINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGRGENWDQAH

SEQ ID NO: 8933 - DNA, 633 bp, Escherichia coli
ttgactaatttgaattatcaacagacgcattttgtgatgagtgcgcctgatattcgccacctaccttccgataccggaattgaagtggcttttgcaggccgttccaacgcaggtaaatccagcgcgctgaacacgctgactaaccagaaaagcctggctcgtacctcaaaaaccccggggcgcacccagcttatcaacctgtttgaagtggctgacggcaagcgtctggttgacttgcctgggtacggttatgcggaagtcccggaagagatgaagcgcaaatggcagcgcgcgctcggcgagtacctcgaaaaacgtcagagcctgcaaggtctggtggtgctaatggatattcgccatccgctgaaagatttggatcagcagatgattgagtgggcggtagacagcaatatcgccgtgctggtactgctgaccaaagcggacaaactggcaagcggcgcacgtaaagcgcaattgaatatggtgcgtgaagcggtgctggcgtttaacggtgatgtgcaggttgaaacgttttcttcgctgaagaaacaaggcgtggacaagctgcggcagaaactggatacctggtttagcgagatgcagcctgtagaagaaacgcaggacggcgaataa

SEQ ID NO: 8934 - protein, 210 aa, Escherichia coli
MTNLNYQQTHFVMSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKAQLNMVREAVLAFNGDVQVETFSSLKKQGVDKLRQKLDTWFSEMQPVEETQDGE

SEQ ID NO: 8935 - DNA, 573 bp, Escherichia coli
ttgctttctgttagattccgccgcaaatctatactgaataaaacggctaaaagacgaaccattatgaaaccatcatcttcaaactcacgcagcaaaggtcatgcaaaagcgcgtcgaaaaacacgcgaggagctggatcaggaagctcgtgaccgtaagcgtcagaaaaaacgtcgtggtcatgcgccgggcagccgcgcagcgggcggtaacaccacgtcaggcagcaaaggccagaacgcaccaaaagatccacgtattggcagtaaaacccctattccattgggcgtggctgaaaaagtcaccaaacagcacaaaccgaagagtgagaaacctatgctttcaccgcaggcggagttggagttactggaaacggatgagcgtctggatgcgctgctggaacgtctggaagcaggcgaaaccctgagcgccgaagagcaatcctgggtggatgtcaaactggatcgtattgatgagttgatgcagaaactcggcctctcttatgacgatgacgaagaagaggaagaagacgagaagcaagaagacatgatgcgtctgctgcggggcaactaa

SEQ ID NO: 8936 - protein, 190 aa, Escherichia coli
MLSVRFRRKSILNKTAKRRTIMKPSSSNSRSKGHAKARRKTREELDQEARDRKRQKKRRGHAPGSRAAGGNTTSGSKGQNAPKDPRIGSKTPIPLGVAEKVTKQHKPKSEKPMLSPQAELELLETDERLDALLERLEAGETLSAEEQSWVDVKLDRIDELMQKLGLSYDDDEEEEEDEKQEDMMRLLRGN

SEQ ID NO: 8937 - DNA, 117 bp, Escherichia coli
atgctcactccttccgatggcgtctctggcggctacggcgtaccggcggatgcccgtttcgagtcatcagccggttgcgcagccacttttgtcgccgcgacaaccgctgtagtttaa

SEQ ID NO: 8938 - protein, 38 aa, Escherichia coli
MLTPSDGVSGGYGVPADARFESSAGCAATFVAATTAVV

SEQ ID NO: 8939 - DNA, 1374 bp, Escherichia coli
atgtctgtacagcaaatcgactgggatctggccctgatccagaaatataactattccgggccacgatacacctcgtacccgaccgcgctggagttttcagaagacttcggcgaacaggcgtttttacaagccgtggcgcgctatcctgagcgtccattatctctctacgtacatattccgttctgccataagctttgttacttctgcggttgcaataagattgttactcgccagcagcacaaggccgatcagtatctggacgcgctggagcaagaaatcgtccatcgtgcaccgctgttcgccgggcgtcacgtcagccaattgcactggggcggcggaacgccgacgtatctgaataaagcgcaaatcagccgtctgatgaagctgctgcgcgaaaacttccagttcaatgccgatgcggagatctcgatcgaagtcgatccgcgggaaatcgaactggatgtactcgatcatttacgcgccgaaggctttaatcggctgagcatgggcgtgcaggacttcaacaaagaagtgcaacgtctggttaaccgcgagcaggatgaagagttcatctttgcactgcttaaccatgcgcgtgagattggctttacctccaccaacatcgacctgatttacggcctgccgaaacagacgccggagagtttcgcctttaccctgaagcgtgtggcggaactgaaccctgaccgtctgagcgtctttaactacgcgcatctgccaactatttttgccgcccagcgcaaaatcaaagatgctgacttgccgagtccgcaacaaaaactcgatattctgcaggaaaccatcgccttcctgacacaatcgggctatcagtttatcggtatggatcactttgctcgcccggatgacgagctggcggtggcccagcgtgaaggcgtgctgcatcgtaacttccagggctacaccactcagggcgataccgatctgctggggatgggcgtttccgccatcagcatgattggcgactgctacgcgcagaaccagaaagagttgaagcagtactatcagcaagtggatgaacaaggcaatgcgctgtggcgtggtattgcgctaacgcgtgatgactgtattcgccgcgatgtgattaagtcgctcatctgcaacttccgtctggattacgcccctattgagcaacagtgggatttgctcttcgctgattactttgcggaagatctcaagctgctcgccccgttagcaaaagatgggctggtggatgtggatgagaagggaatacaggtgacggcgaaaggtcgcttgctgatccgcaacatttgcatgtgctttgatacctatctgcgccagaaagcgcggatgcagcagttctctcgggtgatttaa

SEQ ID NO: 8940 - protein, 457 aa, Escherichia coli
MSVQQIDWDLALIQKYNYSGPRYTSYPTALEFSEDFGEQAFLQAVARYPERPLSLYVHIPFCHKLCYFCGCNKIVTRQQHKADQYLDALEQEIVHRAPLFAGRHVSQLHWGGGTPTYLNKAQISRLMKLLRENFQFNADAEISIEVDPREIELDVLDHLRAEGFNRLSMGVQDFNKEVQRLVNREQDEEFIFALLNHAREIGFTSTNIDLIYGLPKQTPESFAFTLKRVAELNPDRLSVFNYAHLPTIFAAQRKIKDADLPSPQQKLDILQETIAFLTQSGYQFIGMDHFARPDDELAVAQREGVLHRNFQGYTTQGDTDLLGMGVSAISMIGDCYAQNQKELKQYYQQVDEQGNALWRGIALTRDDCIRRDVIKSLICNFRLDYAPIEQQWDLLFADYFAEDLKLLAPLAKDGLVDVDEKGIQVTAKGRLLIRNICMCFDTYLRQKARMQQFSRVI

SEQ ID NO: 8941 - DNA, 111 bp, Escherichia coli
atgctggaatcaataattaatctggtatcgagtggcgcagttgacagccacacaccgcaaactgctgttgctgccgtgctgtgtgccgcgatgatagggctgtttagctga

SEQ ID NO: 8942 - protein, 36 aa, Escherichia coli
MLESIINLVSSGAVDSHTPQTAVAAVLCAAMIGLFS

SEQ ID NO: 8943 - DNA, 1410 bp, Escherichia coli
atgcaacgagggatagtctgggtagtcgatgacgatagttccatccgttgggtgcttgaacgtgcgctcgctggagcgggtttaacctgtacgacatttgagaacggcgcggaagtactggaggcgctggcgagcaaaacgccggatgtgctgctttcagatatccgtatgccgggaatggacgggctggcgctgctcaagcagattaaacagcgccatccgatgcttccggtcatcattatgaccgcacattccgatctggatgctgccgtcagcgcctatcaacaaggggcatttgattatctgcccaaaccgtttgatatcgacgaagccgtggcgctggttgagcgcgccatcagtcattaccaggaacagcagcagccgcgtaatgttcagcttaacggcccaacgaccgatatcatcggtgaagcgccagccatgcaggacgtgttccggattatcggtcggctttcgcgttcttctattagcgtgctgattaacggcgagtccggcaccggtaaagaactggtcgctcatgcccttcatcgccacagtccgcgagccaaagcgccatttatcgcgctgaatatggcggctatcccgaaggatttgatcgaatccgaactgtttggtcacgagaaaggcgcatttaccggcgcgaataccattcgtcaggggcgttttgaacaagctgatggcggtacattatttctcgatgaaattggcgatatgccgctggatgtgcagacgcgtttgctgcgcgtgctggcagatggtcagttttatcgcgttggcggctatgcgccggtgaaagtggatgtgcggattatcgctgccactcaccagaatcttgaacagcgggtgcaggaaggcaagttccgtgaggatctgttccaccgcctgaacgtcatccgcgttcatctgccgccactgcgcgaacgtcgggaagatattccccgtctggcacgccattttttacaggttgccgcgcgagagctgggcgtagaagcgaagttgctgcatccggaaaccgaagccgcgctgacgcgtctggcgtggccaggcaacgtgcgccagctggaaaacacctgtcgctggctaacggtgatggctgccggacaggaagtgttgattcaggatttgcctggcgaactgtttgaatcaaacgtaccggaaagcacttcacacatgcagccggacagttgggcaacgctgttagcacagtgggcagacagagcgctgcgttccggtcatcaaaacctgctttccgaagcacagccagagctggaacggacgttactgaccaccgcgctgcgacatacgcaggggcataaacaggaagcggcgcggctacttggctggggccgcaacaccctgacgcgtaagttaaaagagctggggatggagtga

SEQ ID NO: 8944 - protein, 469 aa, Escherichia coli
MQRGIVWVVDDDSSIRWVLERALAGAGLTCTTFENGAEVLEALASKTPDVLLSDIRMPGMDGLALLKQIKQRHPMLPVIIMTAHSDLDAAVSAYQQGAFDYLPKPFDIDEAVALVERAISHYQEQQQPRNVQLNGPTTDIIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLEQRVQEGKFREDLFHRLNVIRVHLPPLRERREDIPRLARHFLQVAARELGVEAKLLHPETEAALTRLAWPGNVRQLENTCRWLTVMAAGQEVLIQDLPGELFESNVPESTSHMQPDSWATLLAQWADRALRSGHQNLLSEAQPELERTLLTTALRHTQGHKQEAARLLGWGRNTLTRKLKELGME

SEQ ID NO: 8945 - DNA, 1050 bp, Escherichia coli
atggcaacaggcacgcagcccgatgctgggcagatcctcaactcgctgattaacagtattttgttaatcgatgacaatctggcgatccattacgccaaccccgccgcgcaacaactgctcgcccaaagctcccgcaaattgtttggtacgccgttaccggaactgttgagctacttctcattaaatatcgagctgatgcaagaaagtctggaggcggggcaaggttttaccgataacgaagtgacgctggtcatcgacgggcgctcgcatatcctttctgtgacggctcagcgtatgccggacggcatgatcctgctggagatggcaccgatggataaccagcgccgcttaagtcaggaacagctacagcacgcccagcaggttgctgcccgtgatttagtgcgcggcctggcgcatgagattaaaaatccgcttggcggtttacgtggcgcggcgcagctactcagcaaggcattacctgacccgtcactactcgaatataccaaagtgattatcgaacaggcggaccggctgcgaaatctggtcgaccgtctgttggggccgcagctgcccggtacgcgtattaccgaaagtattcacaaagtggctgaacgcgtggtgacgctggtgtcgatggaactgccgaacaacgtgcggttgattcgggattacgaccccagcctgccggaactggcgcacgacccggatcaaattgaacaggtcttgctgaatattgtgcgcaatgcgctacaggcgctggggccggagggtggtgaaatcattctgcgtacccgcacagcgtttcaactgaccttacacggcgagcgctatcggctggcggcgcggattgatgtggaagataacgggccgggcattccgcctcatttgcaggatacgctgttttacccgatggtcagcggccgcgaaggtggcaccgggcttggcttatccatcgcccgtaatttgattgatcagcattcaggcaaaattgaatttaccagttggccaggtcataccgagttctcggtttacctgcctatcaggaaataa

SEQ ID NO: 8946 - protein, 349 aa, Escherichia coli
MATGTQPDAGQILNSLINSILLIDDNLAIHYANPAAQQLLAQSSRKLFGTPLPELLSYFSLNIELMQESLEAGQGFTDNEVTLVIDGRSHILSVTAQRMPDGMILLEMAPMDNQRRLSQEQLQHAQQVAARDLVRGLAHEIKNPLGGLRGAAQLLSKALPDPSLLEYTKVIIEQADRLRNLVDRLLGPQLPGTRITESIHKVAERVVTLVSMELPNNVRLIRDYDPSLPELAHDPDQIEQVLLNIVRNALQALGPEGGEIILRTRTAFQLTLHGERYRLAARIDVEDNGPGIPPHLQDTLFYPMVSGREGGTGLGLSIARNLIDQHSGKIEFTSWPGHTEFSVYLPIRK

SEQ ID NO: 8947 - DNA, 1410 bp, Escherichia coli
atgtccgctgaacacgtactgacgatgctgaacgagcacgaagtgaagtttgttgatttgcgcttcaccgataccaaaggtaaagaacagcacgtcactatccctgctcatcaggtgaatgccgaattcttcgaagaaggcaaaatgtttgacggctcctcgattggcggctggaaaggcattaacgaatccgatatggtgctgatgccagacgcatccaccgcagtgattgatccgttcttcgccgattctaccctgattatccgttgcgacatccttgaacctggcaccctgcaaggctatgaccgtgacccgcgctctattgcgaagcgcgctgaagattacctgcgttccactggcattgccgacaccgtactgttcgggccagaacctgaattcttcctgttcgatgacatccgtttcggatcgtctatctccggttcccacgttgctatcgacgatatcgaaggtgcatggaattcctccacccaatatgaaggtggtaacaaaggtcaccgtccggcagtgaaaggcggttacttcccggttccgccggtagactcagctcaggatattcgttctgaaatgtgtctggtgatggaacagatgggtctggtagttgaagctcatcaccacgaagtcgctaccgcaggtcagaacgaagtggctacccgcttcaataccatgaccaaaaaagctgacgaaattcagatctacaaatatgtcgtgcacaacgtggcgcaccgtttcggtaagaccgcgacctttatgccaaaaccgatgttcggtgataacggttccggtatgcactgccacatgtcgctgtctaaaaacggcgttaacctgtttgctggcgacaaatacgcaggtctgtctgaacaggcgctgtactacattggcggcgtaatcaaacacgcgaaagcgattaacgccctggcaaacccgaccaccaactcttacaagcgtctggtcccgggctacgaagcaccggtgatgctggcttactctgcgcgtaaccgttctgcgtctatccgtattccggtggtttcttctccgaaagcacgtcgtatcgaagtacgtttcccggacccggcggctaacccgtacctgtgctttgctgccctgctgatggccggtcttgatggcatcaagaacaagatccatccgggcgaagccatggacaaaaacctgtatgacctgccgccagaagaagcgaaagagatcccacaggttgcaggctctctggaagaagcactgaacgaactggatctggaccgcgagttcctgaaagctggtggcgtgttcacggatgaagcgatcgatgcgtacatcgctctgcgtcgcgaagaagatgaccgcgtgcgtatgactccgcatccggtagagtttgagctgtactacagcgtctaa

SEQ ID NO: 8948 - protein, 469 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 8949 - DNA, 1824 bp, Escherichia coli
gtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtaccaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggttactatcatcgatagcgaaggcaaaacccgcaacgcgaaagtcggtaaagtgctgggccacctcggtctggaacgtatcgaaaccgatctggcggaagctggcgatatcgtggcgatcacgggcctgggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaagttatcttccgtgaaatcgacggtcgtaaacaagagccgtatgaaaacgtgactctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtacgggtctgctgtactccaccttcagccactacgacgacgtacgtccgggtgaagtgggtcagcgtcagaacggtgtactgatctctaacggtcagggtaaagcggttgcgttcgcgctgttcggtctgcaggaccgtggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgactccaacctctatccgtattcgtaaacgtcacctgacggaaaacgatcgtcgtcgcgctaaccgcgcaccgaaagacgattaa

SEQ ID NO: 8950 - protein, 607 aa, Escherichia coli
MIEKLRNIAIIAHVDHGKTTLVDKLLQQSGTFDSRAETQERVMDSNDLEKERGITILAKNTAIKWNDYRINIVDTPGHADFGGEVERVMSMVDSVLLVVDAFDGPMPQTRFVTKKAFAYGLKPIVVINKVDRPGARPDWVVDQVFDLFVNLDATDEQLDFPIVYASALNGIAGLDHEDMAEDMTPLYQAIVDHVPAPDVDLDGPFQMQISQLDYNSYVGVIGIGRIKRGKVKPNQQVTIIDSEGKTRNAKVGKVLGHLGLERIETDLAEAGDIVAITGLGELNISDTVCDTQNVEALPALSVDEPTVSMFFCVNTSPFCGKEGKFVTSRQILDRLNKELVHNVALRVEETEDADAFRVSGRGELHLSVLIENMRREGFELAVSRPKVIFREIDGRKQEPYENVTLDVEEQHQGSVMQALGERKGDLKNMNPDGKGRVRLDYVIPSRGLIGFRSEFMTMTSGTGLLYSTFSHYDDVRPGEVGQRQNGVLISNGQGKAVAFALFGLQDRGKLFLGHGAEVYEGQIIGIHSRSNDLTVNCLTGKKLTNMRASGTDEAVVLVPPIRMTLEQALEFIDDDELVEVTPTSIRIRKRHLTENDRRRANRAPKDD

SEQ ID NO: 8951 - DNA, 120 bp, Escherichia coli
ttgccgagcaagaagtatcctgaaattgaaacttcggaaaatccgctgggaatttcagcggattttgttttccataagccaaaaaaaacctgccagcgatggcaggttttttataactaa

SEQ ID NO: 8952 - protein, 39 aa, Escherichia coli
MPSKKYPEIETSENPLGISADFVFHKPKKTCQRWQVFYN

SEQ ID NO: 8953 - DNA, 789 bp, Escherichia coli
atgagtatcatcgaagtgacaggtaatccacgccatgaccaactcgttcatctaatcgcagaacgcggttatatgaatattgaagaactggcacaactgctggatgtttcaacgcaaaccgtgcgccgggatatccgaaaactcagtgagcagggcttgatcacccgtcatcatggaggggccgggcgcgtctccagcgtcatgaataccgcttttgagcaacgggaactttcgctcaccgccgagaaacgggcgatcgctgaggcagtcgccgattaccttcccgaacgctgtaccgtctttatcaccatcggtacaaccgtagaagccgttgccagggcattactcaaccggcgtgatttacgcattatcactaatagcctgcgtgtggcacagattctttataagaatcaggatattgaagtgatggtgccgggaggcactttacgcgctcataacggtgggattatcggcccaggagccgtggattttattgaaggcttccgcgcagattatttaatcaccagtataggtgccattgagcatgacggcaccctgctggaatttgatgtcaatgaagcgttagtcgcgagaacgatgattaaacatgcgcggaatacattgttagtggccgatcatacgaagtttgccgcgtctgctgccgtttcaattggcaatgcacggaatgtcagggctttttttactgatgccccgcctcccaattctttctgccagttgttaagtgaagagaatgttgaactggtggttgccgagcaagaagtatcctga

SEQ ID NO: 8954 - protein, 262 aa, Escherichia coli
MSIIEVTGNPRHDQLVHLIAERGYMNIEELAQLLDVSTQTVRRDIRKLSEQGLITRHHGGAGRVSSVMNTAFEQRELSLTAEKRAIAEAVADYLPERCTVFITIGTTVEAVARALLNRRDLRIITNSLRVAQILYKNQDIEVMVPGGTLRAHNGGIIGPGAVDFIEGFRADYLITSIGAIEHDGTLLEFDVNEALVARTMIKHARNTLLVADHTKFAASAAVSIGNARNVRAFFTDAPPPNSFCQLLSEENVELVVAEQEVS

SEQ ID NO: 8955 - DNA, 948 bp, Escherichia coli
gtgtcatttaaattgaccaaagacgacaaaattaaacaggacaagacaaatatgaccagaattgcatgcgtgggtatcacagttcaggacagaatttattctttgcccactctgccggagggtggcgggaaatatcaggcaaatcattatcttgagattggtggcggcccggcagcaacagccgctgttgcaatcgcaaagcttggcgtggaggttgatttcatcggtcgcgtcggcgatgacagttgtggaaataccttacttgcagaacttgagggttggggcgtcaataccgcattttgccgccgatatcctcacgcccgttcgtcgcaatcagcgatcctcgttgatcagcatggcgaacggattatcgttaattatccaagtcctgatctcggtactgatgccgaatggttagaagcgatcgatttctctcgttatgatctgattctggccgatgttcgctggcatagcggtactgaaaaagcattctcgctagcgcgccttgcgggtgtgacaacgcttttagacgccgatatgacaccgcaggatatttctccacttgtcgcgcttgccgatcacgccgtgttctcaacaccagggctgaaacgcatgactggcctgcagtcacctgaagaaggtttgttccaggcaacgacacaaacagcaggtaaagtgtatgttacgctgggttctgaaggatcgttgtggattgaagatggtcatttgtgtcaacaggaggcattttctgtcaatgtggttgataccactggagcaggcgatgtttttcacggcgcactcgcggtagcgttggcagaaaaaatgccaacaaaagaggctattcgttttgccagtgcggttgccgcgatgaaatgtacccagcctggcggtcgggccggcattcctaatcgtgagcaaaccgaatcatttttgtcactttatgcgtaa

SEQ ID NO: 8956 - protein, 315 aa, Escherichia coli
MSFKLTKDDKIKQDKTNMTRIACVGITVQDRIYSLPTLPEGGGKYQANHYLEIGGGPAATAAVAIAKLGVEVDFIGRVGDDSCGNTLLAELEGWGVNTAFCRRYPHARSSQSAILVDQHGERIIVNYPSPDLGTDAEWLEAIDFSRYDLILADVRWHSGTEKAFSLARLAGVTTLLDADMTPQDISPLVALADHAVFSTPGLKRMTGLQSPEEGLFQATTQTAGKVYVTLGSEGSLWIEDGHLCQQEAFSVNVVDTTGAGDVFHGALAVALAEKMPTKEAIRFASAVAAMKCTQPGGRAGIPNREQTESFLSLYA

SEQ ID NO: 8957 - DNA, 879 bp, Escherichia coli
atggcaaccattgcatttctcgggctggggcagatgggtagcccaatggctaacaatctattgcaaaaagggcattcattacaggtatttgatgtcaatacacaggccgtcgatgcgctagttacgcagggggccactgcggcacaaaccccagcggaagcggcagcaagcgctgaatttatcatcactatgcttcccaatggggacattgttcgacaggtgctgttgggggaaaaaggcgtctgtgaaactgtttcatctgacgcgttagtgattgatatgtcgactattcatcccttacagaccgatgcattaatacgggaattacaagaaaaaggcatcaatatgatggacgcccccgtgggcagaacgtcagtgaatgcgattgatggcacattgctgattttagcgggcggcactgatgagcagattgcgcgtgcacgcccgattctcatgtgcatgggtaatgagctggtcgaggctggtggcccaggaatggggatccgcgtgaagctaattaacaactatatgagcattgcgcttaatgcgctgtcctccgaagccgctgtgttatgtgagtcactgggattaaatcttgatgtcgcaattaaggtgatgagtggtacggcagcagggaaaggacattttacgaccacctggcctggcaaagtgctgaaaggcgatctttctcccgccttcatggtggacctggcattgaaagatctgcgtattgcagttgacgtcgctcggaaaacgggggcgccgctcaatatggggattgcagcagaaagttattacgccgcagcaagtcaagacggcaaagggcggcaggactggagcgccctgctaaatcaggttcgccagcaggctggtctttaa

SEQ ID NO: 8958 - protein, 292 aa, Escherichia coli
MATIAFLGLGQMGSPMANNLLQKGHSLQVFDVNTQAVDALVTQGATAAQTPAEAAASAEFIITMLPNGDIVRQVLLGEKGVCETVSSDALVIDMSTIHPLQTDALIRELQEKGINMMDAPVGRTSVNAIDGTLLILAGGTDEQIARARPILMCMGNELVEAGGPGMGIRVKLINNYMSIALNALSSEAAVLCESLGLNLDVAIKVMSGTAAGKGHFTTTWPGKVLKGDLSPAFMVDLALKDLRIAVDVARKTGAPLNMGIAAESYYAAASQDGKGRQDWSALLNQVRQQAGL

SEQ ID NO: 8959 - DNA, 888 bp, Escherichia coli
atgtcatcccacttcaccccatttacgctgaaagatatctcccgcccaggtggtggattcgccatgttagctgtcgatcagcgtgaggccatgcgcctgatgtttgcggcagcagggcagccaaaacccatcgccgacagtgtactcaccgattttaaagttgccgcgacccgaatcctttctccttatgcttctgccgttctggcggataaacaattttgtcttgaacaaatagtcgagcagggcgctgtggctaattcttgcggcctgattgtcgctgccgatctttttatcccaggtaatggcatcccggttgatagcgttgaaatagatatgtccgtcgacccgcataaagcccgtgaaatgggggctaaggcaatgaaattacttgtactctggcgtgaagatgaacccgcagaggaacgtctggcaatggttgataaatttgttcgtcgctgccgtagtgccgggctggttagcattattgaacctgtggtgcgtccacctcgtcgcggttgggactttgatcgtgaaagcgccattgttgccgccgccgcagagcttggtggaacagaggctgatctttacaaagccgagatgccattagggggcaaaggcgatgaaaaaaccttacttgctgcctgtcagcaacttaacgatcagatgaagatgccgtgggtaattctttcttctggcgttgatgccgatatttttggccgtgcagtaagtattgccatgaaaggtggtgcgtcgggcttcctggctggacgagcggtttgggcgtcggttgttggtgcacaagatccacaaaccatgctgcgcgatgtctccgttccacgcttgcaacggctggctgaaattgtcgatgaaggtatcgcgcaacgctaa

SEQ ID NO: 8960 - protein, 295 aa, Escherichia coli
MSSHFTPFTLKDISRPGGGFAMLAVDQREAMRLMFAAAGQPKPIADSVLTDFKVAATRILSPYASAVLADKQFCLEQIVEQGAVANSCGLIVAADLFIPGNGIPVDSVEIDMSVDPHKAREMGAKAMKLLVLWREDEPAEERLAMVDKFVRRCRSAGLVSIIEPVVRPPRRGWDFDRESAIVAAAAELGGTEADLYKAEMPLGGKGDEKTLLAACQQLNDQMKMPWVILSSGVDADIFGRAVSIAMKGGASGFLAGRAVWASVVGAQDPQTMLRDVSVPRLQRLAEIVDEGIAQR

SEQ ID NO: 8961 - DNA, 1011 bp, Escherichia coli
atggataaaattacccaggttttattttcagatattgggaaagtcaccactcaatatgttgaagtaccacaccagcaacttaaaccgcacgaagtacggattgcgcccgtgttctacgggatatgcggttcggatctgcatgttctgaaaggcggtcatccgtttgccaaaccgcctgtcgtccccggtcatgaaattgcagcgcgcgttacggaagtgggcagcgacgttaaaaatgtacagccgggtgatcatgttgtggtcgatcccatcatggcttgcatggaatgccgagcctgcaaagcaggacgttttaatctttgtgaaccaccgcaggttgctggttttcgcgcaccgggctttgctcgctcacaacacattgttcctgcgcgtaattgccatgtcgcaccagcctctttaccgctaaaagtgttggcctttgccgaaccggcggcttgtgctcgtcactgcgttaaccgaatgccgaaagcttctctggaaagcgtactggtgattggtgccggaacgataggcttatccatcgtgcaggcactgcgcattatgggggcaggtaagattaccgtgattgaacctgacgctgccaaacgcgcgctggcgttaaaactgggcgcagcagaagtttgggcaccaggtgagctggccgcagatgtgcgatttacgggggcgattgatgtcgttgcagcgcaggccacgcttaacgatgcatgtacccgtgtatatgccggaggcaccgtcgtgtgcatgggcgtaccaagtgggccgcgtgaaataccattaccgatgatgcaacgtttcgagcgtgacttgctcaactctggcatgtacatccctgaagatttcgatgctgttatcgaatggctggcggatgggcggtttgataccagtgaactggttaccgatttatttgccattgaggatgcagcggcggcattcgaacgcgcgcagcaaaatgactccataaaggtcatgctgcaatttgcgccggaatga

SEQ ID NO: 8962 - protein, 336 aa, Escherichia coli
MDKITQVLFSDIGKVTTQYVEVPHQQLKPHEVRIAPVFYGICGSDLHVLKGGHPFAKPPVVPGHEIAARVTEVGSDVKNVQPGDHVVVDPIMACMECRACKAGRFNLCEPPQVAGFRAPGFARSQHIVPARNCHVAPASLPLKVLAFAEPAACARHCVNRMPKASLESVLVIGAGTIGLSIVQALRIMGAGKITVIEPDAAKRALALKLGAAEVWAPGELAADVRFTGAIDVVAAQATLNDACTRVYAGGTVVCMGVPSGPREIPLPMMQRFERDLLNSGMYIPEDFDAVIEWLADGRFDTSELVTDLFAIEDAAAAFERAQQNDSIKVMLQFAPE

SEQ ID NO: 8963 - DNA, 1434 bp, Escherichia coli
atgagtcaaatcaccagtcctgcaacttattcaattagtcggccacaggacgtaattgatattgttaataagaactctgcaatcaacaccagtatcggcgttatttttattgctttgggcggcatattgattgatgcctaccaggcggcgatggtggggtttggtaataaatacattgccgctcaattcggcatttcgccgggtcttgctgcaaccgtcaatgcatcagtattaatcgccgcgttaattggcggtttattagcgaaccgagtaataaaccgctttgggcaaaagcgggcatttattattggcatggggctgtgcaccatcggtgctgcagcggtagctattgctcccagtatctggtgggtgctggtgtgccgcgtcatcatgggctttggtttaggcatcgacttccctttggcaaccaatgccgtggcagagcttcgtggttcaacgtcgaagaaaaccggcacgtcggtcaacctctggcaaatggcctggtatgtttcgacaaccgttgtttatttggtgcttttgccgctgcttctgtctggtatcgctgaagaacaattgtggcgttacggaatattcatcggagctatttttgcagtcatcttcatgattttgcgttacttctttattggtgaatccgcaatgtgggccgcacgcgtcgggcgttaccaggaagcgtgcgacattctgggaaaacgttatggtgttcaggctcacgttgcggcatcgggtacaacagaagcgaaattctcggaaaaagcagagaataaatacagtggtggatatggcatcttatttaatgatcgttaccgcaaacgcaccattcttggctgtgtcgtggcaaccatgcaggcgtggcaatataacgccgtaggtgtttatcttcctcttacgttggcgggaataataagtggcgggcttactggcgcgttaaccggttctgccgtcgtgaatgccctttgtggggtgacaggcgggatgatcggctcgtttattctccaacgactgggtactcgccgacagtcgatgtatggatttgctgttgtgaccttagcattgctgtcgttaggcgcactggcaacgactaatccctggctgtctttagggttattgggatcaattattttcttccattcagcgggtcctggtgggctgggcatgaccattgccacactctcttatcctcccgctattcgccctactggggtcggatttgcccgcgctattatgcgcacaggggcaattgcaggactcattttctggccgatgctgtggggtgcgttgaaaactgaagcgttttactggttggcaatcgtgccattcctgggattcctgacctgtgtattgattaattgggaaccactgggtgcaaatgttgatgctgaggacgcagaggttctggctgaattgaagaaataa

SEQ ID NO: 8964 - protein, 477 aa, Escherichia coli
MSQITSPATYSISRPQDVIDIVNKNSAINTSIGVIFIALGGILIDAYQAAMVGFGNKYIAAQFGISPGLAATVNASVLIAALIGGLLANRVINRFGQKRAFIIGMGLCTIGAAAVAIAPSIWWVLVCRVIMGFGLGIDFPLATNAVAELRGSTSKKTGTSVNLWQMAWYVSTTVVYLVLLPLLLSGIAEEQLWRYGIFIGAIFAVIFMILRYFFIGESAMWAARVGRYQEACDILGKRYGVQAHVAASGTTEAKFSEKAENKYSGGYGILFNDRYRKRTILGCVVATMQAWQYNAVGVYLPLTLAGIISGGLTGALTGSAVVNALCGVTGGMIGSFILQRLGTRRQSMYGFAVVTLALLSLGALATTNPWLSLGLLGSIIFFHSAGPGGLGMTIATLSYPPAIRPTGVGFARAIMRTGAIAGLIFWPMLWGALKTEAFYWLAIVPFLGFLTCVLINWEPLGANVDAEDAEVLAELKK

SEQ ID NO: 8965 - DNA, 1350 bp, Escherichia coli
atgtctgaaaagttacccgcaccgcgtgaagggctttccggtaaagccatgagacgtgtcgttatgggcagtttcgcaggcgcgttaatggaatggtatgacttctttatttttggcacggcagcaggactggtatttgcaccgctgttttatccagacagcgatccttttataggtcttatagcttcctttgcgacctttggtgttggttttctgactcgtcctttaggtggcatcgtctttggtcattttggcgataaaatcgggcgaaaaataacacttatctggacgctggctattgtcggttgctccacatttttgattggttttattccgacgtatcaggaaattggcatttgggcaccgcttgtattaatggtgctgcgtttgattcagggctttggtcttggtggcgagtacggcggagcggcattgatgaccatagaatcagcgcccgaatcccgacgcggatttttaggttcactcccgcaaacggctgcgtctgtgggtattatgctggcaaccggtatttttgctctctgtaaccattttcttacttcggagcagtttctctcctggggatggcgcattccgttttggctttctgcggtgatgttgatcgttgggctgtttatccgcctgcataccgaagaaacgctggattttcaaaagcaaaaaacgacgaataataaagaaaagtccgttcctccgttgattgaattattcaaaaaacatccacgaaatattttattggcactgggtgcgaggctggcggaaagtgtctcctctaatattattaacgcctttggtattgtctatatttccagccaattagcattgtcgcgagatattcccctgacgggtatgttgattgcctcggcgatcggtattttcagttgtccattggttggatggttatcagatcgtataggtcaaaaaagtctgtatttgtcgggagcaggattttgtgtcctgttcgcgtttcctttcttcttattactggatagcaaaagtacgctcatcatctggtgcagtatgatccttggctacaacttaggtccgacgatgatgtttgccgtgcagccaacacttttcacccgcatgttcggtaccaaagtacgatataccggcctttcttttgcttatcaattttccgcgattcttggcggactaagcccccttatcgcctcaagtttgctggcgctagggggaggaaaaccgtggtatgtcgctctgtttttatttgctgtctcagttctttcctttgtttgcgtctggctgattgagccaaccgatgaacaagaaaccgcttcttaccgctacatcagggaacaatctcatgaaaactga

SEQ ID NO: 8966 - protein, 449 aa, Escherichia coli
MSEKLPAPREGLSGKAMRRVVMGSFAGALMEWYDFFIFGTAAGLVFAPLFYPDSDPFIGLIASFATFGVGFLTRPLGGIVFGHFGDKIGRKITLIWTLAIVGCSTFLIGFIPTYQEIGIWAPLVLMVLRLIQGFGLGGEYGGAALMTIESAPESRRGFLGSLPQTAASVGIMLATGIFALCNHFLTSEQFLSWGWRIPFWLSAVMLIVGLFIRLHTEETLDFQKQKTTNNKEKSVPPLIELFKKHPRNILLALGARLAESVSSNIINAFGIVYISSQLALSRDIPLTGMLIASAIGIFSCPLVGWLSDRIGQKSLYLSGAGFCVLFAFPFFLLLDSKSTLIIWCSMILGYNLGPTMMFAVQPTLFTRMFGTKVRYTGLSFAYQFSAILGGLSPLIASSLLALGGGKPWYVALFLFAVSVLSFVCVWLIEPTDEQETASYRYIREQSHEN

SEQ ID NO: 8967 - DNA, 804 bp, Escherichia coli
gtgacgctggaaaaaggcaatattcacctgcagatttatccgcatgatggtgccaggataacctcgttaaaggcatttggttctgaagtattacgccaatggcagccgcagcgcagagcttttcagtatggctgtttcccaatggtgccgtgggcagggcgactggggaatgcgacgctgaatgctggtgggcaatgttattctttacccgccaataaaccaccacatgcgttgcatggtatggcttgttactcaacgtgggaaatcatcgacaaaacagcagattccctgactttacgtatgcccctggcttcaccgtggccctggcaaggggaagtgattcagacttttttgctggagaacgatgcgctggttttgcaactggaagtccattcatatgccgatacattcccggcctccgcaggctggcatccgtggtttgcgaaaaagctgactccgcaaaatacagaatcgttgcaggtgctttttgatgcggactggcaagaagaagcgggtagtgatgaactgccaactggaaatcgtatctctcctcaagttggtccctgggatgactgttttggtttttatgacggggtgaaggttaagttactgtggcctggtaaactcgcgatgaccatgacctcttctgcaaacagtctggtggtatttgataaacagcccgatgccacctgtattaacccgctgactcaggcacctaacgcaataaatctaacgccggaatttgtgacaccagataagccgctggtcatcgaaactcgttggcaatttacacctgaatcttaa

SEQ ID NO: 8968 - protein, 267 aa, Escherichia coli
MTLEKGNIHLQIYPHDGARITSLKAFGSEVLRQWQPQRRAFQYGCFPMVPWAGRLGNATLNAGGQCYSLPANKPPHALHGMACYSTWEIIDKTADSLTLRMPLASPWPWQGEVIQTFLLENDALVLQLEVHSYADTFPASAGWHPWFAKKLTPQNTESLQVLFDADWQEEAGSDELPTGNRISPQVGPWDDCFGFYDGVKVKLLWPGKLAMTMTSSANSLVVFDKQPDATCINPLTQAPNAINLTPEFVTPDKPLVIETRWQFTPES

SEQ ID NO: 8969 - DNA, 600 bp, Escherichia coli
atgctctatatctttgatttaggtaatgtgattgtcgatatcgactttaaccgtgtgctgggggcctggagcgatttaacgcgtgttccactggctacgcttaagaagagtttccacatgggcgaggcgtttcatcagcatgagcgtggggaaattagcgacgaagcgttcgcagaggcactgtgtcatgagatggccctgccgctaagctatgagcagttctcccacggttggcaggcggtatttgttgcgctacgaccggaagtgatcgccatcatgcataaactgcgtgagcaggggcatcgcgtggtggtgctttccaatactaaccgcctgcatactaccttctggccggaggaatacccggaaatccgtgatgctgctgaccatatctatctgtcgcaagacttgggtatgcgcaaacctgaagcacgaatttatcagcatgttttgcaggcagaaggtttttcaccagacgatacggtctttttcgacgataacgccgataatatagaaggagctaatcagctaggcattactagtattctggtgaaagataaaaccaccatcccggactatttcgcgaaggtgttatgctaa

SEQ ID NO: 8970 - protein, 199 aa, Escherichia coli
MLYIFDLGNVIVDIDFNRVLGAWSDLTRVPLATLKKSFHMGEAFHQHERGEISDEAFAEALCHEMALPLSYEQFSHGWQAVFVALRPEVIAIMHKLREQGHRVVVLSNTNRLHTTFWPEEYPEIRDAADHIYLSQDLGMRKPEARIYQHVLQAEGFSPDDTVFFDDNADNIEGANQLGITSILVKDKTTIPDYFAKVLC

SEQ ID NO: 8971 - DNA, 873 bp, Escherichia coli
atgctaaaaaccattcaggacaaagccaggcatcgtacccgtccactatgggcctggctaaaactactctggcaacgcattgatgaggacaacatgacaaccctggcaggtaaccttgcctatgtgtcgttgctctcattagtgccgctggttgccgttgtttttgcgcttttcgccgcttttcccatgttttccgacgtcagcattcagttgcgtcactttatttttgccaactttctgcctgctactggcgatgttatccagcgatatatcgaacagtttgtcgccaattccaacaaaatgaccgccgtcggggcgtgcgggctgatcgtcacggcgttattgttgatgtactccatcgatagcgcgttgaataccatctggcgcagtaaacgagcgcgacccaaaatttactcgtttgccgtgtactggatgattttaacgctggggccgctgttggcaggggccagtctggcgatcagctcctatctgctctctctgcgctgggcgagcgatctcaatactgtcatcgataatgtgttgcgtatttttccgctgctgttgtcgtggatctctttctggctgctgtacagcatcgttcctaccatccgtgtacctaaccgcgacgcgattgtcggcgcgtttgtcgccgcgctcctgttcgaagcaggaaagaaaggtttcgcgctttatatcaccatgttcccatcatatcagctcatttacggtgtgctggcggtgatccccattctctttgtttgggtctactggacatggtgtatcgtcttgcttggcgcggaaattactgtcactctcggggaataccgcaaattaaaacaggctgctgaacaagaagaagacgacgaaccatga

SEQ ID NO: 8972 - protein, 290 aa, Escherichia coli
MLKTIQDKARHRTRPLWAWLKLLWQRIDEDNMTTLAGNLAYVSLLSLVPLVAVVFALFAAFPMFSDVSIQLRHFIFANFLPATGDVIQRYIEQFVANSNKMTAVGACGLIVTALLLMYSIDSALNTIWRSKRARPKIYSFAVYWMILTLGPLLAGASLAISSYLLSLRWASDLNTVIDNVLRIFPLLLSWISFWLLYSIVPTIRVPNRDAIVGAFVAALLFEAGKKGFALYITMFPSYQLIYGVLAVIPILFVWVYWTWCIVLLGAEITVTLGEYRKLKQAAEQEEDDEP

SEQ ID NO: 8973 - DNA, 438 bp, Escherichia coli
atgattgcattaattcaacgcgtaacccgtgccagcgtcaccgtggagggagaagtgacgggtgaaattggcgcgggacttttggtgttattgggtgtcgaaaaggatgacgacgaacagaaagcaaaccgtctgtgcgagcgtgtgctcggctaccgcatctttagcgatgccgaaggcaagatgaatctcaacgtgcaacaggcgggcggcagtgtactggtggtttcccagtttacccttgccgcagataccgaacgggggatgcgcccaagtttctccaaaggcgcatcaccggatcgcgcggaggcgttatatgactatttcgtcgaacgctgccgtcagcaagagatgaacacgcaaacaggacgcttcgctgcggatatgcaggtatcgctggtcaatgatggccccgtgacattctggttgcaggtatga

SEQ ID NO: 8974 - protein, 145 aa, Escherichia coli
MIALIQRVTRASVTVEGEVTGEIGAGLLVLLGVEKDDDEQKANRLCERVLGYRIFSDAEGKMNLNVQQAGGSVLVVSQFTLAADTERGMRPSFSKGASPDRAEALYDYFVERCRQQEMNTQTGRFAADMQVSLVNDGPVTFWLQV

SEQ ID NO: 8975 - DNA, 990 bp, Escherichia coli
atgagccagcttccagggttgtcacgggaaacaagagagagtatcgctatgtatcaccttcgggttccacaaacagaagaagaattagagcgttactatcagtttcgctgggaaatgttgcgtaagcccctgcatcaaccaaaaggttcggaacgcgacgcgtgggatgcgatggcgcatcaccagatggtcgtcgacgagcagggtaatctggtagcggtaggccgactgtatattaatgccgacaatgaagcgtccattcgctttatggccgttcatcccgacgtgcaggacaaagggttaggcacgctgatggcgatgaccctggagtcggtggcacgtcaggaaggcgttaagcgcgtgacctgtagcgcccgtgaagacgcggtggagtttttcgccaagctggggtttgttaatcagggtgaaatcaccacgccaaccaccacgccgattcgccattttttgatgataaaacctgttgccactctggatgatattcttcatcgcggcgactggtgcgcccagctccagcaagcgtggtatgaacacatcccgctgagtgaaaaaatgggtgtgcgcattcagcaatataccgggcaaaaatttatcaccaccatgccggaaacaggcaatcagaatccgcatcacacgctgtttgccgggagtttattctcgctggcaacgctcactggttgggggcttatctggctgatgctgcgcgaacgccacctcggcggaacgattattctggcggatgcgcatatccgctatagcaaaccgattagcggaaaaccccatgcggtagccgaccttggtgccttaagtggcgatctcgaccgtctggcgcgcggacgaaaagcacgggtgcagatgcaagtagaaatctttggcgacgagacgccgggtgcagtgtttgaaggcacgtatatcgttctgcccgcgaagccatttggtccgtatgaagagggcggaaacgaagaagagtag

SEQ ID NO: 8976 - protein, 329 aa, Escherichia coli
MSQLPGLSRETRESIAMYHLRVPQTEEELERYYQFRWEMLRKPLHQPKGSERDAWDAMAHHQMVVDEQGNLVAVGRLYINADNEASIRFMAVHPDVQDKGLGTLMAMTLESVARQEGVKRVTCSAREDAVEFFAKLGFVNQGEITTPTTTPIRHFLMIKPVATLDDILHRGDWCAQLQQAWYEHIPLSEKMGVRIQQYTGQKFITTMPETGNQNPHHTLFAGSLFSLATLTGWGLIWLMLRERHLGGTIILADAHIRYSKPISGKPHAVADLGALSGDLDRLARGRKARVQMQVEIFGDETPGAVFEGTYIVLPAKPFGPYEEGGNEEE

SEQ ID NO: 8977 - DNA, 909 bp, Escherichia coli
atggcactggaaaaaggaattgcagagttagtcgaagagtttatcgctgcgggtcgcccctcatcgcgccaacaaagtattacgcagcgcagagagggctatatcgccagcgctgtccttgcgggtgagacagaaacgcgggtagatattcagactatcgaacttgaagggatgaccttacgaatagtgtcaccgctgaatgccccgacattactcccgacgataatttattactacggtggctgttttgttagcggcgggttcgcaactcacgacaaccagctgcgccagttagcctattacgggcaatgtcggattattgccgtccagtatcggctggcaccggaacatactttccccgccgcccatgatgatgcacaacgaggtgcagaattagtccggcaacacgccgaacgactcggcgttgataaacaacgaataactcttgccggtgacagtgcgggagggcatctggcgctggtaactgctttgcgattgaagcgtgctggcgagtggcaaccagcacaactcatcttaatttatcctatgcttgatgcgactgcgcatttcgaaagctacatacgcaatggtcacgattacatcatcacacgcgacactttactgagcggctttgagatgtacctgccaggcattgaacgcaggcatcctgaagccagccctatttggcgcaatgatttcaatggcttgccacctgtacatatcattaccgctgaatacgacccactttgcgatgaaggtgaagcgttgtatcaccgcatgacagggcaaggagtgcaatgcacctgccaacgctaccttggcgttatccacggattttttcagttaggtggtatcagtgaggctgcgcgatcggcgctacgggatgttgcctggagagcgggaaggtaa

SEQ ID NO: 8978 - protein, 302 aa, Escherichia coli
MALEKGIAELVEEFIAAGRPSSRQQSITQRREGYIASAVLAGETETRVDIQTIELEGMTLRIVSPLNAPTLLPTIIYYYGGCFVSGGFATHDNQLRQLAYYGQCRIIAVQYRLAPEHTFPAAHDDAQRGAELVRQHAERLGVDKQRITLAGDSAGGHLALVTALRLKRAGEWQPAQLILIYPMLDATAHFESYIRNGHDYIITRDTLLSGFEMYLPGIERRHPEASPIWRNDFNGLPPVHIITAEYDPLCDEGEALYHRMTGQGVQCTCQRYLGVIHGFFQLGGISEAARSALRDVAWRAGR

SEQ ID NO: 8979 - DNA, 291 bp, Escherichia coli
atggataaggcactttttgagcggttgactcacagcatggcccagatgaatgaaattattgaaggaacgcgacagccttcacggacttttgaagttgatgctatgaaaatcaaagaaatacgccgcgcttcagggttgtcacaatctaaatttgccgatcttatttccgtaagcgtagacacgttgcgtaactgggagcaggggcgacgttcaccgaccgggcctgcaaaggctttgctgcgagcgattgccaatgatccgcaacatgtgctgcaagcacttaaccgttag

SEQ ID NO: 8980 - protein, 96 aa, Escherichia coli
MDKALFERLTHSMAQMNEIIEGTRQPSRTFEVDAMKIKEIRRASGLSQSKFADLISVSVDTLRNWEQGRRSPTGPAKALLRAIANDPQHVLQALNR

SEQ ID NO: 8981 - DNA, 246 bp, Escherichia coli
atgagtaatatatgtaaggtggtggtaatggcgatgaatacggtttttcttcatttatcagaagaggcaattaaacggctgaacaagcttcggggatggcgtaaggtttcgcgctctgcaattttacgcgaagcggtagagcaatatctggagcggcagcaatttccggtgcgtaaggcaaaaggcggcaggcaaagggacgaggcagttggtgttgaagaactatgtaagcagcataaggaatga

SEQ ID NO: 8982 - protein, 81 aa, Escherichia coli
MSNICKVVVMAMNTVFLHLSEEAIKRLNKLRGWRKVSRSAILREAVEQYLERQQFPVRKAKGGRQRDEAVGVEELCKQHKE

SEQ ID NO: 8983 - DNA, 930 bp, Escherichia coli
atgagtattcgcataatcccgcaagatgagctgggttcgagcgagaaacgtacggcggatatgattccgccgttattgttccctcggctcaagaatttatacaaccgccgcgccgagcgtctgcgcgagctggcagaaaataatccgctgggtgattacctgcgctttgctgcgcttatcgcccacgcccaggaagtggtgctgtacgaccatccgctggagatggatctgaccacgcgcattaaagaagccagcgcacaaggcaagcccccgctggatattcacgttctgccgcgtgataagcactggcaaaagctgctgatggcgctgattgctgagctgaaacctgaaatgagcggcccggcgctggcagtgattgagaatctggagaaggcatcgactcaggagctggaagatatggccagcgcactgtttgcctctgatttctcgtccgtcagcagcgataaagcgccgtttatctgggctgcgctgtcgctctactgggcgcagatggctaatctgatccccggcaaagcccgcgctgaatacggcgaacaacgtcaatattgcccggtatgtggctctatgccggtgtccagcatggtgcaaattggcaccactcagggtctgcgttacctgcactgcaacctgtgtgaaactgaatggcacgtagtgcgcgtaaaatgcagcaactgtgaacaaagcggcaaactgcattactggtcgctggatgacgaacaggccgcgattaaagccgaaagctgcgatgactgcggcacttacctgaagattctttatcaggaaaaagaaccgaaagttgaagccgtggcagatgacctcgcctctctggtactggacgcgcgaatggagcaagaaggctatgcccgtagttccattaacccgttcctgtttccgggtgaaggggagtaa

SEQ ID NO: 8984 - protein, 309 aa, Escherichia coli
MSIRIIPQDELGSSEKRTADMIPPLLFPRLKNLYNRRAERLRELAENNPLGDYLRFAALIAHAQEVVLYDHPLEMDLTTRIKEASAQGKPPLDIHVLPRDKHWQKLLMALIAELKPEMSGPALAVIENLEKASTQELEDMASALFASDFSSVSSDKAPFIWAALSLYWAQMANLIPGKARAEYGEQRQYCPVCGSMPVSSMVQIGTTQGLRYLHCNLCETEWHVVRVKCSNCEQSGKLHYWSLDDEQAAIKAESCDDCGTYLKILYQEKEPKVEAVADDLASLVLDARMEQEGYARSSINPFLFPGEGE

SEQ ID NO: 8985 - DNA, 636 bp, Escherichia coli
atgaaacgacgtgacaccatcgtgcgctacaccgcgccggaacgtatcaaccactggatcaccgccttctgcttcatcctggcggcggtgagcgggctgggctttttgttcccgtccttcaactggttgatgcaaatcatgggcacaccgcagctggcgcgcattctgcacccgtttgtcggcgtggttatgtttgcctcgttcatcatcatgtttttccgttactggcatcacaacctaatcaatcgggatgatatcttttgggcgaagaatattcgtaagatcgtcgtcaacgaggaagtaggtgacaccgggcgttataacttcggtcagaaatgcgttttctgggcggcgattattttcctggtcctgttgctggtgagcggcgtgattatctggcgtccttattttgcgcctgctttctcaatcccggtgatccgattcgcgttaatgctgcattcatttgccgcagtggcgttaattgtggttatcatggtgcatatctacgccgccctttgggtgaaaggcacgattaccgccatggtggaaggatgggtgaccagcgcatgggcaaagaaacatcacccgcgctggtaccgtgaggtccgcaagacaacggaaaagaaagctgaatga

SEQ ID NO: 8986 - protein, 211 aa, Escherichia coli
MKRRDTIVRYTAPERINHWITAFCFILAAVSGLGFLFPSFNWLMQIMGTPQLARILHPFVGVVMFASFIIMFFRYWHHNLINRDDIFWAKNIRKIVVNEEVGDTGRYNFGQKCVFWAAIIFLVLLLVSGVIIWRPYFAPAFSIPVIRFALMLHSFAAVALIVVIMVHIYAALWVKGTITAMVEGWVTSAWAKKHHPRWYREVRKTTEKKAE

SEQ ID NO: 8987 - DNA, 903 bp, Escherichia coli
atggcttatcaatcgcaagatatcattcgtcgttccgcgactaacggtctgacccccgcgcctcaggcgcgggacttccaggaagaagtggcgaaactcatcgacgttaccacctgtatcggctgtaaagcctgtcaggtggcgtgttcagagtggaacgacattcgcgataccgtcggcaataacattggggtgtacgacaaccccaatgatttaagtgccaaatcgtggacggtgatgcgattctcggaagtggagcagaacgacaaactggaatggctgatccgcaaagacggctgtatgcactgttccgatccaggctgcctgaaagcgtgcccggcggaaggggcaattattcagtatgccaacggtatcgtcgacttccagtccgagcagtgcatcggctgcggttattgcattgcgggctgtccgttcgacattccgcgcctcaacccggaagacaaccgcgtctacaaatgtacgctgtgcgttgaccgcgtggtggttgggcaagaaccggcctgcgtgaagacctgcccaacgggcgcgattcacttcggtacgaaagagtcgatgaaaacgctggcgagcgagcgcgtggcggagctgaaaacccgtggttacgacaatgcgggtttgtacgacccggcaggcgtcggtggtacacatgttatgtacgtgctgcaccatgctgacaagccaaatctgtatcatggcttgccggagaacccggaaatcagcgaaaccgtgaaattctggaaaggcatctggaaaccgctcgcagctgttggctttgcggctaccttcgcagccagtatcttccactacgtgggtgtcggtccgaaccgtgcggatgaggaagagaataatctgcacgaagagaaagacgaggagcgcaaatga

SEQ ID NO: 8988 - protein, 300 aa, Escherichia coli
MAYQSQDIIRRSATNGLTPAPQARDFQEEVAKLIDVTTCIGCKACQVACSEWNDIRDTVGNNIGVYDNPNDLSAKSWTVMRFSEVEQNDKLEWLIRKDGCMHCSDPGCLKACPAEGAIIQYANGIVDFQSEQCIGCGYCIAGCPFDIPRLNPEDNRVYKCTLCVDRVVVGQEPACVKTCPTGAIHFGTKESMKTLASERVAELKTRGYDNAGLYDPAGVGGTHVMYVLHHADKPNLYHGLPENPEISETVKFWKGIWKPLAAVGFAATFAASIFHYVGVGPNRADEEENNLHEEKDEERK

SEQ ID NO: 8989 - DNA, 2415 bp, Escherichia coli
atgaccaaccactgggtcgacatcaagaatgccaacctcgtcgtggtgatgggcggtaacgccgctgaagctcacccggtcgggttccgctgggcgatggaagccaaaattcacaacggcgcaaagctgattgttatcgatcctcgctttacacgtacagcggcggtggctgactactatgcccctatccgttccggtactgacattgctttcctgtcaggcgtattgctgtacctgctgaacaatgaaaaattcaaccgcgaatacaccgaagcctataccaacgccagcctgatcgtgcgtgaggattacggctttgaagatggcctgttcaccggctacgacgcggaaaaacgcaagtacgataagtccacctggacttacgaactggacgaaaacggcttcgccaaacgtgatacaaccctgcaacatccacgttgcgtgtggaacttgctgaaacagcacgtttcccgttatacgccagatgtggttgaaaacatctgcggtacgccaaaagacgcgttcctgaaagtctgcgaatacatcgccgaaaccagtgctcacgataaaacagcgtcgttcctctacgccctcggctggacgcaacactccattggtgcgcaaaacattcgtacgatggcgatgatccagctgctgctcggcaacatggggatggcaggcggcggcgttaacgccctgcgcggtcactccaatattcaggggctgacggacctggggctactgtcgcagagtctgccaggttacatgacgctgccaagcgagaagcagaccgatctgcaaacttaccttaccgccaacacgccgaaaccactgctggaaggccaggttaactactggggcaactacccgaaattcttcgtctctatgatgaaggcattctttggtgataaagcgacggcggaaaatagctggggctttgactggttgccgaagtgggataaaggctacgacgtcctgcaatacttcgagatgatgaaagaaggcaaggtcaatggctatatctgccagggctttaaccctgttgcctcattcccgaacaaaaacaaagtgatcggctgtctgtcgaagctgaaattcctcgtgactatcgacccgctgaacactgaaacctctaacttctggcagaaccacggtgagctgaacgaagttgactcgtcgaagatccagaccgaagtgttccgtctaccatcgacctgcttcgcggaagagaacggttctatcgttaactcaggtcgctggttacagtggcactggaaaggtgcggacgccccggggattgcgctgactgatggcgagatcctctccggtatcttcctgcgcttgcgcaagatgtatgccgaacagggtggcgcgaacccggaccaggtgctgaacatgacctggaactacgccattccgcatgagccatcttcagaagaagtggcaatggagagcaacggcaaagcgctggccgatattaccgacccggcaaccggtgcggttatcgtcaagaaaggccaacaacttagctcgttcgcccaactgcgcgatgacggcacaacttcctgtggctgctggattttcgccggtagctggacgccggaaggcaaccagatggcgcgtcgtgataacgccgatccgtctggcctcggtaacacgctgggctgggcatgggcatggccgcttaaccgccgcattctgtataaccgcgcctccgcagatccgcagggtaacccgtgggatccgaagcgtcagttgctgaaatgggacggcactaagtggaccggctgggatattccggattacagcgcagcgcctccgggcagcggcgtagggccgtttatcatgcagcaggaaggcatgggacgtctgtttgccctcgataagatggcggaaggtccgttcccggaacactacgagccgtttgaaacgccgctgggaactaacccgctgcatccaaacgttatctcgaatccggcggcgcgtatctttaaagacgatgccgaagcattaggtaaagccgataagttcccgtatgtcggaaccacctatcgtctgaccgagcacttccactactggaccaaacacgcgctgttgaacgcgattttgcaaccagagcagtttgtggaaatcggggagtcgctggcgaataaacttggcattgcccagggcgatactgtgaaagtctcctccaaccgtggctatatcaaagccaaagcggtagtgaccaaacgtattcgcacgctgaaagcaaacggcaaagatatcgataccatcggtattcctattcactggggctatgaaggtgttgcgaaaaaaggctttattgccaatacgttgacgccattcgtcggtgatgcgaacacgcagacgccggagtttaagtccttccttgtgaatgtggaaaaggtgtaa

SEQ ID NO: 8990 - protein, 804 aa, Escherichia coli
MTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSTWTYELDENGFAKRDTTLQHPRCVWNLLKQHVSRYTPDVVENICGTPKDAFLKVCEYIAETSAHDKTASFLYALGWTQHSIGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 8991 - DNA, 588 bp, Escherichia coli
atgcaggtcagcagaaggcagttctttaagatctgcgctggcggtatggcaggcaccacggcagcggcactgggttttgcacccagcgtagcactcgcggaaacccggcagtataaactgctgcgcacccgcgaaacccgtaatacctgcacctattgttccgtaggctgtgggctgttgatgtacagcctcggtgacggagcaaaaaacgccaaagcatctatcttccatatcgaaggtgacccggatcacccggtcaaccgcggagcactttgtccgaaaggcgctggcctggtggatttcatccactccgaaagccgtctgaagtttccggaataccgtgcgccaggttctgataaatggcaacaaatcagttgggaagaggcgtttgatcgcatcgccaaactgatgaaagaagaccgcgatgctaactacattgcgcaaaacgccgaaggcgtgactgttaaccgctggctctccaccgggatgctgtgtgcttccgcgtcgagtaacgaaaccggctatttaacgcaaaaattctcccgcgcgctgggtatgctcgcggtcgacaaccaggcgcgtgtctga

SEQ ID NO: 8992 - protein, 195 aa, Escherichia coli
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARV

SEQ ID NO: 8993 - DNA, 834 bp, Escherichia coli
gtgaaaaaaacacagcaaaaagaaatcgagaatgtgacaaatatcacaggtgttcgtcaaattgagttatggcggcgtgatgatttacaacacccacggttagatgaggtggcggaagaagttcccgttgcgctggtctacaacggcatttcgcacgtggtgatgatggcgtcgcccaaagaccttgagtactttgcgctcggtttttcgctttccgaaggaattatcgaaagcccgcgcgatatcttcggcatggatgtcgttccttcctgtaatggcctggaagtacaaattgagctttccagccgccgctttatggggttgaaggaacgccgccgggcgctggcgggacgtacgggctgtggcgtatgcggtgtagaacagcttaacgatatcggtaaaccggtgcagccgctgccgttcacccagacgtttgatctcaacaaactggatgatgcattacgtcatctcaatgatttccagccagtggggcaactgactggttgtactcacgccgctgcatggatgttgccatctggcgaactggtcggcgggcatgaagacgtgggtcgccatgtggcgctggacaaactgttaggccgccggtcacaagaaggggaaagctggcagcaaggtgcggtgctggtttccagccgtgccagttatgaaatggtgcaaaagtcggcgatgtgcggcgtagagattttgtttgcggtgtctgccgcgaccacacttgctgtagaagtggctgagcgctgtaatctgacgctggtgggcttttgtaaaccgggtcgggcaacggtttatacccatccgcagcgtttgagcaattaa

SEQ ID NO: 8994 - protein, 277 aa, Escherichia coli
MKKTQQKEIENVTNITGVRQIELWRRDDLQHPRLDEVAEEVPVALVYNGISHVVMMASPKDLEYFALGFSLSEGIIESPRDIFGMDVVPSCNGLEVQIELSSRRFMGLKERRRALAGRTGCGVCGVEQLNDIGKPVQPLPFTQTFDLNKLDDALRHLNDFQPVGQLTGCTHAAAWMLPSGELVGGHEDVGRHVALDKLLGRRSQEGESWQQGAVLVSSRASYEMVQKSAMCGVEILFAVSAATTLAVEVAERCNLTLVGFCKPGRATVYTHPQRLSN

SEQ ID NO: 8995 - DNA, 195 bp, Escherichia coli
gtggcgttaacgcctgcgctgcaacctattgatggcgtggcggtgagttatattgatgctgccgtagcgttgggtaataccattaacgaaatggataaatattacacccaggaaaattataaagacgatgcgtttgcgaaagggaaaacgctgcaccagacattcttaaaaatctggaagcctttgaacctgtag

SEQ ID NO: 8996 - protein, 64 aa, Escherichia coli
MALTPALQPIDGVAVSYIDAAVALGNTINEMDKYYTQENYKDDAFAKGKTLHQTFLKIWKPLNL

SEQ ID NO: 8997 - DNA, 438 bp, Escherichia coli
ttgaaaaatattgaagaaagagaagggaaaacattccactactactctctggcagtcatgatttcagcgaaacaaattaataacctgatatcgcaagataagtttgatgcagaagcggcaatgaagaaagtgtctgaactggaaacgctggtggcgcaggccaaagaagcggataaaagcggcatgaatttctcgtttattaattcggcaggccagtatcaactcgaggctaaaaaatacgttcgccgcatcagagataaagtcccgtactctgactgggataaagagcaacttcaggacgcaaactcaagctggatggccgaagactcatttccacgagcgttatgcgattacaacgaaatggtcgatgaaatatttcagttaattgtaatcgcggggcgggtttgtgatgagcacggatatgtcacgaagtcgtaa

SEQ ID NO: 8998 - protein, 145 aa, Escherichia coli
MKNIEEREGKTFHYYSLAVMISAKQINNLISQDKFDAEAAMKKVSELETLVAQAKEADKSGMNFSFINSAGQYQLEAKKYVRRIRDKVPYSDWDKEQLQDANSSWMAEDSFPRALCDYNEMVDEIFQLIVIAGRVCDEHGYVTKS

SEQ ID NO: 8999 - DNA, 1395 bp, Escherichia coli
atgaaaaaatcgacattatctttagccatcggtttattattggcatgtagtaccggtatggcaaaaacacagcatttaacgctggaacaacgcatggcattgctggaagaacgcctggaagcggcagaaatgcgggcagcaaaagcagaggggcaggttaaacagcttcagacacaacaagccgccgagatccgcgaaattaaaaccgcacagggcaacacgccggtaaacggtcaatcaacgacggagtcagagaagaaaaacgccaccccgcctaatctcctgctttcagggtatggcgatttaaaaatctacggtgacgtcgaatttaatatggatgcggaaagtaatcatggcctgctggcaatgaccaacgctgatgtgaatagcgatcccactaatgaacagtggaatctcaatggtcgtattctgttaggttttgatggtatgcgaaaactggataatggctatttcgctgggttctccgcacaaccgctgggggatatgcacggttcagtaaatatcgatgatgcggttttcttctttggcaaagaaaacgactggaaggtcaaagtaggccgttttgaagcctacgatatgttcccgctgaatcaggatacctttgttgaacattccggtaatactgcgaacgatctttatgacgatggcagcggttatatctatatgatgaaagagggccgcggacgttctaacgctggcggtaatttcctcgtcagcaaacaactcgataactggtattttgaattaaacacgttactggaagacggaacatctttatataacgacggtaattatcatggacgcgatatggaacagcagaaaaatgttgcttatctgcgtccggtaattgcctggtcgccgacggaagaattcaccgtttccgcagcgatggaagcgaatgtggtaaataatgcttatggttataccgatagcaagggtaattttgtcgatcagtccgatcgtaccggttatggcatgagtatgacctggaatggcctgaaaaccgatccggaaaatggcatcgtggttaatcttaataccgcctatttagatgctaataatgaaaaagatttcacggcagggattaacgcgctgtggaaacgtttcgagctgggttatatctatgcacataataagattgatgaatttagtggcgtggtttgtgataacgattgctggattgatgatgaaggaacatacaacattcacaccattcatgcgtcttatcagttcgctaatgtgatggatatggagaactttaatatttacctcggcacgtattactccattctggatagcgacggcgataagatacacggcgacgatagtgatgaccgttacggcgcacgcgttcgctttaaatacttcttctga

SEQ ID NO: 9000 - protein, 464 aa, Escherichia coli
MKKSTLSLAIGLLLACSTGMAKTQHLTLEQRMALLEERLEAAEMRAAKAEGQVKQLQTQQAAEIREIKTAQGNTPVNGQSTTESEKKNATPPNLLLSGYGDLKIYGDVEFNMDAESNHGLLAMTNADVNSDPTNEQWNLNGRILLGFDGMRKLDNGYFAGFSAQPLGDMHGSVNIDDAVFFFGKENDWKVKVGRFEAYDMFPLNQDTFVEHSGNTANDLYDDGSGYIYMMKEGRGRSNAGGNFLVSKQLDNWYFELNTLLEDGTSLYNDGNYHGRDMEQQKNVAYLRPVIAWSPTEEFTVSAAMEANVVNNAYGYTDSKGNFVDQSDRTGYGMSMTWNGLKTDPENGIVVNLNTAYLDANNEKDFTAGINALWKRFELGYIYAHNKIDEFSGVVCDNDCWIDDEGTYNIHTIHASYQFANVMDMENFNIYLGTYYSILDSDGDKIHGDDSDDRYGARVRFKYFF

SEQ ID NO: 9001 - DNA, 315 bp, Escherichia coli
atgatccgcaaagcctttgtcatgcaggtaaaccccgacgcccacgaagagtatcagcgtcggcataatcccatctggccggaactggaagcagtgctgaaatctcacggtgcgcataactacgccatctatctcgacaaagcgcataatctgctatttgccacggtagagattgaatctgaagaacggtggaatgcggttgccagtacagatgtttgccaacgttggtggaaatatatgaccgacgttatgcccgctaatgcggataacagcccagtcagtagcgaactgcaagaagtgttttacctgccttaa

SEQ ID NO: 9002 - protein, 104 aa, Escherichia coli
MIRKAFVMQVNPDAHEEYQRRHNPIWPELEAVLKSHGAHNYAIYLDKAHNLLFATVEIESEERWNAVASTDVCQRWWKYMTDVMPANADNSPVSSELQEVFYLP

SEQ ID NO: 9003 - DNA, 918 bp, Escherichia coli
ttgattgccggatgcggcacaagtgccttatccggcctacgggtcgtacatccggcaacaggcacggacgtccaattaacaggaacacagaacatgcaaaacataacccagtcctggtttgtccagggaatgatcaaagccaccaccgatgcctggctgaaaggctgggacgagcgcaacggcggcaacctgacgctgcgcctggatgacgccgatatcgcaccatatcacgacaattttcaccaacaaccgcgctatatcccgctcagccagcccatgcctttactggcaaatacaccgtttattgtcaccggctccggcaaattcttccgtaacgtccagcttgatcctgcggctaacttaggcatcgtaaaagtcgacagcgacggcgcgggctaccacattctttgggggttaaccaacgaagccgtccccacttccgaacttccagctcacttcctttcccactgcgagcgcattaaagccaccaacggcaaagatcgggtgatcatgcactgccacgccactaacctgatcgctctcacctacgtgctggaaaacgacaccgcggtcttcactcgccaactgtgggaaggcagcaccgagtgtctggtggtattcccggatggcgttggcattctgccgtggatggtacccggcacggacgaaatcggccaggcaactgcacaagagatgcaaaaacattcgctggtgttgtggcccttccacggtgtgttcggttccggaccgacactggatgaaaccttcggtttaatcgacaccgcagaaaaatcagcacaaatattagtgaaggtttattcgatgggcggcatgaaacagaccatcagccgtgaagagttgatagcgctcggccagcgtttcggcgttacaccactcgccagtgcgctggcgctgtaa

SEQ ID NO: 9004 - protein, 305 aa, Escherichia coli
MIAGCGTSALSGLRVVHPATGTDVQLTGTQNMQNITQSWFVQGMIKATTDAWLKGWDERNGGNLTLRLDDADIAPYHDNFHQQPRYIPLSQPMPLLANTPFIVTGSGKFFRNVQLDPAANLGIVKVDSDGAGYHILWGLTNEAVPTSELPAHFLSHCERIKATNGKDRVIMHCHATNLIALTYVLENDTAVFTRQLWEGSTECLVVFPDGVGILPWMVPGTDEIGQATAQEMQKHSLVLWPFHGVFGSGPTLDETFGLIDTAEKSAQILVKVYSMGGMKQTISREELIALGQRFGVTPLASALAL

SEQ ID NO: 9005 - DNA, 1260 bp, Escherichia coli
atgaccactcaactggaacaggcctgggagcttgcgaaacagcgtttcgcggcagtagggattgatgtcgaggaggcactgcgccaacttgatcgtttacccgtttcaatgcactgctggcagggcgatgatgtttccggttttgaaaacccggaaggttcgctgaccggtggtattcaggctactggtaattatccgggcaaagcgcgtaatgccagtgagctacgtgccgatctggaacaggctatgcggctgattccagggccgaaacggcttaatttacatgccatctatctggaatcagacacgccagtctcgcgcgaccagatcaaaccagagcacttcaaaaactgggttgaatgggcgaaagccaatcagctcggtctggattttaacccctcctgtttttcgcatccgctaagcgccgatggctttacgctttcccatgccgacgaccgcattcgccagttctggattgaccactgtaaagccagccgccgtgtttcagcctattttggcgagcaactcggcacaccatcggtgatgaacatctggatcccggatggtatgaaagatatcaccgttgaccgtctcgccccacgccagcgtttgctggcagcactggatgaggtgatcagcgagaagctaaaccctgcgcaccatatcgacgccgttgagagcaaattgtttggcattggcgcggagagctacacggttggctccaatgagttttacctggggtatgccaccagccgccagacagcgctgtgcctggacgccgggcatttccacccgactgaagtgatttccgacaagatttccgccgccatgctgtatgtgccgcagttgctgctgcacgtcagccgtccggttcgctgggacagcgatcacgtagtgctgctggatgatgaaacccaggcgattgccagtgagattgttcgtcacgatctgttcgaccgggtgcatatcggcctcgacttcttcgatgcctctatcaaccgcattgccgcgtgggtcattggtacacgcaatatgaaaaaagccctgctacgtgcgttgctggaacctaccgctgaactacgcaagctggaagcggcgggcgattacactgcgcgtctggcgctactggaagagcagaaatcgttgccatggcaggcggtatgggaaatgtattgtcagcgtcacgatacgccagcgggtagcgaatggctggagaacgtgcggacttatgagaaagaaattttgagtcgccgcgggtaa

SEQ ID NO: 9006 - protein, 419 aa, Escherichia coli
MTTQLEQAWELAKQRFAAVGIDVEEALRQLDRLPVSMHCWQGDDVSGFENPEGSLTGGIQATGNYPGKARNASELRADLEQAMRLIPGPKRLNLHAIYLESDTPVSRDQIKPEHFKNWVEWAKANQLGLDFNPSCFSHPLSADGFTLSHADDRIRQFWIDHCKASRRVSAYFGEQLGTPSVMNIWIPDGMKDITVDRLAPRQRLLAALDEVISEKLNPAHHIDAVESKLFGIGAESYTVGSNEFYLGYATSRQTALCLDAGHFHPTEVISDKISAAMLYVPQLLLHVSRPVRWDSDHVVLLDDETQAIASEIVRHDLFDRVHIGLDFFDASINRIAAWVIGTRNMKKALLRALLEPTAELRKLEAAGDYTARLALLEEQKSLPWQAVWEMYCQRHDTPAGSEWLENVRTYEKEILSRRG

SEQ ID NO: 9007 - DNA, 1470 bp, Escherichia coli
atgacctttcgcaattgtgtcgccgtcgatctcggcgcatccagtgggcgcgtgatgctggcgcgttacgagcgtgaatgccgcagcctgacgctgcgcgaaatccatcgttttaacaatggcctgcatagccagaacggttatgtcacctggaatgtggatagcctggaaagtgccattcgccttggattaaacaaggtgtgcgaggaagggattcgtatcgatagcattgggattgatacctggggcgtggactttgtgctgctcgaccaacagggtcagcgtgtgggcctgcccgttgcttatcgcgatagccgcaccaatggcctaatggcgcaggcacaacaacaactcggcaaacgcgatatttatcaacgtagcggcatccagtttctgcccttcaatacgatctatcagctacgtgcactgacagagcagcaaccagaacttattccacacattgctcacgctttgctgataccggattactttagttatcgcctgaccggcaagatgaactgggaatataccaacgccacgaccacgcaactggtcaatatcaatagcgacgactgggacgagtcgctactggcgtggagcggtgccaacaaagcctggtttggtcgcccgacgcatccgggtaatgtcataggtcactggatttgcccgcagggtaatgagattccggtggtcgccgttgccagccatgataccgccagcgcggttatcgcctcgccgttaaacggttcacgcgccgcttatctctcttctggcacctggtcattgatgggcttcgaaagccagacgccatttaccaatgacacggcgctggcagccaatatcaccaacgaaggcggggcggaaggtcgctatcgggtgctgaaaaatattatgggcttatggctgcttcagcgagtgcttcaggagcggcaaatcaacgatcttccggcgcttatcgccgcaacacaggcacttccggcctgccgcttcatcatcaatcccaatgacgatcgctttattaatcctgacgagatgtgcagcgaaattcaggctgcgtgtcgggaaacggcgcaaccgatcccggaaagtgatgctgaactggcgcgctgtattttcgacagtctggcgctgctgtatgccgatgtgttgcatgagctggcgcagctgcgtggtgaagatttctcgcaactgcatattgtcggcggcggctgccagaacacgctgctcaaccagctgtgtgccgatgcctgcggtattcgggtgatcgcagggcctgttgaagcctcgacgctcggcaatatcggcatccagttaatgacgctggatgaactcaacaatgtggatgatttccgtcaggtcgtcagcactaccgcgaatctgaccacctttacccctaatcctgacagtgaaattgcccactatgtggcgcagattcactctacacgacagacaaaggagctttgcgcatga

SEQ ID NO: 9008 - protein, 489 aa, Escherichia coli
MTFRNCVAVDLGASSGRVMLARYERECRSLTLREIHRFNNGLHSQNGYVTWNVDSLESAIRLGLNKVCEEGIRIDSIGIDTWGVDFVLLDQQGQRVGLPVAYRDSRTNGLMAQAQQQLGKRDIYQRSGIQFLPFNTIYQLRALTEQQPELIPHIAHALLIPDYFSYRLTGKMNWEYTNATTTQLVNINSDDWDESLLAWSGANKAWFGRPTHPGNVIGHWICPQGNEIPVVAVASHDTASAVIASPLNGSRAAYLSSGTWSLMGFESQTPFTNDTALAANITNEGGAEGRYRVLKNIMGLWLLQRVLQERQINDLPALIAATQALPACRFIINPNDDRFINPDEMCSEIQAACRETAQPIPESDAELARCIFDSLALLYADVLHELAQLRGEDFSQLHIVGGGCQNTLLNQLCADACGIRVIAGPVEASTLGNIGIQLMTLDELNNVDDFRQVVSTTANLTTFTPNPDSEIAHYVAQIHSTRQTKELCA

SEQ ID NO: 9009 - DNA, 96 bp, Escherichia coli
gtgaccttctcgttactgacaggaaaatgggccattggcaaccagggaaagatgaacgtgatgatgttcacaatttgcttcattgtggtgatgtga

SEQ ID NO: 9010 - protein, 31 aa, Escherichia coli
MTFSLLTGKWAIGNQGKMNVMMFTICFIVVM

SEQ ID NO: 9011 - DNA, 837 bp, Escherichia coli
atgaccgtattacatagtgtggatttttttccgtctggtaacgcgtccgtggcgatagaaccccggctcccgcaggcggattttcctgaacatcatcatgattttcatgaaattgtgattgtcgaacatggcacgggtattcatgtatttaatgggcagccctataccatcaccggtgggacggtctgtttcgtacgcgatcatgatcggcatctgtatgaacataccgataatctgtgtctgaccaatgtgctgtatcgctcgccggatcgatttcagtttctcgccgggctgaatcagttgctgccacaagagcaggatgggcagtatccgtctcactggcgcgttaaccacagcgtgttgcagcaggtgcgacagctggttgcacagatggaacagcaggaagaggaaaatgatttaccctcgaccgccagtcgcgagatcttatttatgcaattactgctcttgctgcgtaaaagcagtttgcaggagaacctggaaaacagcgcgtcacgtctcaacttgcttctggcctggctggaggaccattttgccgatgaggtgaattgggacgctgtggcggatcaattttctctttcgctgcgtacgctacatcggcagcttaagcagaaaacgggactgacgcctcagcgttacctgaaccgcctgcgactgatgaaagcccgacatctgctacgccacagcgaggccagcgttactgacatcgcctatcgctgcggatttagcgacagtaaccacttttcgacgctttttcgccgagagtttaactggtcaccgcgtgatattcgccagggacgggatggctttctgcaataa

SEQ ID NO: 9012 - protein, 278 aa, Escherichia coli
MTVLHSVDFFPSGNASVAIEPRLPQADFPEHHHDFHEIVIVEHGTGIHVFNGQPYTITGGTVCFVRDHDRHLYEHTDNLCLTNVLYRSPDRFQFLAGLNQLLPQEQDGQYPSHWRVNHSVLQQVRQLVAQMEQQEEENDLPSTASREILFMQLLLLLRKSSLQENLENSASRLNLLLAWLEDHFADEVNWDAVADQFSLSLRTLHRQLKQKTGLTPQRYLNRLRLMKARHLLRHSEASVTDIAYRCGFSDSNHFSTLFRREFNWSPRDIRQGRDGFLQ

SEQ ID NO: 9013 - DNA, 960 bp, Escherichia coli
gtgatattcgccagggacgggatggctttctgcaataacgcgaatcttctcaacgtatttgtacgccatattgcgaataatcaacttcgctctctggccgaggtagccacggtggcgcatcagttaaaacttctcaaagatgatttttttgccagcgaccagcaggcagtcgctgtggctgaccgttatccgcaagatgtctttgctgaacatacacatgatttttgtgagctggtaattgtctggcgcggtaatggtctgcatgtactcaacgatcgcccttatcgcattacccgtggcgatctcttttacattcatgctgacgataaacactcctacgcttccgttaacgatctggttttgcagaatattatttattgcccggagcggctgaagctgaatcttgactggcagggggcgattccgggatttaacgccagcgcagggcaaccacactggcgtttaggtagcgtggggatggcgcaggcgcggcaggttatcggtcagcttgagcatgaaagtagtcagcatgtgccgtttgctaacgaaatggctgagttgctgttcgggcagttggtgatgttgctgaatcgccatcgttacaccagtgattcgttgccgccaacatccagcgaaacgttgctggataagctgattacccggctggcggccagcctgaaaagtccctttgcgctggataaattttgtgatgaggcatcgtgcagtgagcgcgttttgcgtcagcaatttcgtcagcagactggaatgaccatcaatcaatatctgcgacaggtcagagtgtgtcatgcgcaatatctcctccagcatagccgcctgttaatcagtgatatttcgaccgaatgtggctttgaagatagtaactatttttcggtggtgtttacccgggaaaccgggatgacgcccagccagtggcgtcatctcaattcgcagaaagattaa

SEQ ID NO: 9014 - protein, 319 aa, Escherichia coli
MIFARDGMAFCNNANLLNVFVRHIANNQLRSLAEVATVAHQLKLLKDDFFASDQQAVAVADRYPQDVFAEHTHDFCELVIVWRGNGLHVLNDRPYRITRGDLFYIHADDKHSYASVNDLVLQNIIYCPERLKLNLDWQGAIPGFNASAGQPHWRLGSVGMAQARQVIGQLEHESSQHVPFANEMAELLFGQLVMLLNRHRYTSDSLPPTSSETLLDKLITRLAASLKSPFALDKFCDEASCSERVLRQQFRQQTGMTINQYLRQVRVCHAQYLLQHSRLLISDISTECGFEDSNYFSVVFTRETGMTPSQWRHLNSQKD

SEQ ID NO: 9015 - DNA, 1035 bp, Escherichia coli
atgagtaacgcgattacgatggggatattttggcatttgatcggcgcggccagtgcagcctgtttttacgctccgttcaaaaaagtaaaaaaatggtcatgggaaaccatgtggtcagtcggtgggattgtttcgtggattatcctgccgtgggccatcagcgccctgttactaccgaatttctgggcgtattacagctcgtttagtctctctacgctgctgcctgtttttctgttcggcgctatgtgggggatcggtaatatcaactacggcctgaccatgcgttatctcggcatgtcgatgggaattggcatcgccattggcattacgttgattgtcggtacgctgatgacgccaattatcaacggcaatttcgatgtgctgattaataccgaaggcggacgcatgacgttgctcggcgttctggtggcgctgattggcgtagggattgtaactcgcgccgggcagttgaaagagcgcaagatgggcattaaagcagaagagttcaatctgaaaaaagggctggtgctggcggtgatgtgcggcattttctctgccgggatgtcctttgcgatgaacgccgcaaaaccgatgcatgaagccgctgccgcgctgggcgtcgatcccctgtatgtcgctctgccaagctatgttgtcatcatgggcggcggcgcaatcatcaacctcggcttctgcttcattcgtctggcaaaagtgaaagatttgtcgctaaaagccgacttctcgctggcaaaaccgctgatcattcacaatgtgctactctcagctctgggtgggttgatgtggtatctgcaattctttttctatgcctggggccacgcccgcattccggcgcagtatgactacatcagttggatgctgcatatgagcttctatgtattgtgcggcggtatcgttgggctggtgctgaaagagtggaacaatgcaggacgccgtccggtaacggtgttgagcctcggttgtgtggtgattattgttgccgctaacatcgtcggcatcggcatggcgaattaa

SEQ ID NO: 9016 - protein, 344 aa, Escherichia coli
MSNAITMGIFWHLIGAASAACFYAPFKKVKKWSWETMWSVGGIVSWIILPWAISALLLPNFWAYYSSFSLSTLLPVFLFGAMWGIGNINYGLTMRYLGMSMGIGIAIGITLIVGTLMTPIINGNFDVLINTEGGRMTLLGVLVALIGVGIVTRAGQLKERKMGIKAEEFNLKKGLVLAVMCGIFSAGMSFAMNAAKPMHEAAAALGVDPLYVALPSYVVIMGGGAIINLGFCFIRLAKVKDLSLKADFSLAKPLIIHNVLLSALGGLMWYLQFFFYAWGHARIPAQYDYISWMLHMSFYVLCGGIVGLVLKEWNNAGRRPVTVLSLGCVVIIVAANIVGIGMAN

SEQ ID NO: 9017 - DNA, 621 bp, Escherichia coli
atgagttataccctgccatccctgccgtatgcttacgatgccctggaaccgcacttcgataagcagaccatggaaatccaccacaccaaacaccatcaggcctacgttaacaacgccaacgcggcgctggaaagcctgccagaattcgctaacctgccggttgaagagctgatcaccaaactggaccaactgccagcagacaagaaaaccgtactgcgcaataacgctggtggtcacgctaaccacagcctgttctggaaaggtctgaaaaaaggcaccaccctgcagggtgacctgaaagcggctatcgaacgtgacttcggctccgttgataacttcaaagcagaatttgagaaagcggcagcttcccgctttggttccggctgggcatggctggtgcaaaaaggcgataaactggcggtggtttctactgctaaccaggactctccgctgatgggcgaagccatttctggcgcttccggcttcccgattctgggcctggatgtgtgggaacatgcttactacctgaaattccagaaccgccgtccggactacattaaagagttctggaacgtggtgaactgggacgaagcagcggcacgtttcgcagcgaaaaaataa

SEQ ID NO: 9018 - protein, 206 aa, Escherichia coli
MSYTLPSLPYAYDALEPHFDKQTMEIHHTKHHQAYVNNANAALESLPEFANLPVEELITKLDQLPADKKTVLRNNAGGHANHSLFWKGLKKGTTLQGDLKAAIERDFGSVDNFKAEFEKAAASRFGSGWAWLVQKGDKLAVVSTANQDSPLMGEAISGASGFPILGLDVWEHAYYLKFQNRRPDYIKEFWNVVNWDEAAARFAAKK

SEQ ID NO: 9019 - DNA, 129 bp, Escherichia coli
gtgatcaaaaccacatcaattgaaacgctgttttatttttatcggatcattgtttttattttgaaattgatcacaaaaaaaccaccgccgttggcgatggttcattttttaagctgcaatgcggcgtaa

SEQ ID NO: 9020 - protein, 42 aa, Escherichia coli
MIKTTSIETLFYFYRIIVFILKLITKKPPPLAMVHFLSCNAA

SEQ ID NO: 9021 - DNA, 942 bp, Escherichia coli
atgctcgtcccgctattccttggcgcactgtgccacaccttctcgccgggggcggggaaatattttggatcattcaccaacgggatgattaccggtacggtgcccattctggcggtgtggtttttttgcatgggggcgtcaataaaattaagcgcgacgggaacggtactgcgtaaatccggtacgctggtggtaactaaaattgccgtcgcgtgggtggttgcggcaattgcctcgcgcattattccggaacatggtgttgaagttggattttttgccggactttcaacgttggcgctggtggcggcgatggatatgaccaacggcggactttacgcttccatcatgcagcagtacggcacaaaagaagaagctggggcatttgtgttgatgtcgttggagtccgggccgctcatgacgatgattattctgggcactgccgggattgcctcgtttgaaccgcatgttttcgtcggcgcagtattgccgttcctggtgggctttgccctggggaaccttgaccctgagttacgagaatttttcagcaaagcggtgcagacgcttattccattctttgccttcgcactgggcaataccattgatttgactgtaattgcccagacaggtttgctggggatcctgttgggtgtggcagtaattatcgtgaccggtattccgttgattatcgccgataaattgattggcggtggcgatggcactgccggaattgccgcttccagttccgcaggggccgcggtagcgacacctgtgctgattgctgaaatggtgcctgcgtttaaacctatggctccggcagcaacttcgctggtcgcgacggcggtcattgtgacttcgattctggtgccaattcttacctctatctggtcacgtaaagtcaaagccagagcggcgaaaatcgaaattttaggtacggtgaaataa

SEQ ID NO: 9022 - protein, 313 aa, Escherichia coli
MLVPLFLGALCHTFSPGAGKYFGSFTNGMITGTVPILAVWFFCMGASIKLSATGTVLRKSGTLVVTKIAVAWVVAAIASRIIPEHGVEVGFFAGLSTLALVAAMDMTNGGLYASIMQQYGTKEEAGAFVLMSLESGPLMTMIILGTAGIASFEPHVFVGAVLPFLVGFALGNLDPELREFFSKAVQTLIPFFAFALGNTIDLTVIAQTGLLGILLGVAVIIVTGIPLIIADKLIGGGDGTAGIAASSSAGAAVATPVLIAEMVPAFKPMAPAATSLVATAVIVTSILVPILTSIWSRKVKARAAKIEILGTVK

SEQ ID NO: 9023 - DNA, 675 bp, Escherichia coli
atgcgatatccggttgatgtatacacaggcaagattcaggcttatcccgaaggcaaacccagcgcaattgccaaaatccaggttgatggtgagttgatgctgacggacctggggctggaaggtgacgaacaggcggagaaaaagatccacggcgggccagacagagcgctgtgtcattatcctcgtgagcattatctctactgggcgcgggaatttccggaacaggcggagctgtttgttgcgcctgcgtttggcgaaaatctctcaaccgacggtctgacggaaagtaatgtttatattggtgatattttccgctggggagaggcattaattcaggtcagccagccacgctcaccttgctataaactcaattaccattttgatatcagcgatatagcgcagttgatgcaaaacacgggtaaagtggggtggttgtatagcgtaattgcaccagggttggtatctgctgatgcgccactggagttggtttcccgtgtcagcgatgtgaccgtgcaggaggctgccgccatcgcatggcatatgccgtttgatgacgatcagtatcaccgtttactctccgccgcagggttatcgaaaagctggacgcgaacgatgcaaaagcgccgactgagcggcaagatcgaagatttttcccgccgattgtggggaaaataa

SEQ ID NO: 9024 - protein, 224 aa, Escherichia coli
MRYPVDVYTGKIQAYPEGKPSAIAKIQVDGELMLTDLGLEGDEQAEKKIHGGPDRALCHYPREHYLYWAREFPEQAELFVAPAFGENLSTDGLTESNVYIGDIFRWGEALIQVSQPRSPCYKLNYHFDISDIAQLMQNTGKVGWLYSVIAPGLVSADAPLELVSRVSDVTVQEAAAIAWHMPFDDDQYHRLLSAAGLSKSWTRTMQKRRLSGKIEDFSRRLWGK

SEQ ID NO: 9025 - DNA, 1374 bp, Escherichia coli
atgataggcagcttaaccgcgcgcatcttcgccatcttctggctgacgctggcgctggtgttgatgttggttttgatgttacccaagctcgattcacgccagatgaccgagcttctggatagcgaacagcgtcaggggctgatgattgagcagcatgtcgaagcggagctggcgaacgatccgcccaacgatttaatgtggtggcggcgtctgttccgggcgattgataagtgggcaccaccaggacagcgtttgttactggtgaccaccgaaggccgcgtgatcggcgctgaacgcagcgaaatgcagatcattcgtaactttattggtcaggccgataacgccgatcatccgcagaagaaaaagtatggccgcgtggaactggtcggtccgttctccgtgcgtgatggcgaagataattaccaactttatctgattcgtccggccagcagttctcaatccgatttcataaacttactgtttgaccgcccgttattactgctgattgtcaccatgctggtcagtacgccgctgctgttgtggttggcctggagtctggcaaaaccggcgcgtaagctgaaaaacgctgccgatgaagttgcccagggaaacttacgccagcacccggaactggaagcggggccacaggaattccttgccgccggtgccagttttaaccagatggtcaccgcgctggagcgcatgatgacctctcagcagcgtctactttctgatatctctcacgaactgcgcaccccgctgacgcgtctgcaactgggtacggcgttactgcgccgtcgtagcggtgaaagcaaggaactggagcgtattgaaactgaagcgcaacgtctggacagcatgatcaacgatctgttggtgatgtcacgtaatcagcagaaaaatgcgctggttagcgagaccatcaaagccaaccagttgtggagtgaagtgctggataacgcggcgttcgaagccgagcaaatgggcaagtcgttgacggttaacttcccacctgggccgtggccgctgtacggcaacccgaacgccctggaaagtgcgctggaaaacattgttcgtaatgctctgcgttattcccatacgaagattgaagtgggctttgcggtagataaagacggtatcaccattacggtggacgacgatggtcctggcgttagcccggaagatcgcgaacagattttccgtccgttctatcggaccgacgaagcacgcgatcgtgaatctgggggtacaggtttggggctggcgattgttgaaaccgccattcagcagcatcgtggctgggtgaaggcagaagacagcccgctgggcggtttacggctggtgatttggttgccgctgtataagcggagttaa

SEQ ID NO: 9026 - protein, 457 aa, Escherichia coli
MIGSLTARIFAIFWLTLALVLMLVLMLPKLDSRQMTELLDSEQRQGLMIEQHVEAELANDPPNDLMWWRRLFRAIDKWAPPGQRLLLVTTEGRVIGAERSEMQIIRNFIGQADNADHPQKKKYGRVELVGPFSVRDGEDNYQLYLIRPASSSQSDFINLLFDRPLLLLIVTMLVSTPLLLWLAWSLAKPARKLKNAADEVAQGNLRQHPELEAGPQEFLAAGASFNQMVTALERMMTSQQRLLSDISHELRTPLTRLQLGTALLRRRSGESKELERIETEAQRLDSMINDLLVMSRNQQKNALVSETIKANQLWSEVLDNAAFEAEQMGKSLTVNFPPGPWPLYGNPNALESALENIVRNALRYSHTKIEVGFAVDKDGITITVDDDGPGVSPEDREQIFRPFYRTDEARDRESGGTGLGLAIVETAIQQHRGWVKAEDSPLGGLRLVIWLPLYKRS

SEQ ID NO: 9027 - DNA, 633 bp, Escherichia coli
atggaaggcttcaacgtgattgttgcccacgatggggaacaggcgcttgatcttctggacgacagcattgatttacttttgcttgatgtaatgatgccgaagaaaaatggtatcgacacattaaaagcacttcgccagacacaccagacgcctgtcattatgttgacggcgcgcggcagtgaacttgatcgcgttctcggccttgagctgggcgcagatgactatctcccaaaaccgtttaatgatcgtgagctggtggcacgtattcgcgcgatcctgcgccgttcgcactggagcgaacaacagcaaaacaacgacaacggttcaccgacactggaagttgatgccttaagtctcaatcctggtcgccaggaagccaccttcgacgggcaaacactggagttaaccggtactgagtttaccctgctctatttgctggcacagcatctgggtcaggtggtttcccgtgagcatttaagccaggaagtgctgggcaagcgcctgacgcctttcgaccgcgctatcgatatgcatatttccaacctgcgtcgtaaactgccggatcgtaaagatggtcacccgtggtttaaaaccttgcgtggtcgcggctatctgatggtttctgcttcatga

SEQ ID NO: 9028 - protein, 210 aa, Escherichia coli
MEGFNVIVAHDGEQALDLLDDSIDLLLLDVMMPKKNGIDTLKALRQTHQTPVIMLTARGSELDRVLGLELGADDYLPKPFNDRELVARIRAILRRSHWSEQQQNNDNGSPTLEVDALSLNPGRQEATFDGQTLELTGTEFTLLYLLAQHLGQVVSREHLSQEVLGKRLTPFDRAIDMHISNLRRKLPDRKDGHPWFKTLRGRGYLMVSAS

SEQ ID NO: 9029 - DNA, 501 bp, Escherichia coli
atgcgcatagttaccgctgccgtcatggcctcaacgctggcagtcagttcattaagccacgctgctgaagtcggttcaggcgataactgtcatccgggtgaagaacttacgcagcgcagtacgcagagccatatgttcgacggcataagtttaaccgaacatcagcgtcagcagatgcgagatcttatgcaacaggcccggcacgaacagcctcctgttaatgttagcgaactggagacaatgcatcgccttgtcaccgcagaaaattttgatgaaaacgctgtgcgcgcacaggcagaaaaaatggcgaatgagcaaatagctcgtcaggttgagatggcaaaagtccgcaaccaaatgtatcgcctgttaacgccggagcagcaagcggttttaaacgagaaacatcaacaacgaatggagcagttgcgcgacgtgacgcaatggcaaaaaagttcatcgttgaagctattgagtagtagcaactcacgttcccagtag

SEQ ID NO: 9030 - protein, 166 aa, Escherichia coli
MRIVTAAVMASTLAVSSLSHAAEVGSGDNCHPGEELTQRSTQSHMFDGISLTEHQRQQMRDLMQQARHEQPPVNVSELETMHRLVTAENFDENAVRAQAEKMANEQIARQVEMAKVRNQMYRLLTPEQQAVLNEKHQQRMEQLRDVTQWQKSSSLKLLSSSNSRSQ

SEQ ID NO: 9031 - DNA, 903 bp, Escherichia coli
atgaatcaatcttatggacggctggtcagtcgggcggcgattgctgcgacggcgatggcttcgctgctattgctgattaaaatttttgcatggtggtataccgggtcggtgagtattctcgccgcgctggtggattcgctggtggatatcggcgcgtcgttgacgaatttactggtggtgcgatattccctgcaacctgccgacgataatcactcgtttggtcacggtaaagctgagtccctcgcggcgctggcgcaaagtatgtttatctccggttcggcactattcctgtttttgacgggtattcaacatctggtatctccaacaccgatgacagatccaggcgtcggggttatcgtgacaattgtggcgctaatttgtacgattatccttgtctcgtttcagcgttgggtggtgcgccggacgcaaagccaggcggtgcgggctgatatgctacattaccagtctgatgttatgatgaacggcgcaattctgctggcgctggggttgtcctggtacggctggcatcgcgccgatgctctgtttgcattggggatcggcatctatattttatatagcgcgttacgcatgggatatgaggcggtacagtcattactggatcgcgcattgcctgatgaggaacggcaagaaattattgatatcgtgacttcctggccgggtgttagcggcgctcacgatcttcgcacgcggcagtcagggccgacccgctttattcagattcatttggaaatggaagactctctgcctttggttcaggcacatatggtggcggatcaggtagagcaggctattttacggcgttttccgggatcggatgtgattatccatcaggacccctgttccgtcgtacccagggagggtaaacggtctatgctttcataa

SEQ ID NO: 9032 - protein, 300 aa, Escherichia coli
MNQSYGRLVSRAAIAATAMASLLLLIKIFAWWYTGSVSILAALVDSLVDIGASLTNLLVVRYSLQPADDNHSFGHGKAESLAALAQSMFISGSALFLFLTGIQHLVSPTPMTDPGVGVIVTIVALICTIILVSFQRWVVRRTQSQAVRADMLHYQSDVMMNGAILLALGLSWYGWHRADALFALGIGIYILYSALRMGYEAVQSLLDRALPDEERQEIIDIVTSWPGVSGAHDLRTRQSGPTRFIQIHLEMEDSLPLVQAHMVADQVEQAILRRFPGSDVIIHQDPCSVVPREGKRSMLS

SEQ ID NO: 9033 - DNA, 1059 bp, Escherichia coli
ttgttatactatttgcacattcgttggatcatttcgatgtgcaagaagacttccggcaacagatttcattttgcattccaaagttcagaggtagtcatgattaagaaaatcggtgtgttgacaagcggcggtgatgcgccaggcatgaacgccgcaattcgcggggttgttcgttctgcgctgacagaaggtctggaagtaatgggcatttatgacggctatctgggtctgtatgaagaccgtatggtacagctagaccgttacagcgtttctgacatgatcaaccgtggtggtacgttcctcggttctgcgcgtttcccggaattccgcgacgagaacatccgcgccgtggctatcgaaaacctgaaaaaacgtgggatcgacgcgctggtggttatcggcggtgacggttcctacatgggtgcaatgcgtctgaccgaaatgggcttcccgtgcatcggcctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggcgatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattactgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggtggtcgttgcgtaggtatccagaacgaacagctggttcaccacgacatcatcgacgctatcgaaaacatgaagcgtccgttcaaaggcgactggctggactgcgcgaaaaaactgtattaa

SEQ ID NO: 9034 - protein, 352 aa, Escherichia coli
MLYYLHIRWIISMCKKTSGNRFHFAFQSSEVVMIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAKKLY

SEQ ID NO: 9035 - DNA, 990 bp, Escherichia coli
atgaaaaagtggggcgtagggttaacatttttgctggcggcaaccagcgttatggcaaaggatattcagcttcttaacgtttcatatgatccaacgcgcgaattgtacgaacagtacaacaaggcattcagcgcccactggaaacagcaaactggcgataacgtggtgatccgtcagtcccacggtggttcaggcaaacaagcgacgtcggtaatcaatggtattgaagctgatgttgtcactctggctctggcctatgacgtggacgcaattgcggaacgcgggcggattgataaagagtggatcaaacgtctgccggataactccgcaccgtacacttccaccattgttttcctggtacgtaagggtaatccgaagcagatccatgactggaacgatctgattaaaccgggtgtttcggtgatcacgcctaatccgaaaagctctggtggcgcgcgctggaactacctggcagcctggggctacgcgctgcatcacaacaacaacgatcaggtaaaagcacaggattttgttcgggcactgtataaaaacgtcgaagttctggattctggcgcgcgcggctccactaatacctttgtcgagcgcgggattggcgatgtactgatcgcctgggaaaacgaagctctgctggcagcgaatgaactggggaaagataaattcgaaatcgtcacgccgagtgagtctatcctcgcagagccaaccgtgtcggtggtcgataaagtggtcgagaaaaaaggcaccaaagaggtggcggaagcctacctgaaatatctctactcgccagaaggtcaggaaattgcagcgaaaaactactaccgtccgcgcgacgctgaggtagcgaaaaagtacgaaaatgcgtttccaaaattgaagttattcaccattgatgaagagttcggcggctggacgaaagcgcaaaaagagcattttgctaacggcggtacgttcgatcagatcagcaaacgctga

SEQ ID NO: 9036 - protein, 329 aa, Escherichia coli
MKKWGVGLTFLLAATSVMAKDIQLLNVSYDPTRELYEQYNKAFSAHWKQQTGDNVVIRQSHGGSGKQATSVINGIEADVVTLALAYDVDAIAERGRIDKEWIKRLPDNSAPYTSTIVFLVRKGNPKQIHDWNDLIKPGVSVITPNPKSSGGARWNYLAAWGYALHHNNNDQVKAQDFVRALYKNVEVLDSGARGSTNTFVERGIGDVLIAWENEALLAANELGKDKFEIVTPSESILAEPTVSVVDKVVEKKGTKEVAEAYLKYLYSPEGQEIAAKNYYRPRDAEVAKKYENAFPKLKLFTIDEEFGGWTKAQKEHFANGGTFDQISKR

SEQ ID NO: 9037 - DNA, 948 bp, Escherichia coli
ttgatgaagagttcggcggctggacgaaagcgcaaaaagagcattttgctaacggcggtacgttcgatcagatcagcaaacgctgatttccccaggataattatcaagcccggtggtttctcgccactgggttttttatttgtcacgattttgcgttacccttgcatctctttgaggtacagggaaaaaaagatgaaaaaagcgggtcttctttttttggtgatgatagttatcgccgttgtggctaccggtattggttactggaaattaaccggtgaagagtcagacacgttacgtaagattgttcttgagcaatgtttgcccaaccagcaggaaaaccaaaacccgtcgccatgtgcggaagtcaaacccaacgccggatacgtggttttaaaagatcgtcatggcccactgcaatatctgttgatgccaacgtaccgtattaacggtactgaaagcccattgttgaccgatccgtcaacgcctaattttttctggttagcctggcaggcgcgtgattttatgagccaaaaatacggccagcctgttcccgatcgcgcggtatctctggcgatcaactcccgcaccgggcgtacgcaaaaccattttcatattcatatttcttgtattcgtcctgatgtgcgcgaacagctggataacaatctggcgaacatcagtagccgctggttgccactgccaggtggtttgcgtgggcatgagtacctggcgcgtcgggtaacggaaagcgaactggtacaacgcagcccatttatgatgctggcggaagaagtgcctgaggcgcgggaacatatgggaagctacgggctggcgatggtacggcagagtgataactcatttgtattgctggcgacacaacgaaatctactgacgctgaaccgtgcttcagccgaggaaatccaggatcatcagtgtgagattttgcgttaa

SEQ ID NO: 9038 - protein, 315 aa, Escherichia coli
MMKSSAAGRKRKKSILLTAVRSIRSANADFPRIIIKPGGFSPLGFLFVTILRYPCISLRYREKKMKKAGLLFLVMIVIAVVATGIGYWKLTGEESDTLRKIVLEQCLPNQQENQNPSPCAEVKPNAGYVVLKDRHGPLQYLLMPTYRINGTESPLLTDPSTPNFFWLAWQARDFMSQKYGQPVPDRAVSLAINSRTGRTQNHFHIHISCIRPDVREQLDNNLANISSRWLPLPGGLRGHEYLARRVTESELVQRSPFMMLAEEVPEAREHMGSYGLAMVRQSDNSFVLLATQRNLLTLNRASAEEIQDHQCEILR

SEQ ID NO: 9039 - DNA, 768 bp, Escherichia coli
atgcgacatcctttagtgatgggtaactggaaactgaacggcagccgccacatggttcacgagctggtatctaacctgcgtaaagagctggcaggtgttgctggctgtgcggttgcaatcgcaccaccggaaatgtacatcgatatggcgaagcgtgaagctgaaggcagccacatcatgctgggtgcgcaaaacgtggacctgaacctgtccggcgcattcaccggtgaaacctctgctgctatgctgaaagacatcggcgcacagtacatcatcatcggccactctgaacgtcgtacttaccacaaagaatctgacgaactgatcgcgaaaaaattcgcggtgctgaaagagcagggtctgactccggttctgtgcatcggtgaaaccgaagcggaaaacgaagcgggcaaaactgaagaagtttgtgcacgtcagatcgacgcggtactgaaaactcagggtgctgcggcattcgaaggtgcggttatcgcttacgaacctgtatgggcaatcggtactggcaaatctgcaactccggctcaggcacaggctgttcacaaattcatccgtgaccacattgctaaagttgacgctaacatcgctgaacaagtgatcattcagtacggcggctctgtaaacgcgtctaacgctgcggaactgtttgctcagccagacatcgacggcgcgctggttggcggtgcttctctgaaagctgacgctttcgccgtgatcgttaaagctgcagaagcggctaaacaggcttaa

SEQ ID NO: 9040 - protein, 255 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 9041 - DNA, 600 bp, Escherichia coli
atgaagccagggtgtacgctgttttttctcttatgttctgcattaaccgttacaacaacggcgcatgcacaaacaccagatacggcaacgaccgcgccttatctgctggctggagcccctactttcgatctctccatcagccagtttcgagaagactttaacagccagaatcccagcctgccactgaacgaatttcgtgccatcgacagcagtcccgacaaagccaatctcactcgtgcagcaagtaaaattaacgagaacttgtatgcttctactgcgctggagcgcggtaccttaaaaatcaaaagcattcaaataacctggctacccatccaggggccagagcaaaaagccgcgaaagcgaaagctcaggcatacatggcagcggtgatccgcacactcaccccattaatgaccaaaactcaaagccagaaaaaactgcagtcgctactaacggcggggaaaaacaaacgttattacaccgagacagaaggtgcactgcgttatgttgtcgcggacaacggcgaaaaggggctgaccttcgctgttgaaccgattaagctggcgctatctgaatcgcttgaaggtttgaataaatga

SEQ ID NO: 9042 - protein, 199 aa, Escherichia coli
MKPGCTLFFLLCSALTVTTTAHAQTPDTATTAPYLLAGAPTFDLSISQFREDFNSQNPSLPLNEFRAIDSSPDKANLTRAASKINENLYASTALERGTLKIKSIQITWLPIQGPEQKAAKAKAQAYMAAVIRTLTPLMTKTQSQKKLQSLLTAGKNKRYYTETEGALRYVVADNGEKGLTFAVEPIKLALSESLEGLNK

SEQ ID NO: 9043 - DNA, 441 bp, Escherichia coli
atgaccatacagcaatggttattctcatttaaagggcgtattggacgccgtgatttctggatttggataggcctgtggttcgcaggcatgctggtgcttttctcactggcgggtaaaaatttactcgatattcagaccgcggcgttttgccttgtgtgcttgctttggccaacagcggcagtaaccgttaagcgcttgcatgatcgcgggcgttccggcgcatgggcatttctgatgattgtggcgtggatgctgctggcgggtaactgggcaattttaccgggtgtctggcaatgggcggtggggcgttttgtcccgacattgattctggtgatgatgcttatcgatcttggtgcgtttgttggcacacaaggcgaaaataaatatggtaaagatacccaggatgtgaagtataaagccgacaataaatcaagtaattaa

SEQ ID NO: 9044 - protein, 146 aa, Escherichia coli
MTIQQWLFSFKGRIGRRDFWIWIGLWFAGMLVLFSLAGKNLLDIQTAAFCLVCLLWPTAAVTVKRLHDRGRSGAWAFLMIVAWMLLAGNWAILPGVWQWAVGRFVPTLILVMMLIDLGAFVGTQGENKYGKDTQDVKYKADNKSSN

SEQ ID NO: 9045 - DNA, 300 bp, Escherichia coli
atgaaagatgtcgtagataaatgcagtactaaaggatgtgcgattgatatcggtacggtgattgataacgacaactgtaccagtaagttttcgcgcttttttgccacccgcgaagaagcagagtcctttatgaccaaactgaaagagcttgccgccgctgcatcctctgcagatgaaggggccagcgtggcctataagattaaggatctggaagggcaagttgagcttgatgcggccttcaccttctcatgccaggccgagatgattatttttgagttatcactgcgttcgttagcttga

SEQ ID NO: 9046 - protein, 99 aa, Escherichia coli
MKDVVDKCSTKGCAIDIGTVIDNDNCTSKFSRFFATREEAESFMTKLKELAAAASSADEGASVAYKIKDLEGQVELDAAFTFSCQAEMIIFELSLRSLA

SEQ ID NO: 9047 - DNA, 429 bp, Escherichia coli
atggcttataaacacattggcgtggcaatttccgggaatgaagaagatgccttactggtgaataaagccctggagctcgccagacataatgacgctcacctgacgttaattcatattgatgatggcttaagcgagttgtatccgggtatctacttccctgcaacagaagatattcttcaattgttgaagaataagtcggataacaagctgtataaactgacgaaaaatattcaatggccgaagacaaaactgcgtattgaacgcggagaaatgccggaaacactgctggaaattatgcaaaaagagcagtgcgacctccttgtctgtggtcatcaccactcatttatcaaccgtttgatgccggcatatcgcgggatgatcaataagttgagtgcggatctcttgatcgtgccgtttatcgacaagtaa

SEQ ID NO: 9048 - protein, 142 aa, Escherichia coli
MAYKHIGVAISGNEEDALLVNKALELARHNDAHLTLIHIDDGLSELYPGIYFPATEDILQLLKNKSDNKLYKLTKNIQWPKTKLRIERGEMPETLLEIMQKEQCDLLVCGHHHSFINRLMPAYRGMINKLSADLLIVPFIDK

SEQ ID NO: 9049 - DNA, 747 bp, Escherichia coli
atggctgattgggtaacaggcaaagtcactaaagtgcagaactggaccgacgccctgtttagtctcaccgttcacgctcccgtgcttccgtttaccgccgggcaattcaccaaacttggccttgaaattgaaggcgaacgcgttcagcgcgcctactcctatgttaactcgcccgataatccggatctggagttttacctggtcaccgtccccgatggcaaattaagtccacgactggcggcactgaaaccgggcgatgaagtgcaggtggttagcgaagccgctggcttctttgtgctggatgaagtaccagattgcgaaacgctatggatgctggcaaccggtacagcgattggcccttatttatcgattctgcaattgggcaaagatttagaacgcttcaaaaacatggtgctggttcacgccgcacgatatgccgccgacttaagctatctacctctgatgcaggaactggaaaaacgctacgaggggaaactgcgcattcagacggtggtcagtcgggaaacggctgcgggttcgctcactgggcgattaccggcgttaattgaaagtggtgaactggaaagcgcggttggcctgccgataaataaagaaaccagccatgtgatgctgtgcggcaatccacagatggtgcgcgatacacaacagttgctgaaggagacccggcagatgacgaaacatttacgtcgccgaccgggccatatgacagcggagcattactggtaa

SEQ ID NO: 9050 - protein, 248 aa, Escherichia coli
MADWVTGKVTKVQNWTDALFSLTVHAPVLPFTAGQFTKLGLEIEGERVQRAYSYVNSPDNPDLEFYLVTVPDGKLSPRLAALKPGDEVQVVSEAAGFFVLDEVPDCETLWMLATGTAIGPYLSILQLGKDLERFKNMVLVHAARYAADLSYLPLMQELEKRYEGKLRIQTVVSRETAAGSLTGRLPALIESGELESAVGLPINKETSHVMLCGNPQMVRDTQQLLKETRQMTKHLRRRPGHMTAEHYW

SEQ ID NO: 9051 - DNA, 1011 bp, Escherichia coli
atgagacgagaacttgccatcgaattttcccgcgtcaccgaatcagcagcgctggctggctacaaatggttaggacgcggcgataaaaacaccgcggacggcgcggcggtaaacgccatgcgtattatgctcaaccaggtcaacattgacggcaccatcgttattggtgaaggtgaaatcgacgaagcaccgatgctctacattggtgaaaaagtcggtactggtcgcggcgacgcggtagatattgctgttgatccgattgaaggcacgcgcatgacagcgatgggccaggctaacgcgctggcggtgctggcagtaggcgataaaggctgcttcctcaacgcgccagatatgtatatggagaagctgatcgtcggaccgggagccaaaggcaccattgatctgaacctgccgctggcggataacctgcgcaatgttgcggcggcgctcggcaaaccgttgagcgaactgacggtaacgattctggcaaaaccgcgccacgatgccgttatcgcagaaatgcagcaactcggcgtgcgcgtatttgctattccggacggcgacgttgcagcctcaattctcacctgtatgccagacagcgaagttgacgtgctgtacggtattggtggcgcgccggaaggcgtggtttctgcggcggtgatccgcgcattagatggtgacatgaacggtcgtctgctggcgcgtcatgacgtcaaaggcgacaacgaagagaatcgtcgcattggcgagcaggagctggcacgctgcaaagcgatgggcatcgaagccggtaaagtattgcgtttgggcgatatggcgcgcagcgacaacgtcatcttttctgccaccggcatcaccaaaggtgatctgctggaaggtattagccgcaaaggcaatatcgccaccaccgaaacgctgctgatccgtggtaaatcacgcaccattcgtcgcattcagtccatccactatctggatcgtaaagacccggaaatgcaggtgcacatcctctga

SEQ ID NO: 9052 - protein, 336 aa, Escherichia coli
MRRELAIEFSRVTESAALAGYKWLGRGDKNTADGAAVNAMRIMLNQVNIDGTIVIGEGEIDEAPMLYIGEKVGTGRGDAVDIAVDPIEGTRMTAMGQANALAVLAVGDKGCFLNAPDMYMEKLIVGPGAKGTIDLNLPLADNLRNVAAALGKPLSELTVTILAKPRHDAVIAEMQQLGVRVFAIPDGDVAASILTCMPDSEVDVLYGIGGAPEGVVSAAVIRALDGDMNGRLLARHDVKGDNEENRRIGEQELARCKAMGIEAGKVLRLGDMARSDNVIFSATGITKGDLLEGISRKGNIATTETLLIRGKSRTIRRIQSIHYLDRKDPEMQVHIL

SEQ ID NO: 9053 - DNA, 1530 bp, Escherichia coli
atgactacgggacaattaaacatgactgaaaaaaaatatatcgttgcgctcgaccagggcaccaccagctcccgcgcggtcgtaatggatcacgatgccaatatcattagcgtgtcgcagcgcgaatttgagcaaatctacccaaaaccaggctgggtagaacacgacccaatggaaatctgggccacccaaagctccacgctggtagaagtgctggcgaaagccgatatcagttccgatcagattgcagctatcggtattacgaaccagcgtgaaaccactattgtctgggaaaaagaaaccggcaagcctatctataacgccattgtctggcagtgccgtcgtaccgcagaaatctgcgagcatttaaaacgtgacggtttagaagattatatccgcagcaataccggtctggtgattgacccgtatttctctggcaccaaagtgaagtggatcctcgaccatgtggaaggctctcgcgagcgtgcgcgtcgtggtgaattgctgtttggtacggttgatacgtggcttatctggaaaatgactcagggccgtgtccatgtgaccgattacaccaacgcctctcgtaccatgttgttcaacatccataccctggactgggacgacaaaatgctggaggtgctggatattccgcgtgagatgctgccagaagtgcgtcgttcttccgaagtatacggtcagactaacattggcggcaaaggcggcacgcgtattccaatctccgggatcgccggtgaccagcaggccgcgctgtttggtcagttgtgcgtgaaagaagggatggcgaagaatacctacggcactggctgctttatgctgatgaacaccggcgagaaagcggtgaaatcagaaaacggcctgctgaccaccatcgcctgcggcccgactggcgaagtgaactatgcgctggaaggtgcagtgtttatggcgggcgcgtccattcagtggctgcgcgatgagatgaagttgattaacgacgcctacgattccgaatatttcgccaccaaagtgcaaaacaccaatggtgtgtatgtggttccggcctttaccgggctgggtgcgccatactgggatccgtatgcacgcggggcgattttcggtctgactcgtggggtgaacgctaaccacattatacgcgcgacgctggagtctattgcttatcagacgcgtgacgtgctggaagcaatgcaggccgactccggtattcgtctgcacgcgctgcgcgtggacggcggtgcggtggcgaacaatttcctgatgcagttccagtccgatattctcggtacgcgcgttgagcgcccggaagtgcgcgaagtcaccgctttgggtgcggcctatcttgctggtctggcggttggcttctggcagaatcttgacgagctgcaagagaaagcggtgattgaacgcgagttccgtccaggcatcgaaaccactgagcgtaattaccgttacgcaggctggaaaaaagcggtcaaacgcgcgatggcatgggaagaacacgacgagtaa

SEQ ID NO: 9054 - protein, 509 aa, Escherichia coli
MTTGQLNMTEKKYIVALDQGTTSSRAVVMDHDANIISVSQREFEQIYPKPGWVEHDPMEIWATQSSTLVEVLAKADISSDQIAAIGITNQRETTIVWEKETGKPIYNAIVWQCRRTAEICEHLKRDGLEDYIRSNTGLVIDPYFSGTKVKWILDHVEGSRERARRGELLFGTVDTWLIWKMTQGRVHVTDYTNASRTMLFNIHTLDWDDKMLEVLDIPREMLPEVRRSSEVYGQTNIGGKGGTRIPISGIAGDQQAALFGQLCVKEGMAKNTYGTGCFMLMNTGEKAVKSENGLLTTIACGPTGEVNYALEGAVFMAGASIQWLRDEMKLINDAYDSEYFATKVQNTNGVYVVPAFTGLGAPYWDPYARGAIFGLTRGVNANHIIRATLESIAYQTRDVLEAMQADSGIRLHALRVDGGAVANNFLMQFQSDILGTRVERPEVREVTALGAAYLAGLAVGFWQNLDELQEKAVIEREFRPGIETTERNYRYAGWKKAVKRAMAWEEHDE

SEQ ID NO: 9055 - DNA, 846 bp, Escherichia coli
atgagtcaaacatcaaccttgaaaggccagtgcattgctgaattcctcggtaccgggttgttgatttttttcggtgtgggttgcgttgcagcactaaaagtcgcaggtgcgtcttttggtcagtgggaaatcagtgtcatttggggactgggggtggcaatggccatctacctgaccgcaggggtttccggcgcgcatcttaatcccgctgttaccattgcattgtggctgtttgcctgtttcgacaagcgcaaagttattccttttatcgtttcacaagttgccggcgctttctgtgctgcggctttagtatacgggctttactacaatttatttttcgacttcgagcagactcatcacattgttcgcggcagcgttgaaagtgttgatctggctggcactttctctacttaccctaatcctcatatcaattttgtgcaggctttcgcagttgagatggtgattaccgctattctgatggggctgatcctggcgttaacggacgatggcaacggtgtaccacgcggccctttggctcccttgctgattggtctactgattgcggtcattggcgcatctatgggcccattgacgggctttgccatgaacccagcgcgtgacttcggtccgaaagtctttgcctggctggcgggctggggcaatgtcgcctttaccggcggcagagacattccttacttcctggtgccgctttttggccctatcgttggcgcgattgtaggtgcatttgcctaccgcaaactgattggtcgccatttgccttgcgatatctgtgttgtggaagaaaaggagaccacaactccttcagaacaaaaagcttcgctgtaa

SEQ ID NO: 9056 - protein, 281 aa, Escherichia coli
MSQTSTLKGQCIAEFLGTGLLIFFGVGCVAALKVAGASFGQWEISVIWGLGVAMAIYLTAGVSGAHLNPAVTIALWLFACFDKRKVIPFIVSQVAGAFCAAALVYGLYYNLFFDFEQTHHIVRGSVESVDLAGTFSTYPNPHINFVQAFAVEMVITAILMGLILALTDDGNGVPRGPLAPLLIGLLIAVIGASMGPLTGFAMNPARDFGPKVFAWLAGWGNVAFTGGRDIPYFLVPLFGPIVGAIVGAFAYRKLIGRHLPCDICVVEEKETTTPSEQKASL

SEQ ID NO: 9057 - DNA, 240 bp, Escherichia coli
atgtcattagaagtgtttgagaaactggaagcaaaagtacagcaggcgattgataccatcactctgttgcagatggaaatcgaagagctgaaagaaaaaaacaactcactgtcgcaggaagttcaaaatgcccagcatcagcgcgaagagctggagcgtgagaacaaccatctgaaagaacagcagaacggctggcaggaacgtctacaggccctgctgggtcgcatggaagaggtctga

SEQ ID NO: 9058 - protein, 79 aa, Escherichia coli
MSLEVFEKLEAKVQQAIDTITLLQMEIEELKEKNNSLSQEVQNAQHQREELERENNHLKEQQNGWQERLQALLGRMEEV

SEQ ID NO: 9059 - DNA, 486 bp, Escherichia coli
atgaaatacgatacttccgagctttgtgacatctatcaagaagatgttaacgtcgtggaaccgctgttctccaactttggcggacgggcgtcgtttggcggacaaataatcacggtaaaatgtttcgaggacaacgggttgctgtacgatctgctcgaacagaatggccgtggtcgtgttcttgtcgtcgatggcggaggttctgttcgtcgcgcactggtcgatgctgaactggcgcgtctggcagtacaaaatgaatgggaaggtctggtcatttacggcgcggtgcgtcaggtagatgacctggaagagttggatatcggcatccaggcgatggcggcaattccggttggtgccgctggcgaaggcattggcgaaagcgatgtccgcgtcaattttggcggtgtcaccttcttctccggcgaccatctttatgccgacaataccgggattattctttcagaagatccgctggatattgaatga

SEQ ID NO: 9060 - protein, 161 aa, Escherichia coli
MKYDTSELCDIYQEDVNVVEPLFSNFGGRASFGGQIITVKCFEDNGLLYDLLEQNGRGRVLVVDGGGSVRRALVDAELARLAVQNEWEGLVIYGAVRQVDDLEELDIGIQAMAAIPVGAAGEGIGESDVRVNFGGVTFFSGDHLYADNTGIILSEDPLDIE

SEQ ID NO: 9061 - DNA, 939 bp, Escherichia coli
ttggcgcgtattatgactgaacaacaaattagccgaactcaggcgtggctggaaagtttacgacctaaaaccctccccctcgcctttgctgcaattatcgtcgggacggcgctggcatggtggcaaggtcacttcgatccactggtcgccctgctggcattgattaccgccgggctattacagatcctttctaacctcgccaatgattacggcgatgcggtaaaaggcagcgataaacctgaccgcattgggccgctacgcggcatgcaaaaaggggtcattacccagcaagagatgaaacgggcgctcattattaccgttgtgctcatctgtctttccgggctggcactggttgcagtggcgtgccatacgctggccgattttgtcggtttcctgattcttggcgggttgtcgatcattgccgctatcacctacaccgtgggcaatcgtccttatggttatatcggtttgggtgatatttccgtactggttttctttggctggttgagcgtcatggggagctggtatttacaggctcatacattgattccggcactgatccttccggcaaccgcatgcggcctgctggcaacggcagtactgaacattaataacctgcgtgatatcaatagcgaccgcgaaaacggcaaaaacacgctggtggtgcgcttaggcgcagtaaacgcgcgtcgttatcatgcctgcctgctgatgggctcactggtgtgtctggcgctgtttaatctcttttcgctgcatagcctgtggggctggctgttcctgctggcggcaccgttgctggtgaagcaagctcgttatgtgatgcgcgaaatggacccggtggcgatgcgaccaatgctggaacgcactgtcaaaggagcgttactgactaacctgctgtttgttttagggatattcctaagccagtgggcagcataa

SEQ ID NO: 9062 - protein, 312 aa, Escherichia coli
MARIMTEQQISRTQAWLESLRPKTLPLAFAAIIVGTALAWWQGHFDPLVALLALITAGLLQILSNLANDYGDAVKGSDKPDRIGPLRGMQKGVITQQEMKRALIITVVLICLSGLALVAVACHTLADFVGFLILGGLSIIAAITYTVGNRPYGYIGLGDISVLVFFGWLSVMGSWYLQAHTLIPALILPATACGLLATAVLNINNLRDINSDRENGKNTLVVRLGAVNARRYHACLLMGSLVCLALFNLFSLHSLWGWLFLLAAPLLVKQARYVMREMDPVAMRPMLERTVKGALLTNLLFVLGIFLSQWAA

SEQ ID NO: 9063 - DNA, 1332 bp, Escherichia coli
atgtctgaaatgaccccacgcgaaatcgtcagcgaactggataagcacatcatcggccaggacaacgccaagcgttccgtggcgattgctctgcgtaaccgctggcgtcgcatgcagctcaacgaagagctgcgccatgaagtgaccccgaaaaatatcctgatgatcggcccgaccggtgtcggtaaaactgaaatcgcccgtcgtctggctaagctggcgaatgcgccgttcatcaaagttgaagcgaccaaattcaccgaagtgggctatgtcggtaaggaagtggattctattattcgcgatctgaccgatgccgccgtgaaaatggtacgcgtccaggctatcgagaaaaaccgttatcgcgctgaagaactggcagaagaacgtattctcgacgtactgatcccaccggctaaaaacaactggggacagaccgaacagcagcaggaaccgtccgctgctcgtcaggcattccgcaaaaaactgcgtgaaggccagcttgatgacaaagaaatcgagatcgatcttgccgcagcaccgatgggcgttgaaattatggctcctccgggcatggaagagatgaccagccagctgcagtccatgttccagaacctgggcggtcagaaacaaaaagcgcgtaagctgaaaatcaaagacgccatgaagctgctgattgaagaagaagcggcgaaactggtgaacccggaagagctgaagcaagatgctatcgacgctgttgagcagcacgggatcgtgtttatcgacgaaatcgacaaaatctgtaagcgcggcgagtcttccggtccggatgtttctcgtgaaggcgttcagcgtgacctgctgccgctggtagaaggttgcactgtttccaccaaacatgggatggtcaaaactgaccacattctgtttatcgcttctggcgcgttccagattgcgaaaccgtctgacctgatcccggaactgcaaggtcgtctgccaatccgcgttgagctgcaggcactgaccaccagcgacttcgagcgtattctgaccgagccgaatgcctctatcactgtgcagtacaaagcactgatggcaactgaaggcgtaaatatcgagtttaccgactccggtattaagcgcatcgcggaagcggcatggcaggtgaacgaatctaccgaaaacatcggtgctcgtcgtttacataccgttctggagcgtttaatggaagagatttcctacgacgccagcgatttaagcggtcaaactatcactattgacgcagattatgtgagcaaacatctggatgcgttggtggcagatgaagatctgagccgttttatcctataa

SEQ ID NO: 9064 - protein, 443 aa, Escherichia coli
MSEMTPREIVSELDKHIIGQDNAKRSVAIALRNRWRRMQLNEELRHEVTPKNILMIGPTGVGKTEIARRLAKLANAPFIKVEATKFTEVGYVGKEVDSIIRDLTDAAVKMVRVQAIEKNRYRAEELAEERILDVLIPPAKNNWGQTEQQQEPSAARQAFRKKLREGQLDDKEIEIDLAAAPMGVEIMAPPGMEEMTSQLQSMFQNLGGQKQKARKLKIKDAMKLLIEEEAAKLVNPEELKQDAIDAVEQHGIVFIDEIDKICKRGESSGPDVSREGVQRDLLPLVEGCTVSTKHGMVKTDHILFIASGAFQIAKPSDLIPELQGRLPIRVELQALTTSDFERILTEPNASITVQYKALMATEGVNIEFTDSGIKRIAEAAWQVNESTENIGARRLHTVLERLMEEISYDASDLSGQTITIDADYVSKHLDALVADEDLSRFIL

SEQ ID NO: 9065 - DNA, 531 bp, Escherichia coli
gtgacaactatagtaagcgtacgccgtaacggccatgtggtcatcgctggtgatggtcaggccacgttgggcaataccgtaatgaaaggcaacgtgaaaaaggtccgccgtctgtacaacgacaaagtcatcgcgggctttgcgggcggtactgcggatgcttttacgctgttcgaactgtttgaacgtaaactggaaatgcatcagggccatctgatcaaagccgccgttgagctggcgaaagactggcgtaccgatcgcatgctgcgcaaacttgaagcattgctggcagtcgcggatgaaactgcatcgcttatcatcaccggtaacggtgacgtggtgcagccagaaaacgatcttattgctatcggctccggcggcccttacgcccaggctgcggcgcgcgcgctgttagaaaacactgaacttagcgcccgtgaaattgctgaaaaggcgttggatattgcaggcgacatttgcatctataccaaccatttccacaccatcgaagaattaagctacaaagcgtaa

SEQ ID NO: 9066 - protein, 176 aa, Escherichia coli
MTTIVSVRRNGHVVIAGDGQATLGNTVMKGNVKKVRRLYNDKVIAGFAGGTADAFTLFELFERKLEMHQGHLIKAAVELAKDWRTDRMLRKLEALLAVADETASLIITGNGDVVQPENDLIAIGSGGPYAQAAARALLENTELSAREIAEKALDIAGDICIYTNHFHTIEELSYKA

SEQ ID NO: 9067 - DNA, 960 bp, Escherichia coli
gtggcacaacgagattatgtacgccgcagccaaccggcaccttcgcggcgaaaaaagagcacctcacggaaaaagcaacgaaatctgcctgcggtttctcccgctatggtcgctattgctgccgccgttcttgtgacctttatcggtggtctgtacttcattacgcatcacaagaaagaagagtccgagacgctgcaaagccagaaagtgaccggaaacggactaccaccaaaaccagaagaacgctggcgctacatcaaagagctggaaagtcgccagccgggtgtgcgtgcgcccacagaaccttctgctggtggtgaagtgaaaacgccggagcaactgacaccagaacaacgtcagcttcttgaacaaatgcaggctgatatgcgccagcagccaacgcagctggttgaagttccgtggaatgagcagacgccggaacagcgtcagcaaacgctacagcgccagcgtcaggcgcagcaattagcggagcagcaacgcctggctcagcagtcgcgtacgactgaacaaagctggcagcagcagacgcgtacgtcgcaagccgcaccggtacaggcgcaaccgcgccagtctaaaccggcttctactcagcagccttaccaggatctgctgcaaacccctgcgcacacgaccgcgcagtcgaagccgcagcaagctgcgccggttgctcgtgccgctgacgcgccaaaaccgacggcggagaaaaaagacgaacgccgctggatggtgcagtgcggttcgttcagaggcgcggaacaggcagagacggtacgtgctcagctggcgttcgaaggctttgactcaaaaattaccaccaacaatggctggaatcgtgtggtgattggcccggtgaaaggcaaagagaacgcagacagcaccctcaatcgcttgaagatggcgggtcatacaaactgcattcggctcgccgccgggggttga

SEQ ID NO: 9068 - protein, 319 aa, Escherichia coli
MAQRDYVRRSQPAPSRRKKSTSRKKQRNLPAVSPAMVAIAAAVLVTFIGGLYFITHHKKEESETLQSQKVTGNGLPPKPEERWRYIKELESRQPGVRAPTEPSAGGEVKTPEQLTPEQRQLLEQMQADMRQQPTQLVEVPWNEQTPEQRQQTLQRQRQAQQLAEQQRLAQQSRTTEQSWQQQTRTSQAAPVQAQPRQSKPASTQQPYQDLLQTPAHTTAQSKPQQAAPVARAADAPKPTAEKKDERRWMVQCGSFRGAEQAETVRAQLAFEGFDSKITTNNGWNRVVIGPVKGKENADSTLNRLKMAGHTNCIRLAAGG

SEQ ID NO: 9069 - DNA, 993 bp, Escherichia coli
atgaaagacgttgccctcaaggcaaaagtctctacagcgaccgtctcccgagcattaatgaatcccgataaagtctcccaggccactcgtaatcgggttgaaaaagcggcccgggaagtgggttatttaccacagcctatggggcgcaacgtcaagcgtaatgaatcccgcactattctggtgattgtcccggatatctgcgaccctttctttagcgaaattattcgcggtatcgaagttacggcggcaaatcacggatatctggtgctgattggcgactgtgcgcatcaaaatcagcaggaaaaaacctttatcgatttgatcatcaccaagcaaattgatggcatgttgctgctgggttcaaggctgccgtttgatgccagcattgaggaacagcgtaatctgccgccgatggtgatggcgaacgaatttgcaccggaactggagctacctacagttcatatagacaatctgaccgccgcatttgatgcagtaaattatctatatgagcaagggcataaacggattggctgtatagccggtcctgaagagatgccgctgtgtcactaccgcctgcaaggctacgttcaggcgctgcgtcgctgcggcattatggttgatccgcaatacatcgcccgtggcgacttcaccttcgaagccggaagcaaagcgatgcagcagttgcttgatcttccacaaccgcctactgctgtcttctgccatagcgatgtgatggcgctcggcgcactttctcaggcaaaacgccaggggctgaaagtcccggaagacctttccataatcggttttgataacatcgacctgacgcaattttgtgatccgccgctgacaaccatcgcgcagccgcgttacgaaatcggtcgggaagctatgctgttattgcttgatcaaatgcaggggcaacacgttggcagtggctctcgtttaatggactgcgaacttatcatccggggatcaacacgcgcgttaccttaa

SEQ ID NO: 9070 - protein, 330 aa, Escherichia coli
MKDVALKAKVSTATVSRALMNPDKVSQATRNRVEKAAREVGYLPQPMGRNVKRNESRTILVIVPDICDPFFSEIIRGIEVTAANHGYLVLIGDCAHQNQQEKTFIDLIITKQIDGMLLLGSRLPFDASIEEQRNLPPMVMANEFAPELELPTVHIDNLTAAFDAVNYLYEQGHKRIGCIAGPEEMPLCHYRLQGYVQALRRCGIMVDPQYIARGDFTFEAGSKAMQQLLDLPQPPTAVFCHSDVMALGALSQAKRQGLKVPEDLSIIGFDNIDLTQFCDPPLTTIAQPRYEIGREAMLLLLDQMQGQHVGSGSRLMDCELIIRGSTRALP

SEQ ID NO: 9071 - DNA, 2271 bp, Escherichia coli
atgcaaactgatccgcactcttctacggcaatgtgtatactaacccaccgaatttcaagtcaggatgatgctatgcccgttgcccacgttgccttgcccgttccgcttcctcgtacctttgactatctgctgccagaaggcatgacggttaaagccgggagtcgcgtgcgcgtgccgtttggcaaacaacaggagcgtatcggggttgtggtgtcagtgagcgatgtcagtgagctgccgcttaacgagctgaaagcggtagttgaagtgctggacgttgagccggtatttactcactctgtctggcgattactgctctgggcggcagattactatcatcatccgattggcgatgtgctgtttcatgccttgccgattttactgcgccaggggcggcctgcggcgaacgcgccgatgtggtactggtttgccactgaacaaggtcaggcggtggatctgaacagcctgaaacgttcgccaaagcaacaacaggcgctggcagcgttacggcaacgcaaaatctggcgtgatcaggtcgcggaacttgaatttaatgatgccgcgttgcaggcactgcgcaaaaaaggtctgtgtgatttagcaagtgaaacaccagagtttagcgactggcgaacgaactatgccgtttctggtgagcggttgcggttgaataccgaacaggccaccgccgttggcgcaattcatagcgcggcagatactttttctgcctggctgctggcgggcgttaccggttccggtaaaacggaggtttatctcagtgtactggaaaacgtgctcgctcagggcaaacaggcgctggtgatggtgccggaaatcggcctgacaccgcaaactatcgcccgttttcgtgaacgttttaatgccccggtggaagttctgcattccggcctgaacgacagcgagcgtctttcggcgtggttgaaagcgaaaaatggcgaggcggcgattgtcatcggcacccgctccgcgctgtttacgccgtttaaaaatctcggcgtgattgttattgatgaagagcacgacagctcctacaagcagcaggaaggctggcgctatcatgcccgcgacctggcggtgtatcgcgcgcatagcgagcaaatcccaattattcttggctccgcaacgcccgcactggaaacgttatgcaacgtgcagcagaaaaaataccgcctgctgcgcctgacccgtcgggcgggcaatgcgcgcccggcaattcaacatgtgctggatttaaaaggtcagaaggtgcaggcaggtctggctccggcgttaatcacccgtatgcgccagcatttacaggccgacaaccaggttatcctctttcttaaccgccggggttttgcgcctgcgctactgtgccacgactgtggttggatagccgaatgcccacgttgcgatcactactacacgctgcatcaggcgcaacagcatttgcgctgccaccattgcgacagtcagcgtccggtgccgcgccagtgcccttcttgcggttccacgcacctggtccccgtggggctgggcaccgaacagcttgaacagacgctcgcgccgttgttccctggtgtccccatttctcgtatcgaccgcgataccaccagccgcaaaggggcgctggaacaacaactggcggaagtacatcgcggtggcgcgaggattttgattggcacgcaaatgctggcgaaaggtcaccactttccggatgtgacgctggtggcattactggacgtggacggcgcgctgttttctgccgatttccgctcggcggagcgttttgcccagctttacacccaagtggcaggccgtgccggacgtgccggtaaacagggcgaagtagttctgcaaacgcaccatcctgaacatccgctgttgcaaacgttgctctataaaggctacgacgcctttgccgaacaggcactggctgaacgacgcatgatgcagctgccgccgtggaccagccatgtgattgtgcgtgcggaagatcataacaatcagcacgcgccattgttcctgcaacaactgcgtaatctcattctcgccagcccactggcagacgagaaactgtgggttctcggtccggttccggcgctggcccctaaacgtggcggtcgctggcgctggcagatattgttgcagcacccttcccgcgtgcgcttacagcacatcatcaatggtacgctggcgcttattaatacaataccggattcccgcaaggtgaaatgggtgctggatgtcgatccgattgagggttaa

SEQ ID NO: 9072 - protein, 756 aa, Escherichia coli
MQTDPHSSTAMCILTHRISSQDDAMPVAHVALPVPLPRTFDYLLPEGMTVKAGSRVRVPFGKQQERIGVVVSVSDVSELPLNELKAVVEVLDVEPVFTHSVWRLLLWAADYYHHPIGDVLFHALPILLRQGRPAANAPMWYWFATEQGQAVDLNSLKRSPKQQQALAALRQRKIWRDQVAELEFNDAALQALRKKGLCDLASETPEFSDWRTNYAVSGERLRLNTEQATAVGAIHSAADTFSAWLLAGVTGSGKTEVYLSVLENVLAQGKQALVMVPEIGLTPQTIARFRERFNAPVEVLHSGLNDSERLSAWLKAKNGEAAIVIGTRSALFTPFKNLGVIVIDEEHDSSYKQQEGWRYHARDLAVYRAHSEQIPIILGSATPALETLCNVQQKKYRLLRLTRRAGNARPAIQHVLDLKGQKVQAGLAPALITRMRQHLQADNQVILFLNRRGFAPALLCHDCGWIAECPRCDHYYTLHQAQQHLRCHHCDSQRPVPRQCPSCGSTHLVPVGLGTEQLEQTLAPLFPGVPISRIDRDTTSRKGALEQQLAEVHRGGARILIGTQMLAKGHHFPDVTLVALLDVDGALFSADFRSAERFAQLYTQVAGRAGRAGKQGEVVLQTHHPEHPLLQTLLYKGYDAFAEQALAERRMMQLPPWTSHVIVRAEDHNNQHAPLFLQQLRNLILASPLADEKLWVLGPVPALAPKRGGRWRWQILLQHPSRVRLQHIINGTLALINTIPDSRKVKWVLDVDPIEG

SEQ ID NO: 9073 - DNA, 213 bp, Escherichia coli
atgaaaaaagatattcacccgaaatacgaagaaattactgctagctgctcttgcggtaacgtaatgaaaatccgctccaccgttggtcatgacctgaacctcgacgtgtgcagcaagtgccacccgttcttcactggcaaacagcgtgatgttgctaccggtggccgtgttgaccgcttcaacaagcgtttcaacatcccgggcagcaaataa

SEQ ID NO: 9074 - protein, 70 aa, Escherichia coli
MKKDIHPKYEEITASCSCGNVMKIRSTVGHDLNLDVCSKCHPFFTGKQRDVATGGRVDRFNKRFNIPGSK

SEQ ID NO: 9075 - DNA, 609 bp, Escherichia coli
atgaaaatcaggctactgatccccggcctgctggtttctgtgcctgcatttgcctggcaaccacaaaccggcgacatcatctttcaggtctctcgctcatcgcaaagtaaagcgatccaactggcgacccattccgattacagccacaccggtatgctggtgatacgcaacaaaaagccctacgtttttgaagcggtcggcccggtgaaatacaccccgctcaagcagtggattgcccatggtgaaaagggcaaatacgttgttcgccgcgttgaaggcggactgagtgttgaacaacagcaaaaactggcgcaaacggcaaaacgttatctcggcaaaccgtacgatttcagcttctcgtggagcgacgatcgccagtactgttcggaagtggtgtggaaggtttatcagaatgcgctgggaatgcgcgtaggcgaacagcagaagttgaaagagttcgatctcagcaacccgctggtccaggcgaagctcaaagaacgctacggcaaaaatattccgcttgaggaaacggtagtttcaccccaagccgttttcgacgcgccacaactcaccacggtcgccaaagaatggccgctgttttcctggtaa

SEQ ID NO: 9076 - protein, 202 aa, Escherichia coli
MKIRLLIPGLLVSVPAFAWQPQTGDIIFQVSRSSQSKAIQLATHSDYSHTGMLVIRNKKPYVFEAVGPVKYTPLKQWIAHGEKGKYVVRRVEGGLSVEQQQKLAQTAKRYLGKPYDFSFSWSDDRQYCSEVVWKVYQNALGMRVGEQQKLKEFDLSNPLVQAKLKERYGKNIPLEETVVSPQAVFDAPQLTTVAKEWPLFSW

SEQ ID NO: 9077 - DNA, 456 bp, Escherichia coli
atgcattatcacgccgacaggtgcattacacgatgtcacggtaacgcctgtacggtaaactatgcgggtttacggtcagtacccacattcactgtgtggtctggtctcaatttattgacgaagaggattaagtatctcatggctgaatggagcggcgaatatatcagcccatacgctgagcacggcaagaagagtgaacaagtcaaaaaaattacggtttccattcctcttaaggtgttaaaaatcctcaccgatgaacgcacgcgtcgtcaggtgaacaacctgcgtcacgcgaccaacagcgagctgctgtgcgaagcgtttctgcatgcctttaccgggcaacctctgccggatgatgccgatctgcgtaaagagcgcagcgacgaaatcccggaagcggcaaaagagatcatgcgtgagatggggattaacccggagacgtgggaatactaa

SEQ ID NO: 9078 - protein, 151 aa, Escherichia coli
MHYHADRCITRCHGNACTVNYAGLRSVPTFTVWSGLNLLTKRIKYLMAEWSGEYISPYAEHGKKSEQVKKITVSIPLKVLKILTDERTRRQVNNLRHATNSELLCEAFLHAFTGQPLPDDADLRKERSDEIPEAAKEIMREMGINPETWEY

SEQ ID NO: 9079 - DNA, 1275 bp, Escherichia coli
ttgctcaatctatacgcaaagaagtttagatgtccagatgtattgacgtccattaacgcaatgtttactctggtgcctgacatttcaccgaccaagcccagggaacttcatcacatgacgcgtaaacaggccaccatcgcagtgcgtagcgggttaaatgacgacgaacagtatggttgcgttgtccctcccatccatctttccagtacctataactttaccggatttaatgaaccgcgtgcgcatgattactcgcggcgcggcaacccaacgcgcgatgtggttcagcgtgcgctggcagaactggaaggcggtgctggtgccgtacttactaataccggcatgtccgcgattcacctggtaacgaccgtctttttgaaacctggcgatctgctggttgcgccgcacgactgctacggcggtagctatcgcctgttcgacagcctggcgaaacgcggttgctatcgcgtgttgtttgttgatcaaggcgatgaacaggcattacgggcagcgctggcagaaaaccccaaactggtactggtagaaagcccaagtaatccattgttacgcgtcgtggatattgcgaaaatctgccatctggcaagggaagtcggggcggtgagcgtggtggataacaccttcttaagcccggcattacaaaatccactggcattaggtgccgatctggtgttgcattcatgcacgaaatatctgaacggtcactctgacgtggtggcaggcgtagtgattgctaaagacccggacgttgtcactgaacttgcctggtgggcaaacaatattggcgtgacgggcggcgcgtttgacagctatctgctgctgcgcgggttgcgaacgctggtgccgcgaatggagctggcccagcgcaacgcgcaggcgattgtgaaatatctgcaaacccagccgttggtgaaaaaactgtatcacccgtcgctgccggaaaatcaggggcatgaaattgccgcgcgccagcaaaaaggctttggcgcaatgttgagttttgaactggatggcgatgagcacacgctgcgtcgtttcctgggcgagctgtcgttgtttacgctggcggaatcattagggggagtggaaagtttaatctctcacgccgcaaccatgacacatgcaggcatggcgccagaagcgcgtgctgccgccgggatctccgagacgctgctgcgtatctccaccggtattgaagatggcgaagatttaattgccgacctggaaaatggcttccgggctgcaaacaaggggtaa

SEQ ID NO: 9080 - protein, 424 aa, Escherichia coli
MLNLYAKKFRCPDVLTSINAMFTLVPDISPTKPRELHHMTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAENPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEHTLRRFLGELSLFTLAESLGGVESLISHAATMTHAGMAPEARAAAGISETLLRISTGIEDGEDLIADLENGFRAANKG

SEQ ID NO: 9081 - DNA, 2433 bp, Escherichia coli
atgagtgtgattgcgcaggcaggggcgaaaggtcgtcaactgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacattacgtcgttatcagtgcgatctgattagcggcctgctacccgccgaagaagccgataacctcattagcgcttttgtcagcgatcttgagcacctggctgcgttgctcgacagcggtattaacgatgcggtgtatgcggaagtggtgggccacggtgaagtgtggtcggcgcgcctgatgtctgcggtgcttaatcaacaagggctgccagcggcctggcttgatgcccgcgagtttttacgcgctgaacgcgctgcgcaaccgcaggttgatgaagggctttcgtacccgttgctgcaacagctactggtacaacatccgggcaaacgtctggtggtgaccgggtttatcagccgtaacaacgccggtgaaacggtgctgcttgggcgtaacggttccgactattccgcgacacaaatcggtgcgctggcgggtgtttctcgcgtaaccatttggagcgacgtcgccggggtatatagcgccgacccgcgtaaagtgaaagatgcctgcctgctgccgttgctgcgtctggatgaagccagcgaactggcgcgtctggcggctcccgttcttcatgcccgtactttacagcccgtttctggcagcgaaatcgacctgcaactgcgctgtagctacacgccggatcaaggttccacgcgcattgaacgcgtgctggcctccggtactggtgcgcgtattgtcaccagccatgatgatgtctgcttgattgagtttcaggtgcccgccagccaggatttcaaactggcgcataaagagatcgaccagatcctgaaacgtgctcaggtgcgcccactggcggttggcgtgcataacgatcgccagttgctgcaattttgctacacctcagaagtggccgacagtgcgctgaaaatcctcgacgaagcgggattacctggcgaactgcgcctgcgtcaggggctagcgctggtggcgatggttggggcgggcgtcacccgtaacccgctgcattgccaccgcttctggcagcaactgaaaggccagccggtcgagtttacctggcagtctgatgatggcatcagcctggtggcagtactgcgcaccggcccgaccgaaagcctgattcaggggctgcatcagtccgtcttccgtgcggaaaaacgcatcggcctggtattgttcggcaagggcaatatcggttcccgctggctggaactgttcgcccgtgagcagagcacgctttcggcacgcaccggctttgaatttgtgctggcaggcgtggtggacagccgccgcagcctgttgagttatgacgggctggatgccagccgcgcgctagccttcttcaacgatgaagcggtcgagcaggatgaagagtcgctgttcctgtggatgcgcgcccatccgtatgatgatttagtggtgctggacgttaccgccagccagcagctcgctgaccagtatcttgatttcgccagccacggtttccacgtcatcagtgccaacaaactggcaggagcaagcgacagcaataaatatcgccagatccacgacgccttcgaaaaaaccgggcgtcactggctgtacaacgccaccgtcggtgcgggcttgccgatcaaccataccgtgcgcgatctgatcgacagcggcgataccattttgtcgatcagtgggatcttctctggcacgctctcctggctgttcctgcaattcgacggtagcgtgccgtttaccgaactggtggatcaggcgtggcagcagggcttaaccgagcctgacccgcgtgatgacctttccggcaaagacgtgatgcgcaagctggtgattctggcgcgtgaagcgggttacaacattgaatcggaccaggtacgtgttgaatcactggtacctgcccattgcgaaggcggcagcatcgaccatttctttgaaaatggcgatgaacttaacgagcagatggtgcaacgactggaagcggcccgcgaaatggggctggtgctgcgctacgtggcgcgtttcgatgccaacggcaaagcgcgtgtgggcgtggaagcggtgcgtgaagaccatccgctggcatcactactgccatgcgataacgtctttgccatcgaaagccgctggtatcgcgacaacccgctggtgatccgcgggccaggtgcagggcgcgacgtcacagccggggcgattcagtcggatattaaccgactggcgcagttgttgtag

SEQ ID NO: 9082 - protein, 810 aa, Escherichia coli
MSVIAQAGAKGRQLHKFGGSSLADVKCYLRVAGIMAEYSQPDDMMVVSAAGSTTNQLINWLKLSQTDRLSAHQVQQTLRRYQCDLISGLLPAEEADNLISAFVSDLEHLAALLDSGINDAVYAEVVGHGEVWSARLMSAVLNQQGLPAAWLDAREFLRAERAAQPQVDEGLSYPLLQQLLVQHPGKRLVVTGFISRNNAGETVLLGRNGSDYSATQIGALAGVSRVTIWSDVAGVYSADPRKVKDACLLPLLRLDEASELARLAAPVLHARTLQPVSGSEIDLQLRCSYTPDQGSTRIERVLASGTGARIVTSHDDVCLIEFQVPASQDFKLAHKEIDQILKRAQVRPLAVGVHNDRQLLQFCYTSEVADSALKILDEAGLPGELRLRQGLALVAMVGAGVTRNPLHCHRFWQQLKGQPVEFTWQSDDGISLVAVLRTGPTESLIQGLHQSVFRAEKRIGLVLFGKGNIGSRWLELFAREQSTLSARTGFEFVLAGVVDSRRSLLSYDGLDASRALAFFNDEAVEQDEESLFLWMRAHPYDDLVVLDVTASQQLADQYLDFASHGFHVISANKLAGASDSNKYRQIHDAFEKTGRHWLYNATVGAGLPINHTVRDLIDSGDTILSISGIFSGTLSWLFLQFDGSVPFTELVDQAWQQGLTEPDPRDDLSGKDVMRKLVILAREAGYNIESDQVRVESLVPAHCEGGSIDHFFENGDELNEQMVQRLEAAREMGLVLRYVARFDANGKARVGVEAVREDHPLASLLPCDNVFAIESRWYRDNPLVIRGPGAGRDVTAGAIQSDINRLAQLL

SEQ ID NO: 9083 - DNA, 861 bp, Escherichia coli
atgtatataaaaaagcactggatagctttatccattctattaataccttgcattggaaacgctcaggaaattaaaattgatgaaagctggttacatcaaagcttgaatgtcattggtcgcacagactctcgctttggcccaagactgactaacgacctctaccctgaatatactgtagcaggaagaaaagactggtttgatttttatggttatgttgatctaccgaaattctttggcgtcggcagtcactatgatgttgggatctgggatgagggctcaccactatttacggaaatagaacctcggttttccattgacaaattgaccggattaaatcttgcgttcggcccatttaaagaatggtttattgcaaacaactatgtctatgatatgggtgacaaccagtcatcccggcaaagtacatggtatatggggcttggtacagatatcgacacgggtctaccaattaagctttctgccaatatatacgccaagtatcagtggcaaaactatggtgccgctaatgaaaatgaatgggacggatatcgattcaaaataaaatatagcatccctcttacaaatttattcggaggacgattggtatacaatagttttactaactttgattttggctccgatcttgcggacaagtcacacaataataaacgaaccagtaatgctattgcttcaagccatatcctttcccttctatatgaacactggaaatttgcatttacactacgttattttcacaacggtggacaatggaatgcgggagagaaggttaacttcggagatggtccatttgaattaaaaaatacaggatggggaacctatactactattggttatcaattttaa

SEQ ID NO: 9084 - protein, 286 aa, Escherichia coli
MYIKKHWIALSILLIPCIGNAQEIKIDESWLHQSLNVIGRTDSRFGPRLTNDLYPEYTVAGRKDWFDFYGYVDLPKFFGVGSHYDVGIWDEGSPLFTEIEPRFSIDKLTGLNLAFGPFKEWFIANNYVYDMGDNQSSRQSTWYMGLGTDIDTGLPIKLSANIYAKYQWQNYGAANENEWDGYRFKIKYSIPLTNLFGGRLVYNSFTNFDFGSDLADKSHNNKRTSNAIASSHILSLLYEHWKFAFTLRYFHNGGQWNAGEKVNFGDGPFELKNTGWGTYTTIGYQF

SEQ ID NO: 9085 - DNA, 1620 bp, Escherichia coli
atgaaaacagcgcagcgtactttatttgccgcaacattgctgactattttttcgacctcagttatggcgcaggatgtcacgattatttataccaatgatcttcacgcccatgtggattcctataaagtaccgtatgtcgcagacggaaaacgcgacattggtggctttgccaatatatccacgttagtaaaacaagagaaagccaaaaataaagccaccttttattttgatgctggagactatttcaccgggccatatatcagtagcctgacaaagggcgaagcaataattgatattatgaataccatgccttttgacgcagtatcaatcggtaatcatgagtttgaccatggctgggataatgccctccgacaattaagcaaagcgaatttccctgttttattaggcaatgtttatcataaagagagtgagaaacccttctggaacaagccctacaccatcctggaaaaagatggcatcaagattggtattgttgggctacacggcgtatttgcatttaatgacactgtctcggagctctctctccagggactcgataatgacaataataaccgatttgataaatcttccgcgaccctcaagaatcaggggattgaagcacgtgatgaagtgaagtatttgcagcattatatcgacgagttacgtgataaggttgacctcaccgtggcgctggttcatgaaggcgtaccggcgcgtcagtccagcattggcaatacagatgttagacgtgcgctggataaagatattcaaaccgcaagcaaggtgaaaggattggatattctgattaccgggcatgcccacgtcggaacgccagaaccaatcaaagtcggcaacaccttaatcctttcgactgacagtggcggtatcgatattggtaaattaatccttgatgtcaaccctacagctcgtactcataaagtgaagagctttgagctgaaaacggtttatgccgatgaatggatacccgatccaaccacacaaaaagttatcaatagctggaataaaaaactggcggatcttgtacgccaaccagtcggtgaatcatcgattgcattaactcgtgcctacggtgagtcatcgcaacttggcaacctgtttaccgatgcaatgcttgtcgctgcaccgactgcacaaattgcgttgataaactccggcagtttacgtgctgatataaatgcaggcacgattacctttggtgacattaccagtacattccccttcaagaatgaacttactgaaatggatctcagcggtaaggatctgcgtaacctactggagcacggggcatcgcttaccaatggcatcctgcaaatgtcaaaaggcgcagaaatgcgctataccctgcagaaaccagtaggtcagcgcattgtatcttttaaaattaatggtgaagagatcgttgatacgaatatttaccatgttgcgactacgactttccttgcacttgggggcgatggttttctggcattcaaagaagggaaaaatgtccaggtccgcgccggaaataacatgtccaatgtcgtaatcgattattttaagaaaggccacaagattactcctgcacaggtaaatgaaatgcgggtagaagtaagcaaataa

SEQ ID NO: 9086 - protein, 539 aa, Escherichia coli
MKTAQRTLFAATLLTIFSTSVMAQDVTIIYTNDLHAHVDSYKVPYVADGKRDIGGFANISTLVKQEKAKNKATFYFDAGDYFTGPYISSLTKGEAIIDIMNTMPFDAVSIGNHEFDHGWDNALRQLSKANFPVLLGNVYHKESEKPFWNKPYTILEKDGIKIGIVGLHGVFAFNDTVSELSLQGLDNDNNNRFDKSSATLKNQGIEARDEVKYLQHYIDELRDKVDLTVALVHEGVPARQSSIGNTDVRRALDKDIQTASKVKGLDILITGHAHVGTPEPIKVGNTLILSTDSGGIDIGKLILDVNPTARTHKVKSFELKTVYADEWIPDPTTQKVINSWNKKLADLVRQPVGESSIALTRAYGESSQLGNLFTDAMLVAAPTAQIALINSGSLRADINAGTITFGDITSTFPFKNELTEMDLSGKDLRNLLEHGASLTNGILQMSKGAEMRYTLQKPVGQRIVSFKINGEEIVDTNIYHVATTTFLALGGDGFLAFKEGKNVQVRAGNNMSNVVIDYFKKGHKITPAQVNEMRVEVSK

SEQ ID NO: 9087 - DNA, 879 bp, Escherichia coli
atgtggagcggctactacaggcagatattgagacagctaaaaaaagtgaatggtgttgatgtcttaattaccggtcacgcacatgtcggaacaccgcaaccaataaaagttaataacacattaattgtatctaccgatgcatacggcaccaacatcggaaaacttgtgcttgattacaatccgaaaacgaagaaaattgatagttataatggtgagttaatcaccatctttgcagatcaatttaaacctgacaccatcgttcaaaatactattgataaatggagtgcaaagcttaacaaaataacacaggaagttgtcggccattctcccgtagttttaacacgtgagtatggtagttcctcttctaccggcaaccttattcttgatgcaatgatggaaaaaacacctgatgccgttgccggatttcaaaatagcggtgggatgcgagctgattttcctaaaggcgatatcacactgggagatgttattagcacattcccctttaataatgacctcatcgagatggatttgacgggccgcgatctcaaatcattgatgacgcatgcaaccaatctaactaacggtgtgttacaggtttcaaaaagcgttgcggttgtctatgacagcaaaaaaccactcaaccaacggttaatctctttcaccattaacggcaaacccgtggaagataatcaaacatatcgtattgccacgcactccttttgtgccagtggtggtgacggttttgaagcatttttgaatggaaaaaatgtgaagacgataccgggaacaacctcggcggaatctatcatcgattatttcaaaaatcataaacctgtcaccccagacttaactaaacgagtcatggacgtcgccaaataa

SEQ ID NO: 9088 - protein, 292 aa, Escherichia coli
MWSGYYRQILRQLKKVNGVDVLITGHAHVGTPQPIKVNNTLIVSTDAYGTNIGKLVLDYNPKTKKIDSYNGELITIFADQFKPDTIVQNTIDKWSAKLNKITQEVVGHSPVVLTREYGSSSSTGNLILDAMMEKTPDAVAGFQNSGGMRADFPKGDITLGDVISTFPFNNDLIEMDLTGRDLKSLMTHATNLTNGVLQVSKSVAVVYDSKKPLNQRLISFTINGKPVEDNQTYRIATHSFCASGGDGFEAFLNGKNVKTIPGTTSAESIIDYFKNHKPVTPDLTKRVMDVAK

SEQ ID NO: 9089 - DNA, 732 bp, Escherichia coli
atgaaaactgtatttacaacattatcagtcatattcggcgtgatattttctcacagtgttctagctcaggacgttactatttattatacgaatgacattcacgcacatgtcaatccggcaaaaatcctcgctgttgataagaacagacttataggtggtatggctaatattgcaggcatcgttaatgaagcgaagaaaaaaagcaaagatgtgtttttctttgatgcaggcgactattttaccgggccgtatatcagcaccctgaccaaaggtgaagctattattgatatcatgaacactatgccctttgatgcggtgtctgttggtaatcacgagttcgatcacggtgtgcccaatatggtgtctcagttatcaaaagcaaaattccccattctgctgggaaatatctactacaccgatacgaataaaccagtttgggatcatccgtggaccattatcgaaaaagatggtttaaagattggtgtgattggattgcatggcgcattcgctttctatgatacagtcgcggcaaaagcacgtgaaggcgtagaagccagagacgaaattaaatatttaaataaagcacttgcagaattaaaaggtaaagtcgacataaccgttttgctaattcacgaaggtgtcccggcgcgtcaatcaagctttggtagtaaagatgtggagcggctactacaggcagatattgagacagctaaaaaaagtgaatggtgttga

SEQ ID NO: 9090 - protein, 243 aa, Escherichia coli
MKTVFTTLSVIFGVIFSHSVLAQDVTIYYTNDIHAHVNPAKILAVDKNRLIGGMANIAGIVNEAKKKSKDVFFFDAGDYFTGPYISTLTKGEAIIDIMNTMPFDAVSVGNHEFDHGVPNMVSQLSKAKFPILLGNIYYTDTNKPVWDHPWTIIEKDGLKIGVIGLHGAFAFYDTVAAKAREGVEARDEIKYLNKALAELKGKVDITVLLIHEGVPARQSSFGSKDVERLLQADIETAKKSEWC

SEQ ID NO: 9091 - DNA, 1125 bp, Escherichia coli
atgtcgactctgtttacgattaatgcctgtaaaacgttcggttgccgaaatttgggattggcctcatcggaagattacagttggccagactataaactgggttatccggcactgcactgtcgggcatgtggcagttacccgccgttgtttgacgagcaacaatttcgtgactggttgtcagttcacttgtctacttatgcaattgagaaaggccatttctgcccggtatgttatggcacagacatgatttgttatggtcacaatccacagggttcgcaacgcattcaatgccgtaactgcaaaaaagtctggacgcctaaaaaatatcagaaagaaattacgcatccccaggccattgaaaccgttcaactgttcataccctttcaaggggccagcgcagtacaaaaactgtatgttttagtcagtcttgacgccactcgtggcaacattcttcatctctccacgaattatacgcaacatcagacaggagacagtctgcggtacagttacaagggcaacacagaaccaactatgcaccatcgcgatatcgtgcagaaggtagatatgcgtgaagcgcaattcttgcgccggagccagttcgatgaaattcagtatggcagtgctgtactcaagcgcaacggtaagggagccatactacgcccggttatcacggcacacgggcatttcagaatactgaaaatccgctatccagatgtcaaaacgcatattatttcacacgaatgttttctaagaggcgcaattattacagcctgggcagatcagttccgccaacaacaaggtgaactttggttcgtagaagaagaaatcagtgacagtaacgctgatacgccctggcattttaagggaacgacataccatggttggtggcaaaatcagtggcagcgctgggagcaggggaataattgcaagatggtctgcctactcacgggagccagcttagaaaggggcgcaaatgtttctctggcaaccagtcgttgttttatcacatggctgacagaccaacacgactttacccaaagcgcgttattatccgcaggtcgcgtaacgcaaatgctgacctcactggcgttaaaatacaatgaatcgctcactccatcttgttag

SEQ ID NO: 9092 - protein, 374 aa, Escherichia coli
MSTLFTINACKTFGCRNLGLASSEDYSWPDYKLGYPALHCRACGSYPPLFDEQQFRDWLSVHLSTYAIEKGHFCPVCYGTDMICYGHNPQGSQRIQCRNCKKVWTPKKYQKEITHPQAIETVQLFIPFQGASAVQKLYVLVSLDATRGNILHLSTNYTQHQTGDSLRYSYKGNTEPTMHHRDIVQKVDMREAQFLRRSQFDEIQYGSAVLKRNGKGAILRPVITAHGHFRILKIRYPDVKTHIISHECFLRGAIITAWADQFRQQQGELWFVEEEISDSNADTPWHFKGTTYHGWWQNQWQRWEQGNNCKMVCLLTGASLERGANVSLATSRCFITWLTDQHDFTQSALLSAGRVTQMLTSLALKYNESLTPSC

SEQ ID NO: 9093 - DNA, 1554 bp, Escherichia coli
atgaaaattaaaatacttgctgcgggtatcgcattaacactgccgttctgggcttgcgctaaagatgtcactattatttataccaacgacctccatgcgcatgtagaaccttataaagtgccgtggatcgctgacggtaaacgggatattggcggctgggcaaatatcactacgctggttaagcaagaaaaagcaaaaaataaagcgacatggttttttgatgcgggcgactattttaccgggccatatatcagcagcctgaccaaaggtaaggctattatcgatattatgaatactatgccgtttgatgccgtcacaataggcaaccatgaatttgaccacggctgggacaacacattattacagttgagccaggcaaaattccctattgtgcagggcaatattttttatcagaacagcagtaaatcattctgggataagccctataccatcatcgaaaaagacggcgtgaaaattggcgttataggtttgcacggagtatttgccttcaatgatacggtatctgctgccacgcgcgtgggtattgaagcgcgcgatgaaattaaatggctacaacgttatatcgatgaactcaaaggcaaggttgatttgaccgtcgccctgatccacgaaggtgttccagcccgccagtccagtatgggaggcacagatgtgcgtcgcgcgttggataaagatattcagacggcaagtcaggtgaaagggctggatattttgatcaccggacatgcacatgtgggtacgccggaaccgattaaagtcggcaatacgctcatcctctccactgacagcggcgggattgatgtgggcaaactggttctcgactacaaagagaagccgcataattttacggtgaaaaacttcgagcttaaaaccatttacgctgacgagtggaagcccgatccgcaaacgaaacaggtgatcgacggctggaataaaaagcttgatgaagtggtgcaacaaacggtggcgcaatcgccggttgaattaaaacgtgcctatggtgaatcggcttccctcgggaacctggcggctgacgctttactggcagcagcgggtaaaaatacccaactggcgttaacaaactctggtggtatccgcaatgagatccccgcaggggcgattacgatgggcggcgtcatcagtacgttcccgttccccaacgaactggtgacgatggaactcacgggtaaacaattacgcagtctgatggaacacggcgcaagtttaagcaatggcgttttacaggtatcgaaaggcctggaaatgaagtacgacagcagcaagccggttggtcagcgggtaatcacactgactctgaatggcaaacccattgaagatgcgacggtttatcacattgctactcagagtttccttgctgatggtggagatggttttaccgcctttaccgaagggaaagcgcgtaacataacgggcggttattacgtttatcacgcggtggttgattacttcaaagcgggcaacaccattacggatgaacagctcaacggtatgcgcgtgaaggatatcaaataa

SEQ ID NO: 9094 - protein, 517 aa, Escherichia coli
MKIKILAAGIALTLPFWACAKDVTIIYTNDLHAHVEPYKVPWIADGKRDIGGWANITTLVKQEKAKNKATWFFDAGDYFTGPYISSLTKGKAIIDIMNTMPFDAVTIGNHEFDHGWDNTLLQLSQAKFPIVQGNIFYQNSSKSFWDKPYTIIEKDGVKIGVIGLHGVFAFNDTVSAATRVGIEARDEIKWLQRYIDELKGKVDLTVALIHEGVPARQSSMGGTDVRRALDKDIQTASQVKGLDILITGHAHVGTPEPIKVGNTLILSTDSGGIDVGKLVLDYKEKPHNFTVKNFELKTIYADEWKPDPQTKQVIDGWNKKLDEVVQQTVAQSPVELKRAYGESASLGNLAADALLAAAGKNTQLALTNSGGIRNEIPAGAITMGGVISTFPFPNELVTMELTGKQLRSLMEHGASLSNGVLQVSKGLEMKYDSSKPVGQRVITLTLNGKPIEDATVYHIATQSFLADGGDGFTAFTEGKARNITGGYYVYHAVVDYFKAGNTITDEQLNGMRVKDIK

SEQ ID NO: 9095 - DNA, 891 bp, Escherichia coli
atgagcttttttcacgccagccagcgggatgccctgaatcagagtctggcagaagtccaggggcagattaacgtttcgttcgaatttttcccgccgcgtaccagtgaaatggagcagaccctgtggaactccatcgatcgccttagcagcctgaaaccgaagtttgtatcggtgacctatggcgcaaactccggcgagcgcgaccgtacgcacagcattattaaaggcattaaagatcgcaccggcctggaagcggcaccgcatcttacctgcattgatgcgacgcctgccgagctgcggatcattgcacgcgactactggaataacggtattcgccatatcgtggcgctgcgtggcgacctgccgccgggaagtggtaagccagaaatgtatgcttctgacctggtgacgctgttaaaagaagtggcagatttcgatatctccgtggcggcgtatccggaagtacatccagaagcgaaaagtgcccaggccgatttactcaacctgagacgaaaagtggatgccggagccaaccgcgccattactcagttcttcttcgatgtcgaaagctacctgcgttttcgcgatcgctgcgtctcggcaggcattgatgtggaaatcattccgggaattttgccggtttcgaactttaaacaggcgaagaaatttgccgacatgaccaacgtgcgtattccggcgtggatggcacaaatgttcgacggcctggatgacgatgctgaaacccgcaagctggtgggcgcgaatattgccatggatatggtgaagattttaagccgtgaaggagtgaaagatttccacttctatacgcttaaccgcgctgaaatgagttacgcgatttgccatacactgggtgttcgacctggtttataa

SEQ ID NO: 9096 - protein, 296 aa, Escherichia coli
MSFFHASQRDALNQSLAEVQGQINVSFEFFPPRTSEMEQTLWNSIDRLSSLKPKFVSVTYGANSGERDRTHSIIKGIKDRTGLEAAPHLTCIDATPAELRIIARDYWNNGIRHIVALRGDLPPGSGKPEMYASDLVTLLKEVADFDISVAAYPEVHPEAKSAQADLLNLRRKVDAGANRAITQFFFDVESYLRFRDRCVSAGIDVEIIPGILPVSNFKQAKKFADMTNVRIPAWMAQMFDGLDDDAETRKLVGANIAMDMVKILSREGVKDFHFYTLNRAEMSYAICHTLGVRPGL

SEQ ID NO: 9097 - DNA, 2181 bp, Escherichia coli
atgagcacgtcagacgatatccataacacgacagccaccggcaaatgcccgttccatcaaggcggtcacgaccagagcgcaggtgggggcacaaccacgcgcgactggtggccaaatcaactccgtgttgacctgttaaaccaacattctaatcgttctaacccgctgggtgaggactttgactaccgcaaagaattcagcaaattagattactacggcctgaaaaaagatctgaaagccctgctgacagaatctcaaccgtggtggccagccgactggggcagctacgccggtctgtttattcgtatggcctggcacggcgcgggtacttaccgttcaatcgacggtcgcggcggcgcgggtcgtggtcagcaacgttttgcaccgctgaactcctggccggataacgtaagcctcgataaagcgcgtcgcctgttgtggccaatcaaacagaaatatggtcagaaaatctcctgggccgacctgtttatcctcgcgggtaacgtggcgctggaaaactccggcttccgtaccttcggttttggtgccggtcgtgaagacgtctgggaaccggatctggatgttaactggggtgatgaaaaagcctggctgactcaccgtcatccggaagcgctggcgaaagcaccgctgggtgcaaccgagatgggcctgatttacgttaacccggaaggcccggatcacagcggcgaaccactttcggcggcagcagctatccgcgcgaccttcggcaacatgggcatgaatgacgaagaaaccgtggcgctgattgcgggtggtcatacgctgggtaaaacccacggtgctggtccgacatcaaacgtaggtcctgatccagaagctgcaccgattgaagaacaaggtttaggctgggcgagcacttacggcagcggcgttggcgcagatgccattacctctggtctggaagtggtctggacccagacgccgacccagtggagcaactatttcttcgagaacttgttcaagtatgagtgggtacagacccgcagcccggctggtgcaatccagtttgaagcggtagacgcaccggaaattatcccggatccgtttgatccgtcgaagaaacgtaaaccgacgatgctggtgaccgacctgacgctgcgttttgatcctgagttcgagaagatctctcgtcgtttcctcaacgatccgcaggcgttcaacgaagcctttgctcgtgcctggttcaaactgacgcacagggatatggggccgaaatctcgttacatcggaccggaagtaccgaaagaagatctgatctggcaagatccgctgccgcagccgatctacaacccgaccgagcaggacattatcgatctgaaattcgcgattgcggattctggtctgtctgttagtgagctggtatcggtggcctgggcgtctgcttctaccttccgtggtggcgacaaacgtggtggtgccaacggtgcgcgtctggcattaatgccgcagcgtgactgggatgtgaacgccgcagccgttcgtgctctgccagttctggagaaaattcagaaagagtctggcaaagcttcgctggcggatatcatcgtgctggcaggtgtggttggcgttgagaaagccgcaagcgccgcaggtttgagcattcatgtaccgtttgcgccgggtcgcgttgatgcgcgtcaggatcagactgacattgagatgttcgaactgctggaaccaattgctgacggtttccgtaactatcgcgctcgtctggacgtttccaccaccgagtcactgttgattgataaagcacagcaactgacgctgaccgcgccggaaatgactgcgctggtgggcgggatgcgcgtactgggtgccaacttcgatggcagcaaaaacggcgtcttcactgaccgcgttggtgtattgagcaatgacttcttcgtgaacttgctggatatgcgttacgagtggaaagcgaccgacgaatcgaaagaactgttcgaaggccgtgaccgcgaaactggcgaagtgaaatacacagccagccgtgcggatctggtctttggttctaactctgtcctgcgtgcggtggcggaagtctacgccagcagcgatgcccacgagaagtttgttaaagacttcgtggcagcgtgggtgaaagtgatgaacctcgaccgtttcgacctgctgtaa

SEQ ID NO: 9098 - protein, 726 aa, Escherichia coli
MSTSDDIHNTTATGKCPFHQGGHDQSAGGGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVGPDPEAAPIEEQGLGWASTYGSGVGADAITSGLEVVWTQTPTQWSNYFFENLFKYEWVQTRSPAGAIQFEAVDAPEIIPDPFDPSKKRKPTMLVTDLTLRFDPEFEKISRRFLNDPQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGVVGVEKAASAAGLSIHVPFAPGRVDARQDQTDIEMFELLEPIADGFRNYRARLDVSTTESLLIDKAQQLTLTAPEMTALVGGMRVLGANFDGSKNGVFTDRVGVLSNDFFVNLLDMRYEWKATDESKELFEGRDRETGEVKYTASRADLVFGSNSVLRAVAEVYASSDAHEKFVKDFVAAWVKVMNLDRFDLL

SEQ ID NO: 9099 - DNA, 972 bp, Escherichia coli
atgcagtcgctgaagtttctttaccggcgtatagtgtccacaggaaaactacacactggatctctcatgtctgccgcaggaaagagcaacccactggcaatcagtggcctggttgtgctcacacttatctggagttatagctggattttcatgaagcaagtcaccagctacatcggtgccttcgacttcaccgccttacgctgcattttcggcgctctcgttttattcatcgtccttttattacgtggtcgcggaatgcgcccgacgccgtttaaatacaccttagccattgccctgttacaaacctgcgggatggttggcctggcacagtgggcgctggtcagcggcggagcggggaaggtggcaatcctgagctataccatgccgttctgggtggtaattttcgccgcgttgtttctcggtgaacgcctgcgacgtgggcaatatttcgcgatactgattgccgctttcggcttatttttggtgttgcagccgtggcaactcgatttctcttcgatgaaaagtgccatgctggcaatcctctccggtgtgagttggggggcgagcgcgattgttgctaaacgtctgtatgcccgccatccgcgcgtggatttattgtcgctaacatcctggcagatgctgtatgcggcgctggtgatgagcgtggtcgctttactggtgccgcaacgtgaaattgactggcaacccaccgtgttctgggcgctggcctacagtgcgattctggcgacagcgctggcctggagcttatggttgtttgtattgaaaaacttgcctgccagtattgccagcttaagcacactggccgttcccgtttgcggcgtactcttttcctggtggctgctcggtgagaatccgggggcagttgaaggtagcggtattgtgctgattgtactggcactggcgctggtgagccgtaagaaaaaagaagccgtcagtgtaaaaaggatctga

SEQ ID NO: 9100 - protein, 323 aa, Escherichia coli
MQSLKFLYRRIVSTGKLHTGSLMSAAGKSNPLAISGLVVLTLIWSYSWIFMKQVTSYIGAFDFTALRCIFGALVLFIVLLLRGRGMRPTPFKYTLAIALLQTCGMVGLAQWALVSGGAGKVAILSYTMPFWVVIFAALFLGERLRRGQYFAILIAAFGLFLVLQPWQLDFSSMKSAMLAILSGVSWGASAIVAKRLYARHPRVDLLSLTSWQMLYAALVMSVVALLVPQREIDWQPTVFWALAYSAILATALAWSLWLFVLKNLPASIASLSTLAVPVCGVLFSWWLLGENPGAVEGSGIVLIVLALALVSRKKKEAVSVKRI

SEQ ID NO: 9101 - DNA, 537 bp, Escherichia coli
gtggtacaaatccaggctaacaccaatcttgccatcgcagacggcgccagactgcaaatcggcagcacgctattttacgatccggcgtatgtgcagcttacctatcctggcggtgatgtcccgcaagaacgcggcgtatgttccgatgtggtgatccgtgcattgcgcagccagaaggtcgatttgcagaaactggtgcacgaagatatggcgaagaattttgctgcgtacccgcaaaaatggcagttaaagcgcccggacagcaacatcgatcaccgtcgggtgcctaatctggaaacctggtttacccgccacgataaaacacgccccaccagcaagaaccccagtgactatcaagcgggcgatattgtctcctggcgattagataacgggctggcacatattggggtggtgtcagatggcttcgcccgcgacggtacgccgctggtgatacataacattggcgcaggcgcgcaggaagaagatgtactgtttagctggcagatggtggggcactatcggtattttgctaaataa

SEQ ID NO: 9102 - protein, 178 aa, Escherichia coli
MVQIQANTNLAIADGARLQIGSTLFYDPAYVQLTYPGGDVPQERGVCSDVVIRALRSQKVDLQKLVHEDMAKNFAAYPQKWQLKRPDSNIDHRRVPNLETWFTRHDKTRPTSKNPSDYQAGDIVSWRLDNGLAHIGVVSDGFARDGTPLVIHNIGAGAQEEDVLFSWQMVGHYRYFAK

SEQ ID NO: 9103 - DNA, 195 bp, Escherichia coli
gtgtttttttatccgcttctggacattttctccacagaacaatcgttagcccggaaggtcgaatctgtgactcttattttcacggacgaaacagatgaaagcttcactggcgttattcagtcttctgacgttatttaccagttactccttaaaatctcccgccgttccaccaaccgtggtacaaatccaggctaa

SEQ ID NO: 9104 - protein, 64 aa, Escherichia coli
MFFYPLLDIFSTEQSLARKVESVTLIFTDETDESFTGVIQSSDVIYQLLLKISRRSTNRGTNPG

SEQ ID NO: 9105 - DNA, 1104 bp, Escherichia coli
atggaccgcattattcaatcaccaggtaaatacatccagggcgcagatgtaattaatcgtctgggcgagtacctgaagccactggcggaacgctggttagtggtgggtgacaaatttgttttaggttttgctcaatccactgtcgagaaaagctttaaagatgctggactggtagtagaaattgcgccgtttggcggtgaatgttcgcaaaatgagatcgaccgtctgcgtggcatcgcggagactgcgcagtgtggcgcaattctcggtatcggtggcggaaaaaccctcgatactgccaaagcactggcacatttcatgggtgttccggtagcgatcgcaccgactatcgcttctaccgacgcaccgtgcagcgcattgtctgttatctacaccgatgagggtgagtttgaccgctatctgctgttgccaaataacccgaatatggtcattgtcgacaccaaaatcgtcgctggcgcgcccgcgcgtctgttagcggcgggtattggcgatgcgctggcaacctggtttgaagcgcgtgcctgttcccgtagcggcgcgaccaccatggcgggtggcaagtgcactcaggcagcgctggcactggctgaactgtgctacaacaccctgctggaagaaggcgaaaaagcgatgcttgccgccgaacagcatgtagtgactccggcgctggagcgcgtgattgaagcgaacacctatttgagtggcgttggttttgaaagcggcgggctggcggcggcacacgcggtacataacggcctgaccgctatcccggacgcgcatcactattatcatggtgaaaaagtagcattcggtacgctgacgcagctggtgctggaaaacgcgtcggtggaggaaatcgaaaccgtagctgcgcttagccatgcggtaggtttgccaataactctcgctcaactggatattagagaagatgtcccggcgaaaatgcgaattgtggcagaagcggcatgtgcagaaggtgaaaccatccacaacatgcctggcggcgcgacgccagatcaggtttacgccgcactgctggtagccgaccagtatggtcagcgtttcctgcaagagtgggaataa

SEQ ID NO: 9106 - protein, 367 aa, Escherichia coli
MDRIIQSPGKYIQGADVINRLGEYLKPLAERWLVVGDKFVLGFAQSTVEKSFKDAGLVVEIAPFGGECSQNEIDRLRGIAETAQCGAILGIGGGKTLDTAKALAHFMGVPVAIAPTIASTDAPCSALSVIYTDEGEFDRYLLLPNNPNMVIVDTKIVAGAPARLLAAGIGDALATWFEARACSRSGATTMAGGKCTQAALALAELCYNTLLEEGEKAMLAAEQHVVTPALERVIEANTYLSGVGFESGGLAAAHAVHNGLTAIPDAHHYYHGEKVAFGTLTQLVLENASVEEIETVAALSHAVGLPITLAQLDIREDVPAKMRIVAEAACAEGETIHNMPGGATPDQVYAALLVADQYGQRFLQEWE

SEQ ID NO: 9107 - DNA, 663 bp, Escherichia coli
atggaactgtatctggacaccgctaacgtcgcagaagtcgaacgtctggcacgcatattcccgattgccggggtgacaactaacccgagcattatcgctgccagcaaggagtccatctgggaagtgctgccgcgccttcaaaaagcgatcggtgatgagggcattctgtttgctcagaccatgagccgcgacgcgcagggtatggtgaaagaagcgaaacacctgcgcgacgctattccgggcattgtggtgaaaattccggtaacctctgaaggtctggcagcaattaaaatgctgaagaaagaaggcattactacgctgggaaccgcagtgtacagcgccgcgcaaggattactggcggcgctggctggagccaaatacgttgctccatacgttaaccgcgtagatgcccagggcggtgacggcattcgtactgtacaggagttgcaagcgttactggaaatgcatgcgccagaaagcatggtgctggctgccagctttaaaacaccacgtcaggcgctggattgtttgctggctggatgtgaatccatcacactgcccttagatgtagcgcaacaaatgcttaacacccctgcggtagagtcagctatagagaagttcgagcacgactggaatgccgcatttgacactactcatctctaa

SEQ ID NO: 9108 - protein, 220 aa, Escherichia coli
MELYLDTANVAEVERLARIFPIAGVTTNPSIIAASKESIWEVLPRLQKAIGDEGILFAQTMSRDAQGMVKEAKHLRDAIPGIVVKIPVTSEGLAAIKMLKKEGITTLGTAVYSAAQGLLAALAGAKYVAPYVNRVDAQGGDGIRTVQELQALLEMHAPESMVLAASFKTPRQALDCLLAGCESITLPLDVAQQMLNTPAVESAIEKFEHDWNAAFDTTHL

SEQ ID NO: 9109 - DNA, 2502 bp, Escherichia coli
atggccctgattgtggaatttatttgtgagctacctaacggcgtccatgcgcgtccggcaagccacgttgaaacgctgtgtaatactttttcatcacaaattgagtggcataacctgcgcactgaccgcaagggcaacgccaaaagcgcccttgcgctgattggcaccgatacgctggtgggcgataactgccagttactgatttccggggccgacgaacaggaagcgtaccagcgtttaagccaatggctgcgcgatgaattcccccactgcgacgcaccgctggcggaagtaaaatctgacgaactggaaccactgccggtttcactgaccaatctgaatccgcaaattatccgtgctcgcaccgtgtgcagtggtagcgcaggcggcattctgacgccgatctcttctttagatctcaatgcgctgggtaatcttcccgcagccaaaggcgttgacgccgaacaatccgcactggaaaacggtctgacgctggtactgaaaaacatagagtttcgtctgctggatagcgacggtgctaccagcgcgattctggaagcgcaccgatccctggctggcgatacttccctgcgcgaacatttactggcaggtgtcagcgccggattaagctgcgccgaagcgattgttgccagtgcgaatcacttttgcgaagagttcgcccgttccagcagcagctacctgcaagaacgtgccctggacgtacgcgacgtctgcttccagttactccagcaaatctacggtgagcaacgcttcccggcaccgggcaaactgacgcagcccgccatttgtatggctgatgaactgacccccagccagttcctcgaactggataaaaatcatctcaaaggtctgttactgaaaagtggcggcaccacctcacatactgtgatccttgcccgttcgttcaacattccgacgctggtaggtgtggatattgctgcccttactccgtggcagcatcagacgatttatatcgacggcaacgcaggggcgattgtggttgagccaggggaatccgtggcccgttattatcagcaagaagcccgcgtacaggacgctctgcgtgagcaacagcgtgtctggctgacccagcaagcgcgtaccgctgacggtatccgcattgaaattgccgctaacatcgctcactccgtggaagcgcaggccgcattcggcaatggtgcggaaggcgttggtttgttccgcactgaaatgctctatatggatcgcaccagtgcaccgggcgaaagcgagctgtacaacattttttgtcaggcgctggagtctgccaacggacgcagcattattgtgcgcactatggacattggcggtgataaacccgttgattatctgaacattccggcagaagctaacccgttcctcggttatcgcgcggtgcgtatttatgaagaatacgcgtcgttgtttaccacacaactacggtcgatcctgcgcgcctctgctcacggcagcctgaaaatcatgatcccgatgatctcctcaatggaagagatcttatgggtgaaagaaaaactggcggaagccaaacagcaactgcgtaacgaacacattccgtttgatgagaagatccagctcggcatcatgctggaagtgccgtcggtgatgttcatcatcgatcaatgctgcgaagagattgatttctttagtattggtagtaatgacctgacgcaatatctactggcagtggatcgcgataacgctaaggtgactcgtcactacaacagcctgaatccggccttcttgcgggcgctcgattacgccgtgcaggcggtgcatcgccagggcaaatggattggtctgtgcggtgaactgggagcgaaaggttccgtgctgccgttgctggtcggtttagggctggatgaactcagcatgagcgcaccatcaattccggcggcgaaagcgcggatggcgcaacttgatagccgtgagtgccgccagttgctcaaccaggcaatggcctgccgtacttcgctggaagtggaacacctgctggcgcaattccgcatgacccaacaggacgcaccgctggtcaccgccgagtgcatcacactggaaagcgactggcgcagcaaagaagaagtgctcaaaggcatgaccgataacctgctgctggcgggccgctgccgctatccgcgtaaactggaagccgacttgtgggcgcgcgaggccgttttctctaccggtctgggctttagtttcgccattccccacagtaaatcggaacacattgagcaatccaccatcagcgtagcgcgtctgcaagcgccagtgcgctggggcgatgatgaagcgcaattcatcattatgttaaccctgaacaaacacgccgcgggcgatcaacatatgcgcattttctcgcgcctcgctcgtcgcatcatgcacgaagaattccgtaatgcgctggttaacgccgcctctgccgacgctatcgccagcctgctgcaacatgaactggaactgtaa

SEQ ID NO: 9110 - protein, 833 aa, Escherichia coli
MALIVEFICELPNGVHARPASHVETLCNTFSSQIEWHNLRTDRKGNAKSALALIGTDTLVGDNCQLLISGADEQEAYQRLSQWLRDEFPHCDAPLAEVKSDELEPLPVSLTNLNPQIIRARTVCSGSAGGILTPISSLDLNALGNLPAAKGVDAEQSALENGLTLVLKNIEFRLLDSDGATSAILEAHRSLAGDTSLREHLLAGVSAGLSCAEAIVASANHFCEEFARSSSSYLQERALDVRDVCFQLLQQIYGEQRFPAPGKLTQPAICMADELTPSQFLELDKNHLKGLLLKSGGTTSHTVILARSFNIPTLVGVDIAALTPWQHQTIYIDGNAGAIVVEPGESVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRQLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVARLQAPVRWGDDEAQFIIMLTLNKHAAGDQHMRIFSRLARRIMHEEFRNALVNAASADAIASLLQHELEL

SEQ ID NO: 9111 - DNA, 1080 bp, Escherichia coli
atgaatgagttggtgcagatcctgaaaaatacccgtcagcatttaatgacgggcgtttcacacatgattcccttcgtggtatcgggcggtattttgctggcggtttccgtcatgttgtatggcaaaggcgcagtgccggatgccgtagccgatccgaatctgaaaaaactgtttgatatcggcgttgcaggtttgacgctgatggtgcctttcctcgccgcttacatcggttattccattgcagaacgttctgcgctggctccatgcgctatcggtgcctgggttggtaacagctttggcgcgggcttctttggtgcgctgatcgccgggattatcggcggcatcgtggtgcattacctgaagaaaattccggtgcataaagttctgcgctcggtgatgccaatcttcatcattccaatcgtcggcacactgattaccgctggcgtcatgatgtgggggctgggcgagccggtgggggcgttgaccaacagcctgacccagtggcttcaggggatgcagcagggcagcattgttatgctggcggtgatcatgggtctgatgctggcgttcgatatgggcggcccggttaacaaagtggcctatgccttcatgctgatttgcgttgctcagggtgtttataccgtggtggctattgccgctgttgggatttgtgttccaccgctggggatggggctggcgacgctgattggtcgtaaaaatttctccgcagaagagcgcgaaaccggcaaggcggcactggtgatgggctgtgttggcgttactgaaggggcgattcctttcgccgctgccgatccgctgcgtgtcattccttccatcatggtcggttcagtttgtggtgcggtaactgcggcgctggtcggtgcgcagtgctatgcaggctggggtggtctgattgtgctgccggtggttgaaggtaagttgggttacatcgcggcagtggctgtcggggcggttgtgacggcagtctgcgtgaacgtgctgaaaagtctggcgcgtaaaaatgggtcttcaactgaagagaaggaagacgacctggatctggattttgaaattaattaa

SEQ ID NO: 9112 - protein, 359 aa, Escherichia coli
MNELVQILKNTRQHLMTGVSHMIPFVVSGGILLAVSVMLYGKGAVPDAVADPNLKKLFDIGVAGLTLMVPFLAAYIGYSIAERSALAPCAIGAWVGNSFGAGFFGALIAGIIGGIVVHYLKKIPVHKVLRSVMPIFIIPIVGTLITAGVMMWGLGEPVGALTNSLTQWLQGMQQGSIVMLAVIMGLMLAFDMGGPVNKVAYAFMLICVAQGVYTVVAIAAVGICVPPLGMGLATLIGRKNFSAEERETGKAALVMGCVGVTEGAIPFAAADPLRVIPSIMVGSVCGAVTAALVGAQCYAGWGGLIVLPVVEGKLGYIAAVAVGAVVTAVCVNVLKSLARKNGSSTEEKEDDLDLDFEIN

SEQ ID NO: 9113 - DNA, 321 bp, Escherichia coli
atgacgaaaattatcgcagtaaccgcatgtccttcaggtgttgcccatacttatatggcggcagaggcgctggaaagcgccgcgaaagcgaaaggctgggaagtgaaagtagaaacccaggggtcgattggtctggaaaatgaactgactgcggaagacgtggcaagcgccgatatggtgattttgaccaaagatatcggcatcaaatttgaagagcgttttgctggcaagactatcgtgcgtgtcaacatcagcgacgcggtaaagcgtgctgacgccattatgagcaaaattgaagcccacctggcacaaaccgcttaa

SEQ ID NO: 9114 - protein, 106 aa, Escherichia coli
MTKIIAVTACPSGVAHTYMAAEALESAAKAKGWEVKVETQGSIGLENELTAEDVASADMVILTKDIGIKFEERFAGKTIVRVNISDAVKRADAIMSKIEAHLAQTA

SEQ ID NO: 9115 - DNA, 2298 bp, Escherichia coli
atgacgaatcgtatctctcgcctcaaaactgcactgtttgccaatacccgtgaaatctcgctggagcgggcgttgctttataccgccagccatcggcaaaccgaaggggagccggtgataatgcgtcgggcgaaagcaacagcgtatatccttgaacacgttgaaatttcgattcgtgatgaagaactgattgccggtaaccgcaccgtaaaaccacgcgccgggattatgtcgccggaaatggacccttactggctgctgaaagagctggatcaattcccgacgcgtccgcaggaccgctttgctatcagcgaagaagataaacgtatctaccgcgaagagttgttcccgtactgggaaaaacgttcgatgaaagatttcatcaacgggcagatgacggatgaagtaaaagccgcgaccagcacgcagattttcagcatcaaccagacggataaaggccaggggcacattattattgattacccgcgcctgctgaatcacgggctgggggagctggtggcacagatgcagcaacattgtcagcaacagccggagaatcacttttatcaggcagcgctgttactgctggaagcctcgcagaaacatattttgcgttacgccgaactggcggaaacgatggcggcaagctgcactgatggccagcgtcgcgaagaactgctgaccattgcggagatctcccgccataacgccgaacataagccgcagacgttctggcaggcgtgccagttattctggtacatgaacatcattctgcaatacgaatccaacgccagttcgctatcgttggggcgcttcgaccagtatatgttgccgttctatcagacatcattaacccagggcgaagatccggcattcctgaaagaactgctcgaatctttatgggtgaaatgcaacgacatcgtgctgttgcgctccaccagtagcgcgcgttatttcgcaggtttccctaccggctataccgcactgctcggcgggttaaccgagaacggacgtagcgcggtgaacgtgctttcgttcctttgccttgacgcttatcaaagcgtgcaattaccgcaaccgaacctcggcgtgcgcactaacgccttgatcgacacgccgttcctgatgaaaaccgcagaaaccattcgcctcggcaccggtattccgcaaatctttaacgatgaagtggtggtgccagcgttcctcaaccgtggcgtttcgctggaagatgcgcgcgactattccgtagtgggctgtgtggaattatctattcccggcagaacctacggcttgcatgacatcgcgatgtttaacctgctgaaagtgatggaaatctgcctgcatgaaaatgaaggcaacgctgcgctgacttatgaaggtttactggaacagatccgcgccaagatcagccactacatcaccctgatggttgagggcagcaatatttgtgatatcggccatcgcgactgggcacctgtaccgctactctcgtcttttatcagcgattgtctggaaaaaggccgcgatattactgacggcggcgcgcgttataacttctccggcgtacaggggatcggtatcgccaacctgagcgattctctccatgcgttgaaagggatgatttttgatcaacagcgtttaagttttgacgaattgctgtcggtattaaaagccaacttcgccacgccagaaggcgaaaaagtccgcgctcgcttaattaaccgcttcgagaaatacggtaacgatatcgacgaggtggataacatcagcgccgaactgttacgccactactgcaaagaagtggaaaaataccagaacccgcgcggcggctacttcacgccaggatcgtataccgtttctgctcacgtcccgttgggatcggtggttggcgcgacgccagacggtcgttttgccggggaacaactggcagacggtggcttgtcacccatgctgggtcaggatgcacaagggccaacggcggtgctgaaatcagtcagtaagctcgataatacgctgctgtctaacggtacgttgctgaacgtgaaattcactccggcgaccctggaaggtgaagcgggattacgcaaactggccgacttcttacgggcgtttacccagcttaagttgcagcatattcagtttaacgtggtgaacgccgacacgttacgggaagcgcaacagcgcccacaagattatgccgggctggtggtgcgcgttgccggatacagcgccttctttgtcgaactgtcgaaggagatccaggatgacatcatccgccggacagcgcatcagctgtaa

SEQ ID NO: 9116 - protein, 765 aa, Escherichia coli
MTNRISRLKTALFANTREISLERALLYTASHRQTEGEPVIMRRAKATAYILEHVEISIRDEELIAGNRTVKPRAGIMSPEMDPYWLLKELDQFPTRPQDRFAISEEDKRIYREELFPYWEKRSMKDFINGQMTDEVKAATSTQIFSINQTDKGQGHIIIDYPRLLNHGLGELVAQMQQHCQQQPENHFYQAALLLLEASQKHILRYAELAETMAASCTDGQRREELLTIAEISRHNAEHKPQTFWQACQLFWYMNIILQYESNASSLSLGRFDQYMLPFYQTSLTQGEDPAFLKELLESLWVKCNDIVLLRSTSSARYFAGFPTGYTALLGGLTENGRSAVNVLSFLCLDAYQSVQLPQPNLGVRTNALIDTPFLMKTAETIRLGTGIPQIFNDEVVVPAFLNRGVSLEDARDYSVVGCVELSIPGRTYGLHDIAMFNLLKVMEICLHENEGNAALTYEGLLEQIRAKISHYITLMVEGSNICDIGHRDWAPVPLLSSFISDCLEKGRDITDGGARYNFSGVQGIGIANLSDSLHALKGMIFDQQRLSFDELLSVLKANFATPEGEKVRARLINRFEKYGNDIDEVDNISAELLRHYCKEVEKYQNPRGGYFTPGSYTVSAHVPLGSVVGATPDGRFAGEQLADGGLSPMLGQDAQGPTAVLKSVSKLDNTLLSNGTLLNVKFTPATLEGEAGLRKLADFLRAFTQLKLQHIQFNVVNADTLREAQQRPQDYAGLVVRVAGYSAFFVELSKEIQDDIIRRTAHQL

SEQ ID NO: 9117 - DNA, 879 bp, Escherichia coli
atgacatcatccgccggacagcgcatcagctgtaacgttgtggaaacgcgccgcaatgatgtggcgcgcattttcaacattcagcgttattcactgaatgacggcgagggcattcgtacggtggtcttttttaaaggctgtccgcatctttgcccatggtgtgctaatccggagtcgatctccggcaaaatccagacggtgcgcagagaggcgaaatgtctgcactgcgcgaaatgtttgcgtgatgcggatgaatgcccctccggggcatttgaacggattggtcgcgatatcagccttgacgctctggaacgggaagtgatgaaagatgacattttctttcgcacgtccggcggtggcgtcacgctttctggcggcgaagtgttaatgcaggcggagtttgcgacccgttttttacagcgactgcggctatggggtgtgtcatgcgccatcgaaactgccggagacgcgccagccagcaagctgttaccgctggcgaaattgtgcgatgaagtgttgttcgatttaaaaattatggatgcggctcaggcgcgggatgtggtgaagatgaacctgcaacgcgtgctggagaatctgcgtttgctggtgagtgagggtgtcaacgtgatcccgcgtttaccgctgatccctggtttcacgctcagccgggagaatatgcagcaggcgctggacgtgctgatcccgctgaatatcaagcagatccatctgttaccgtttcatcagtacggcgagccgaaataccgcctgctggggaaaacatggtcgatgaaagaggtttctgcgccgtcgtcagccgatgtggcaacgatgcgtgaaatggcagaacgggccggatttcaggttaccgtgggaggttaa

SEQ ID NO: 9118 - protein, 292 aa, Escherichia coli
MTSSAGQRISCNVVETRRNDVARIFNIQRYSLNDGEGIRTVVFFKGCPHLCPWCANPESISGKIQTVRREAKCLHCAKCLRDADECPSGAFERIGRDISLDALEREVMKDDIFFRTSGGGVTLSGGEVLMQAEFATRFLQRLRLWGVSCAIETAGDAPASKLLPLAKLCDEVLFDLKIMDAAQARDVVKMNLQRVLENLRLLVSEGVNVIPRLPLIPGFTLSRENMQQALDVLIPLNIKQIHLLPFHQYGEPKYRLLGKTWSMKEVSAPSSADVATMREMAERAGFQVTVGG

SEQ ID NO: 9119 - DNA, 852 bp, Escherichia coli
atgtatcacgacgtcagctatctgctctcccgcctgataaacggcccgctgtccctgcgccagatttactttgccagcagcaacggcccggtgcccgatcttgcgtatcaggtcgattttccacggctggaaattgtgctggaaggtgagtttattgataccggcgctggagcagcgttagttcccggcgatgtgctgtacgtccctgctggtggctggaattttccacaatggcaagcccccgccaccacctttagcgtgctgtttggcaaacagcaactcggcttcagcgttgtgcaatgggatggcaaacaatatcaaaatctggcgaagcaacacgtcgcccgacgcggcccgcgcattggttcttttctgctacaaacgctcaatgaaatgcaaatgcagtcgcaggagcagcaaacggccagacttatcgtcgccagcctgcttagccactgccgcgatttgctcggcagccaaatacagaccgcctcacgcagccaggctctattcgaagctattcgtgattatatcgacgaacgctatgcctccgcacttacccgcgaatctgtcgcacaggcgttctatatttcgccaaattacctctcgcacctgtttcaaaaaacgggggccattggttttaacgaatacctgaatcacacgcgactggagcacgctaagacattattgaaaggctatgacctgaaggtaaaagaagtggcgcacgcctgcggctttgtcgacagcaactacttctgccgtctgtttcgtaaaaataccgaacgctcgccgtcggaatatcgtcggcagtaccacagccaactgacagaaaaaccgactactccagaataa

SEQ ID NO: 9120 - protein, 283 aa, Escherichia coli
MYHDVSYLLSRLINGPLSLRQIYFASSNGPVPDLAYQVDFPRLEIVLEGEFIDTGAGAALVPGDVLYVPAGGWNFPQWQAPATTFSVLFGKQQLGFSVVQWDGKQYQNLAKQHVARRGPRIGSFLLQTLNEMQMQSQEQQTARLIVASLLSHCRDLLGSQIQTASRSQALFEAIRDYIDERYASALTRESVAQAFYISPNYLSHLFQKTGAIGFNEYLNHTRLEHAKTLLKGYDLKVKEVAHACGFVDSNYFCRLFRKNTERSPSEYRRQYHSQLTEKPTTPE

SEQ ID NO: 9121 - DNA, 342 bp, Escherichia coli
atggcatatctggtggcagtaaccgcctgcgtaagcggcgtggcgcatacttatatggcggcggaacggctggaaaagttgtgccagttagagaagtggggcgttagcattgaaactcagggcgcgttgggaacggagaatcgtttagcggacgaggatatccgccgggcggatgttgcgctgttaattacggatatcgagcttgccggtgctgagcgatttgaacattgtcgctacgtgcaatgcagcatctacgctttcctgcgtgagccgcagagggtgatgagcgcagtgcgcaaagtgctttctgcgccgcagcaaacccatcttattctggagtag

SEQ ID NO: 9122 - protein, 113 aa, Escherichia coli
MAYLVAVTACVSGVAHTYMAAERLEKLCQLEKWGVSIETQGALGTENRLADEDIRRADVALLITDIELAGAERFEHCRYVQCSIYAFLREPQRVMSAVRKVLSAPQQTHLILE

SEQ ID NO: 9123 - DNA, 1779 bp, Escherichia coli
ttgtcgttacattcggcgatatttttttcaagacaggttcttactatgcattccacagaagtccaggctaaacccctttttagctggaaagccctgggttgggcactgctctacttttggtttttctctactctgctacaggccattatttacatcagtggttatagtggcactaacggcattcgcgactcgctgttattcagttcgctgtggttgatcccggtattcctctttccgaagcggattaaaattattgccgcagtgatcggcgtggtgctatgggcggcctctctggcggcgctgtgctattacgtcatctacggtcaggagttctcgcagagcgttctgtttgtgatgttcgaaaccaacaccaacgaagccagcgagtatttaagccagtatttcagcctgaaaattgtgcttatcgcgctggcctatacggcggtggcagttctgctgtggacacgcctgcgcccggtctatattccaaagccgtggcgttatgttgtctcttttgccctgctttatggcttgattctgcatccgatcgccatgaatacgtttatcaagaacaagccgtttgagaaaacgttggataacctggcatcgcgtatggagcctgccgcaccgtggcaattcctgaccggctattatcagtatcgtcagcaactaaactcgctaacaaagctactgaatgaaaataatgccttgccgccgctggctaatttcaaagatgaatcgggtaacgaaccgcgcaccttagtgctggtaattggcgaatcgacccagcgtggacgcatgagtctgtacggttatccgcgtgaaaccacgccggagctggatgcgctgcataaaaccgatccgaatctgaccgtgtttaataacgtggttacgtctcgtccgtacaccattgaaatcctgcaacaggcgctgacctttgctaatgaaaagaacccggatctgtatctgacgcagccgtcgctgatgaacatgatgaaacaggcgggttataaaaccttctggatcaccaaccagcagacgatgaccgcccgcaataccatgctgacggtattttcgcgccagaccgacaagcagtactacatgaaccagcaacgtacgcagagtgcgcgtgaatacgacaccaacgtgctgaagccgttccaggaagtgctgaaggaccctgcgccgaagaaactgatcatcgttcatctgctgggtacgcatatcaagtacaagtaccgttatccggaagatcagggcaaatttgacggtaatacagagcatgttccaccgggattaaacgcagaagagctggagtcatataatgattatgacaatgctaacctgtacaacgatcacgtggttgccagcctgattaaagactttaaagcgaccgatccgaacggtttcctggtttatttctctgaccacggtgaagaggtttacgacacgccgccgcacaaaactcaggggcgtaatgaagacaacccgacgcgtcatatgtacaccattccgttcctgctgtggacgtcagaaaaatggcaagcgactcatccgcgtgatttctcacaggatgttgatcgtaaatacagcctggcggaactgatccacacctggtcagatttggcgggcttatcttacgacggttacgatccaacccgttcagtggtgaatccgcagttcaaagaaactacccgctggattggtaacccgtataagaaaaacgcactgatcgattacgacactctgccgtatggcgatcaggtgggtaatcagtaa

SEQ ID NO: 9124 - protein, 592 aa, Escherichia coli
MSLHSAIFFSRQVLTMHSTEVQAKPLFSWKALGWALLYFWFFSTLLQAIIYISGYSGTNGIRDSLLFSSLWLIPVFLFPKRIKIIAAVIGVVLWAASLAALCYYVIYGQEFSQSVLFVMFETNTNEASEYLSQYFSLKIVLIALAYTAVAVLLWTRLRPVYIPKPWRYVVSFALLYGLILHPIAMNTFIKNKPFEKTLDNLASRMEPAAPWQFLTGYYQYRQQLNSLTKLLNENNALPPLANFKDESGNEPRTLVLVIGESTQRGRMSLYGYPRETTPELDALHKTDPNLTVFNNVVTSRPYTIEILQQALTFANEKNPDLYLTQPSLMNMMKQAGYKTFWITNQQTMTARNTMLTVFSRQTDKQYYMNQQRTQSAREYDTNVLKPFQEVLKDPAPKKLIIVHLLGTHIKYKYRYPEDQGKFDGNTEHVPPGLNAEELESYNDYDNANLYNDHVVASLIKDFKATDPNGFLVYFSDHGEEVYDTPPHKTQGRNEDNPTRHMYTIPFLLWTSEKWQATHPRDFSQDVDRKYSLAELIHTWSDLAGLSYDGYDPTRSVVNPQFKETTRWIGNPYKKNALIDYDTLPYGDQVGNQ

SEQ ID NO: 9125 - DNA, 2652 bp, Escherichia coli
atgaacgaacaatattccgcattgcgtagtaatgtcagtatgctcggcaaagtgctgggagaaaccatcaaggatgcgttgggagaacacattcttgaacgcgtagaaactatccgtaagttgtccaaatcttcacgcgctggcaatgatgctaaccgccaggagttgctcaccaccttacaaaatttgtcgaacgacgagctgctgcccgttgcgcgtgcgtttagtcagtttctgaacctggccaacaccgccgagcaataccacagcatttcgccgaaaggcgaagctgccagcaacccggaagtgatcgcccgcaccctgcgcaaactgaaaaaccagccggaactgagcgaagacaccataaaaaaagcagtggaatcgctgtcgctggaactggtcctcacggctcacccaaccgaaattacccgtcgtacactgatccacaaaatggtggaagtgaacgcctgcttaaaacagctcgataacaaagatatcgccgactacgaacataaccagctgatgcgccgcctgcgccagttgatcgcccagtcatggcatacagatgaaatccgtaagctgcgtccaagcccggtagatgaagccaaatggggctttgccgtagtagaaaacagcctgtggcaaggcgtaccgaattacctgcgcgaactgaacgaacaactggaagagaatctcggctacaaactgcccgtcgaatttgttccggtccgttttacctcgtggatgggcggtgaccgcgacggcaacccgaacgtcactgccgatatcacccgccacgtcctgctgctcagtcgctggaaagccaccgatctgttcctgaaagatattcaggtgctggtttctgaactgtcgatggttgaagcgacccctgaactgctggcgctggttggcgaagaaggtgccgcagaaccgtatcgctatctgatgaaaaacctgcgttctcgcctgatggcgacacaggcatggctggaagcgcgcctgaaaggcgaagaactgccaaaaccagaaggcctgctgacacaaaacgaagaactgtgggaaccgctctacgcttgctaccagtcacttcaggcgtgtggcatgggtattatcgccaacggcgatctgctcgacaccctgcgccgcgtgaaatgtttcggcgtaccgctggtgcgtattgatatccgtcaggagagcacccgccataccgaagcgctgggcgagctgacccgctacctcggtatcggcgactacgagagctggtcagaagccgacaaacaggcgttcctgatccgcgaactgaactccaaacgtccgcttctaccgcgcaactggcaaccaagcgccgaaacgcgcgaagtgctcgatacctgccaggtgattgccgaagcgccgcaaggctccattgccgcctacgtgatctcgatggcgaaaacgccgtccgacgtgctggctgtccacctgctgctgaaagaagcgggtatcgggtttgcgatgccggttgctccgctgtttgaaaccctcgatgacctgaacaacgccaacgatgtcatgacccagctgctgaatatcgactggtatcgcggcctgattcagggcaaacagatggtgatgattggctattccgactcagcaaaagatgcgggcgtgatggcagcttcctgggcgcaatatcaggcacaggatgcattaatcaaaacctgcgaaaaagcgggtattgagctgacgttgttccacggtcgcggcggttccattggtcgcggcggcgcacctgcccatgcggcgctgctgtcacaaccgccaggaagcctgaaaggtggcctgcgcgtgaccgaacagggcgagatgatccgctttaaatatggtctgccagaaatcaccgtcagcagcctgtcgctgtacaccggggcgattctggaagccaacctgctgccaccgcctgagccgaaagagagctggcgtcgtattatggatgaactgtctgttatctcctgcgatgtctaccgcggctacgtacgtgaaaacaaagattttgtgccttacttccgctccgctacgccggaacaagaattgggtaaactgccgttgggttcacgtccggcgaaacgtcgcccaaccggcggcgtcgagtcactgcgcgctattccgtggattttcgcctggacgcaaaaccgcctgatgctccccgcctggctgggtgcaggtacggcgctgcaaaaagtggtcgaagatggcaaacagaacgagctggaagccatgtgccgcgattggccattcttctcgacgcgtctcggcatgctggagatggtcttcgccaaagcagacctgtggctggcggaatactatgaccaacgcctggtagacaaagcactgtggccgttaggtaaagagttacgcaatctgcaagaagaagacatcaaagtggtgctggcgattgccaacgattctcacctgatggccgatctgccgtggattgcagagtctattcagctacggaatatttacaccgacccgctgaacgtattgcaggccgagttgctgcaccgctcccgccaggcagaaaaagaaggccaggaaccggatcctcgcgtcgagcaggcgttaatggtcactattgccgggattgcggcaggtatgcgtaataccggctaa

SEQ ID NO: 9126 - protein, 883 aa, Escherichia coli
MNEQYSALRSNVSMLGKVLGETIKDALGEHILERVETIRKLSKSSRAGNDANRQELLTTLQNLSNDELLPVARAFSQFLNLANTAEQYHSISPKGEAASNPEVIARTLRKLKNQPELSEDTIKKAVESLSLELVLTAHPTEITRRTLIHKMVEVNACLKQLDNKDIADYEHNQLMRRLRQLIAQSWHTDEIRKLRPSPVDEAKWGFAVVENSLWQGVPNYLRELNEQLEENLGYKLPVEFVPVRFTSWMGGDRDGNPNVTADITRHVLLLSRWKATDLFLKDIQVLVSELSMVEATPELLALVGEEGAAEPYRYLMKNLRSRLMATQAWLEARLKGEELPKPEGLLTQNEELWEPLYACYQSLQACGMGIIANGDLLDTLRRVKCFGVPLVRIDIRQESTRHTEALGELTRYLGIGDYESWSEADKQAFLIRELNSKRPLLPRNWQPSAETREVLDTCQVIAEAPQGSIAAYVISMAKTPSDVLAVHLLLKEAGIGFAMPVAPLFETLDDLNNANDVMTQLLNIDWYRGLIQGKQMVMIGYSDSAKDAGVMAASWAQYQAQDALIKTCEKAGIELTLFHGRGGSIGRGGAPAHAALLSQPPGSLKGGLRVTEQGEMIRFKYGLPEITVSSLSLYTGAILEANLLPPPEPKESWRRIMDELSVISCDVYRGYVRENKDFVPYFRSATPEQELGKLPLGSRPAKRRPTGGVESLRAIPWIFAWTQNRLMLPAWLGAGTALQKVVEDGKQNELEAMCRDWPFFSTRLGMLEMVFAKADLWLAEYYDQRLVDKALWPLGKELRNLQEEDIKVVLAIANDSHLMADLPWIAESIQLRNIYTDPLNVLQAELLHRSRQAEKEGQEPDPRVEQALMVTIAGIAAGMRNTG

SEQ ID NO: 9127 - DNA, 1152 bp, Escherichia coli
atgaaaaacaaattaccgccatttatcgagatttaccgtgctctgattgccacaccttcaataagcgccacggaagaggcactcgatcaaagcaatgcagatttaatcactctgctggcggactggtttaaggatttaggcttcaatgtggaagtacagcctgtgccaggaactcgcaacaaatttaatatgctggccagttgcggacagggggctggcggtttgttgctggcggggcataccgatacggtgccatttgatgacggacgctggacgcgcgatccatttacgttgacggagcatgacggcaagctttacggcttaggcaccgccgacatgaaaggcttttttgcgtttatccttgatgcgctacgcgatgtcgacgtcacgaagcttgcaaaaccgctctacattctggcgactgccgatgaagaaaccagtatggccggagcgcgttattttgccgaaactaccgccctgcgcccggattgcgccatcattggcgagccaacgtcgctgcaaccggtacgcgcgcataaaggtcatatctctaacgccatccgtattcagggccagtcgggccactccagcgatccagcacgcggagttaacgctatcgaactgatgcacgacgccatcgggcatattttgcaattgcgcgataacctgaaagaacgttatcactacgacgcgtttaccgtgccataccctacgctcaacctcgggcatatccacggcggcgatgcatctaaccgtatttgcgcttgttgtgagttgcatatggatattcgtccgctgccaggcatgacactcaatgaacttaacggtttgctcaacgatgcattggctccagtgagcgaacgctggccgggtcgtctgacggtcgacgagctgcatccgccgatccctggctatgaatgcccaccgaatcatcaactggttgaagtggttgagaaattgctcggagcaaagaccgaagtggtgaattactgtaccgaagcgccgtttattcaaacgttatgcccgacgctggttctggggcctggctcaattaatcaggctcatcagcctgatgaatatctggagacgaggtttatcaagcccacccgcgaactgatcacccaggtgattcaccatttttgctggcattaa

SEQ ID NO: 9128 - protein, 383 aa, Escherichia coli
MKNKLPPFIEIYRALIATPSISATEEALDQSNADLITLLADWFKDLGFNVEVQPVPGTRNKFNMLASCGQGAGGLLLAGHTDTVPFDDGRWTRDPFTLTEHDGKLYGLGTADMKGFFAFILDALRDVDVTKLAKPLYILATADEETSMAGARYFAETTALRPDCAIIGEPTSLQPVRAHKGHISNAIRIQGQSGHSSDPARGVNAIELMHDAIGHILQLRDNLKERYHYDAFTVPYPTLNLGHIHGGDASNRICACCELHMDIRPLPGMTLNELNGLLNDALAPVSERWPGRLTVDELHPPIPGYECPPNHQLVEVVEKLLGAKTEVVNYCTEAPFIQTLCPTLVLGPGSINQAHQPDEYLETRFIKPTRELITQVIHHFCWH

SEQ ID NO: 9129 - DNA, 1005 bp, Escherichia coli
atgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtggtgtttctcgccaccgcccatgaagtcagccacgatttagcgccgcaatttcttgaagcaggctgtgtggtgttcgacctttccggcgcgtttcgtgttaacgatgtcgccttctatgaaaaatattacggctttacccatcaatacccggaactgctggaacaggcagcctacggtctggcggagtggtgcggtaataaattaaaagaagcgaacttgattgccgtgccaggctgttatccgacggcagcacagctggcgctgaaaccgttgattgatgccgatcttcttgacctcaatcagtggccggtgatcaacgccaccagcggcgtgagcggtgcaggacgtaaggcagcgatttcaaatagtttttgtgaagttagcctgcaaccgtatggcgtctttacccatcgccatcaaccagagatcgccacacacctcggtgctgacgttatcttcaccccgcatctgggcaatttcccgcgcggcattctcgaaaccattacctgccgcctgaaaccgggtgtgagccaggtgcaagtggcgcaagcgttacagcaggcgtatgcccataaaccactgatgcggctgtatgacaaaggcgttccggcgctgaaaaatgtcgttggactgccattctgcgatatcggttttgccgttcagggcgagcatctgattattgtggcgaccgaagacaacttactgaaaggcgcggcggcacaagcggtgcagtgcgccaatattcgtttcggctatgcggaaacgcagtctcttatttaa

SEQ ID NO: 9130 - protein, 334 aa, Escherichia coli
MLNTLIVGASGYAGAELVTYVNRHPHMNITALTVSAQSNDAGKLISDLHPQLKGIVDLPLQPMSDISEFSPGVDVVFLATAHEVSHDLAPQFLEAGCVVFDLSGAFRVNDVAFYEKYYGFTHQYPELLEQAAYGLAEWCGNKLKEANLIAVPGCYPTAAQLALKPLIDADLLDLNQWPVINATSGVSGAGRKAAISNSFCEVSLQPYGVFTHRHQPEIATHLGADVIFTPHLGNFPRGILETITCRLKPGVSQVQVAQALQQAYAHKPLMRLYDKGVPALKNVVGLPFCDIGFAVQGEHLIIVATEDNLLKGAAAQAVQCANIRFGYAETQSLI

SEQ ID NO: 9131 - DNA, 774 bp, Escherichia coli
atgaatccattaattatcaaactgggtggcgtactgctggatagtgaagaggcgctggaacgtctgtttagcgcactggtgaattatcgcgagtcacatcagcgtccgctggtgattgtgcacggcggcggttgcgtggtggatgagctgatgaaagggctgaatctgccggtgaaaaagaaaaatggcctgcgggtgacgcctgcggatcagatagacattatcaccggagcactggcgggaacggcaaataaaaccctgctggcatgggcgaagaagcatcagattgcggccgtaggtttgtttctcggtgacggcgacagcgtcaaagtgacccagcttgatgaagagttaggccatgttggactggcgcagccaggttcgcctaagcttatcaacagcttgctggagaacggttatctgccggtggtcagctccattggcgtaacagacgaagggcaactgatgaacgtcaatgccgaccaggcggcgacggcgctggcggcaacgctgggcgcggatctgattttgctctctgacgtcagcggcattctcgacggcaaagggcaacgtattgccgaaatgaccgccgcgaaagcagaacaactgattgagcagggcattattactgacggcatgattgtgaaagtgaacgcggcgctggatgctgcgcgcacgttgggccgtccggtagatatcgcctcctggcgtcatgcggaacagcttccggcactgtttaacggtatgccgatgggtacgcggattttagcttaa

SEQ ID NO: 9132 - protein, 257 aa, Escherichia coli
MNPLIIKLGGVLLDSEEALERLFSALVNYRESHQRPLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLMNVNADQAATALAATLGADLILLSDVSGILDGKGQRIAEMTAAKAEQLIEQGIITDGMIVKVNAALDAARTLGRPVDIASWRHAEQLPALFNGMPMGTRILA

SEQ ID NO: 9133 - DNA, 1374 bp, Escherichia coli
atggcactttggggcgggcgttttacccaggcagcagatcaacggttcaaacaattcaacgactcactgcgctttgattaccgtctggcggagcaggatattgttggctctgtggcctggtccaaagccctggtaacggtcggcgtgttaaccgcagaagagcaggcgcaactggaagaggcgctgaacgtgctgctggaggatgttcgcgccaggccacaacaaatccttgaaagcgacgccgaagatatccatagctgggtggaaggcaaactgatcgacaaagtgggtcagttaggcaaaaaactgcataccgggcgtagccgtaatgatcaggtagcaactgacctgaaactgtggtgcaaagataccgttagcgagttgctgacggctaaccggcagttacaatccgctctggtcgagaccgcgcagaacaatcaggacgcggtgatgccgggttacactcacctgcaacgcgcccagccggtgacgttcgctcactggtgcctggcctacgttgagatgctggcgcgtgatgaaagccgtttgcaggacgcgcttaagcgtctggatgtcagcccgctaggctgtggcgcactggcaggaacggcctatgaaatcgatcgtgaacagttagcaggctggctgggctttgcttcagcgacccgtaacagtctcgacagcgtttctgaccgtgatcatgtgctggaactgctttctgctgccgctatcggcatggtgcatctgtcgcgttttgctgaagatctgattttctttaacaccggcgaagcggggtttgtggagctttcggaccgcgtgacttccggttcatcattaatgccgcagaagaaaaacccggatgcgctggagctgattcgcggtaaatgcggtcgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccgcgttgccaggaagcggcgcagcagggttacgccaacgctactgaactggcggattatctggtggcgaaaggcgtaccgttccgcgaggcgcaccatattgtgggtgaagctgtggtggaagccattcgtcagggcaaagcgttggaagatctgccgctcagtgagttgcagaaattcagccaggtgattggcgaagatgtctatccgattctgtcgctgcaatcgtgcctcgacaagcgtgcagcaaaaggcggtgtctcaccgcaacaggtggcgcaggcgattgcttttgcgcaggcgcggttggggtaa

SEQ ID NO: 9134 - protein, 457 aa, Escherichia coli
MALWGGRFTQAADQRFKQFNDSLRFDYRLAEQDIVGSVAWSKALVTVGVLTAEEQAQLEEALNVLLEDVRARPQQILESDAEDIHSWVEGKLIDKVGQLGKKLHTGRSRNDQVATDLKLWCKDTVSELLTANRQLQSALVETAQNNQDAVMPGYTHLQRAQPVTFAHWCLAYVEMLARDESRLQDALKRLDVSPLGCGALAGTAYEIDREQLAGWLGFASATRNSLDSVSDRDHVLELLSAAAIGMVHLSRFAEDLIFFNTGEAGFVELSDRVTSGSSLMPQKKNPDALELIRGKCGRVQGALTGMMMTLKGLPLAYNKDMQEDKEGLFDALDTWLDCLHMAALVLDGIQVKRPRCQEAAQQGYANATELADYLVAKGVPFREAHHIVGEAVVEAIRQGKALEDLPLSELQKFSQVIGEDVYPILSLQSCLDKRAAKGGVSPQQVAQAIAFAQARLG

SEQ ID NO: 9135 - DNA, 1215 bp, Escherichia coli
atgaaaattattgctgtggatgtttttgttacttgtcccgggcgtaatttcgttacgcttaaaataaccactgaaagcggactttgtggattaggagatgccacgttaaatggtcgcgaattgtcggtcgcttcttatctgaaagatcatctttgtcctcaattaattggccgcgatgccagccgtatcgaagatatctggcaattcttttataaaggagcttactggcgacgtggtcccgtcacgatgtcggccatttctgccattgatatggcgttgtgggatatcaaagctaaagcggcaaatatgccattgtatcaactgcttggtggcgcttctcgtgaaggcgtgatggtttattgccacaccaccgggcggacgattgatgaagtccttgaagactatgcaaagcaccagcagatgggctttaaggcgattcgtgtgcagtgtggtgtaccgggtatgcaaaccacctatggtctggcgaagggcaaaggactggcgtatgaaccagcaaccaaaggcctgtggccagaagagcagttgtggtcttcagaaaagtatctcgattttacgccgaagttatttgaagcggtgcgtaataagttcggttttaacgaacatctgttgcatgacatgcaccatcgcctgacccccatcgaagcggcgcgctttgggaggagcattgaggattaccgcctgttctggatggaagatccgacgcctgccgagaaccaggaatgttttcgtctgattcgccagcataccgtgacgccgattgcggtcggtgaagtgtttaacagtatctgggactgcaaacagttaatcgaagagcagctgattgactatattcgcacgacgattacccatgcaggcggcattaccgggatgcgacggattgtcgattttgcatcgctttatcaggtacgtaccggttcgcatggcccttcagatttatcgcctgtttgtcatgcggcggcgctgcattttgacctctgggtgccaaactttggcgttcaggagtacatgggctattccgaacaaatgtttgaagtcttcccgcacagctggcgcttcgatgaaggttatatgcacccaggcgatgaaccggggctgggtatttctttcgatgagaaactggcggcgaaatatccgtatgacccggcgtatctccccgtcgcacgactggaagatggcacattgtggaactggtaa

SEQ ID NO: 9136 - protein, 404 aa, Escherichia coli
MKIIAVDVFVTCPGRNFVTLKITTESGLCGLGDATLNGRELSVASYLKDHLCPQLIGRDASRIEDIWQFFYKGAYWRRGPVTMSAISAIDMALWDIKAKAANMPLYQLLGGASREGVMVYCHTTGRTIDEVLEDYAKHQQMGFKAIRVQCGVPGMQTTYGLAKGKGLAYEPATKGLWPEEQLWSSEKYLDFTPKLFEAVRNKFGFNEHLLHDMHHRLTPIEAARFGRSIEDYRLFWMEDPTPAENQECFRLIRQHTVTPIAVGEVFNSIWDCKQLIEEQLIDYIRTTITHAGGITGMRRIVDFASLYQVRTGSHGPSDLSPVCHAAALHFDLWVPNFGVQEYMGYSEQMFEVFPHSWRFDEGYMHPGDEPGLGISFDEKLAAKYPYDPAYLPVARLEDGTLWNW

SEQ ID NO: 9137 - DNA, 1284 bp, Escherichia coli
atggacgttgatgtgtcaaccagtgttgcgggtaataaaccgcaacggattcgtcgtattcagacagtgaccctggttttattatttatggcggggatcgttaattttctcgaccgttcgtcattgagcgtggcaggtgaagcaattcgtggcgagttaggattatccgctaccgagtttggtgttttgctttctgcattttctctgtcttatggtttttcacaacttccttccggtattttgctagaccgctttggcccacgaatagtgttaggcgcaggcttaatattctggtcattaatgcaggcattaacaggaatggttaattcttttagccactttattttaatgcgtatcggtctgggtattggcgaagcgccatttatgcctgcgggagtaaagtcgatcaccgactggtatgcgcaaaaagaacgcggcacggcgctggggatttttaactcatctaccgttatcggtcaggctatcgcgcctcctgctcttgtattgatgcaactggcatggggctggcggacgatgtttgtcatcatcggcgtagcagggattctggttgggatctgttggtacgcgtggtatcgcaaccgggcgcagtttgtcctgaccgaggaagaacggacatatctctccgcgccggttaaaccgcgtccacagttacaatttagcgagtggctggcgctgtttaagcatcggacaacctgggggatgattttaggtttctctggcgtcaattataccggttggctctacatcgcgtggttacccggttatttgcaggccgaacaaggtttcagtctggcgaaaaccggttgggtggcggcaattcctttcctcgcggcggcggtcgggatgtgggttaacggtattgttgtcgatcggctggcgaaaaaaggctatgacctggcgaagacgcgtaaaacggcgattgtctgcggtttgatgatgtcggcattaggcacgttgctggtcgtgcaatcttcctcgccagcccaggcggtagcgtttatctcaatggcgctgttctgcgtgcatttcgcgggaacatctgcatgggggctggtgcaggtgatggtgtcagaaacaaaagtggcttccatcgccgggattcaaaactttggcagttttgtttttgcttcctttgctccgatcgtaaccggttgggtcgtggataccacacactcgtttaatctggcgctggttatcgcggcctgtgtgacgttcaccggggcgctgtgttacttctttattgtcaaagatcggattgagtaa

SEQ ID NO: 9138 - protein, 427 aa, Escherichia coli
MDVDVSTSVAGNKPQRIRRIQTVTLVLLFMAGIVNFLDRSSLSVAGEAIRGELGLSATEFGVLLSAFSLSYGFSQLPSGILLDRFGPRIVLGAGLIFWSLMQALTGMVNSFSHFILMRIGLGIGEAPFMPAGVKSITDWYAQKERGTALGIFNSSTVIGQAIAPPALVLMQLAWGWRTMFVIIGVAGILVGICWYAWYRNRAQFVLTEEERTYLSAPVKPRPQLQFSEWLALFKHRTTWGMILGFSGVNYTGWLYIAWLPGYLQAEQGFSLAKTGWVAAIPFLAAAVGMWVNGIVVDRLAKKGYDLAKTRKTAIVCGLMMSALGTLLVVQSSSPAQAVAFISMALFCVHFAGTSAWGLVQVMVSETKVASIAGIQNFGSFVFASFAPIVTGWVVDTTHSFNLALVIAACVTFTGALCYFFIVKDRIE

SEQ ID NO: 9139 - DNA, 1335 bp, Escherichia coli
atgggcctggttaagcaaggtgcgcgcgtcgcagttatcgagcgttatcaaaatgttggcggcggttgcacccactggggcaccatcccgtcgaaagctctccgtcacgccgtcagccgcattatagaattcaatcaaaacccactatacagcgaccattcccgactgctccgctcttcttttgccgatatccttaaccatgccgataacgtgattaatcaacaaacgcgcatgcgtcagggattttacgaacgtaatcactgtgaaatattgcaggggaacgctcgctttgttgatgagcatacgttggcgctggattgcccggacggcagcgtcgaaacactaactgctgaaaaatttgttattgcctgcggctctcgtccatatcatccaacagatgttgatttcacccatccacgcatttatgacagcgactcaattcttagcatgcaccacgaaccgcgccatgtacttatttacggtgctggagtgatcggctgtgaatatgcgtcgatcttccgcggtatggatgtaaaagtggatctgatcaacacccgcgatcgcctgctggcatttctcgatcaagagatgtcagattctctctcctatcacttctggaacagtggcgtagtgattcgtcacaacgaagagtacgagaagatcgaaggctgtgacgacggtgtgatcatgcatctgaagtcgggtaaaaaactgaaagctgactgtctgctctatgccaacggtcgcaccggtaataccgattcgctggcgttacagaacattgggctggaaactgacagtcgcggacagctgaaggtcaacagcatgtatcagaccgcacagccgcacgtttacgcggtgggcgacgtgattggttatccgagcctggcgtcggcagcctatgaccaggggcgcattgccgcgcaggcgctggtgaaaggtgaagccaccgcacatctgattgaagatatccctaccggcatttacaccatcccggaaatcagctctgtaggcaaaaccgaacagcagctgaccgcgatgaaagtgccatatgaagtgggccgcgcccagtttaaacatctggcacgtgcacaaatcgtcggcatgaacgtgggcacgctgaaaattttgttccatcgggaaacaaaagagattctgggtattcactgctttggcgagcgcgctgccgaaattattcatatcggtcaggcgattatggaacagaaaggtggcggcaacactattgagtacttcgtcaacaccacctttaactacccgacgatggcggaagcctatcgggtagctgcgctaaatggcttaaaccgcctgttttaa

SEQ ID NO: 9140 - protein, 444 aa, Escherichia coli
MGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 9141 - DNA, 918 bp, Escherichia coli
atgaatattcgtgatcttgagtacctggtggcattggccgaacaccgccattttcggcgtgcggcagattcctgccacgttagccagccgacgcttagcgggcaaattcgtaagctggaagatgagttgggcgtgatgttgctggagcggaccagccgtaaagtgttgttcacccaggcgggaatgctgctggtggatcaggcgcgtaccgtactgcgtgaggtgaaagtccttaaagagatggcaagccagcagggcgagacgatgtccgggccgctgcatattggtttgattcccacggttggaccgtacctgctaccgcatattatcccgatgctgcaccagacctttccaaagctggaaatgtatctgcatgaagcacagacccaccagttactggcgcaactggacagcggcaaactcgattgcgtgatcctcgcgctggtgaaagagagcgaagcattcattgaagtgccgttgtttgatgagccaatgttgctggctatctatgaagaccacccgtgggcgaaccgcgaatgcgtaccgatggccgatctggcaggggaaaaactgctgatgctggaagatggtcactgtttgcgcgatcaggcaatgggtttctgttttgaagccggggcggatgaagatacacacttccgcgcgaccagcctggaaactctgcgcaacatggtggcggcaggtagcgggatcactttactgcctgcgctggctgtgccgccggaacgcaaacgcgatggggttgtttatctgccgtgcattaagccggaaccacgccgcactattggcctggtttatcgtcctggctcaccgctgcgcagccgctatgagcagctggcagaggccatccgcgcaagaatggatggccatttcgataaagtgttaaaacaggcggtttaa

SEQ ID NO: 9142 - protein, 305 aa, Escherichia coli
MNIRDLEYLVALAEHRHFRRAADSCHVSQPTLSGQIRKLEDELGVMLLERTSRKVLFTQAGMLLVDQARTVLREVKVLKEMASQQGETMSGPLHIGLIPTVGPYLLPHIIPMLHQTFPKLEMYLHEAQTHQLLAQLDSGKLDCVILALVKESEAFIEVPLFDEPMLLAIYEDHPWANRECVPMADLAGEKLLMLEDGHCLRDQAMGFCFEAGADEDTHFRATSLETLRNMVAAGSGITLLPALAVPPERKRDGVVYLPCIKPEPRRTIGLVYRPGSPLRSRYEQLAEAIRARMDGHFDKVLKQAV

SEQ ID NO: 9143 - DNA, 1167 bp, Escherichia coli
atgatcgaacactatattcgtgggtttgaggaagaacttcgcgagatccgccatcagatccacgaaaacccggagctgggattacaagaatttaaaaccagtgctttggttgcggaaaagctgcgccagtggggctatgaggttgagcaagggctggcgacaaccggcgtggtagccacgttaaaagtgggcgacggagagaaaagtattggcctgcgggcggatatggatgcgttgccgatttatgaaaatagtggcaagccctgggccagtaaacatcctggtttaatgcacgcctgcgggcatgacgggcataccaccatactgctgggggctgcgcgttattttgccgaaacccgccgttttaacggcacgttacgccttatcttccagcctgcggaagagatgattaacggcggtgagatcatggttaaagaggggctttttgatcgtttcccctgcgatgtcattttcgggatgcacaacatgccgggtttgccggtcggcaagtttttcttccagcctggggcgctgatggcgtcaatggatcagttccatattacggttcgtggttgtggcggacacggtgcgatcccgcacaaagccatcgatccagtgctggttgccgcacatatcaccaccgcattacaaagcattgtgtcgcgcaatgtcgatccgctggaagcggcggtaattaccgtcggcagcattgttgcgggtgaggcggctaacgtcattcctgacagtgctgagatgaaaatcagtgtccgctctcttagccgcgatacccgacaacttcttctgacccgtattcctgctcttgcacaagcccaggctgccagctttggcgctacggctgaggttacgcatgttaacggtacaccggtattagtaaatgacgaggagatggcgcgcttcgcctggcaggtggcgtgcaaaacatttggtgaagatcgggctgagtttggcatcaaacccctgatgggcagtgaagatttctctttcatgctggaagcccaacccaaaggcggtttcctgttattcggtaatggcgatgtcggggaaggttcctgcatggtgcataaccccggttacgactttaacgatgcaagcctggtcccggcaagcagctactggggcgcactggttgaagcctggctgcaataa

SEQ ID NO: 9144 - protein, 388 aa, Escherichia coli
MIEHYIRGFEEELREIRHQIHENPELGLQEFKTSALVAEKLRQWGYEVEQGLATTGVVATLKVGDGEKSIGLRADMDALPIYENSGKPWASKHPGLMHACGHDGHTTILLGAARYFAETRRFNGTLRLIFQPAEEMINGGEIMVKEGLFDRFPCDVIFGMHNMPGLPVGKFFFQPGALMASMDQFHITVRGCGGHGAIPHKAIDPVLVAAHITTALQSIVSRNVDPLEAAVITVGSIVAGEAANVIPDSAEMKISVRSLSRDTRQLLLTRIPALAQAQAASFGATAEVTHVNGTPVLVNDEEMARFAWQVACKTFGEDRAEFGIKPLMGSEDFSFMLEAQPKGGFLLFGNGDVGEGSCMVHNPGYDFNDASLVPASSYWGALVEAWLQ

SEQ ID NO: 9145 - DNA, 1317 bp, Escherichia coli
atgacggcgatcgtaaatgaaaccgtgagtgtgaagaaaaagcccagcggcaggcgggtgatctttgcctcggcgtttggcaatgcgctcgaattttttgattttggcgtttacaacttttttgtggtctatatcagtacgcttttcttcccacccagtgccgatcataacgtcgcgctgttactggcatttgcaacgtttggtgtgagcttttttatgcgtccgctcggtgggattatcgttggtgcctgggccgatcgcttcgggcgtaaaccggcgatggtgttcactattgctctgatgagcctcggtacgctgatgatcggcatcgcaccgacgtatgaaacggcgggctattggggaactgcaacgctggtgctggcgcgtctaattcagggcgttgcggcaggtggtgaagtcggggcttcaatgtcgctactggtggagtcagctccggcaaatcgtcgcggcttttacagcagttggtcactggcgacccaagggctggcaacgaccttcggtggggttgttgctttaggtctgagcgcatggctaccgttcgccacaggttcagaaaccgtaatggcagaatggggctggcgtgtgccgttttttattggcgtgttattagcacctatcggttgctggttgcgtctgagcctggaaaatgacgtacctgagccagtgcgcaataaaaaagctgctaccagcgaaagcgcgttttctctgctcctgcaacataaggcgactatcgttaatggcgttttactcgctattggtagcacggtcgcaacctatatctccctcttttattacggcacctgggcggcgaagtatctggcgatgcctcaacattattctcatgcagcgatgttactggcgggggtaattacgtttgtgggtgcgctgttggtggggatgctatgtgattcggttgggcgtaaaaagctgattttaatctcccgtgtgatggtgcttctctgtagctggccgtcattctggctgttggtgaattacccaagccctggcatgttgctgacggtggttttcgtgatggtcagctttaccacgcttggcggtgtgccagtgatgttgttgatctctgaactgttgccgaaacggattcgggcattaggtttcgcgctggtttatagcattggcgtagcaatctttggcggttttgcgcaatatttcgccacgcaatccatcgtgttgctggatagtctgacggctccggcgtggtatctggggggaggcacgttgctgtcgatgctggcgttgttgtacgtaaaagaaccggccaaagaattgcagtaa

SEQ ID NO: 9146 - protein, 438 aa, Escherichia coli
MTAIVNETVSVKKKPSGRRVIFASAFGNALEFFDFGVYNFFVVYISTLFFPPSADHNVALLLAFATFGVSFFMRPLGGIIVGAWADRFGRKPAMVFTIALMSLGTLMIGIAPTYETAGYWGTATLVLARLIQGVAAGGEVGASMSLLVESAPANRRGFYSSWSLATQGLATTFGGVVALGLSAWLPFATGSETVMAEWGWRVPFFIGVLLAPIGCWLRLSLENDVPEPVRNKKAATSESAFSLLLQHKATIVNGVLLAIGSTVATYISLFYYGTWAAKYLAMPQHYSHAAMLLAGVITFVGALLVGMLCDSVGRKKLILISRVMVLLCSWPSFWLLVNYPSPGMLLTVVFVMVSFTTLGGVPVMLLISELLPKRIRALGFALVYSIGVAIFGGFAQYFATQSIVLLDSLTAPAWYLGGGTLLSMLALLYVKEPAKELQ

SEQ ID NO: 9147 - DNA, 705 bp, Escherichia coli
atgttcattctctggtatagtgccagcagtacttttggcaaggattcagacatcgtgatgggcgtaagagcgcaacaaaaagaaaaaacccgccgttcgctggtggaagccgcatttagccaattaagtgctgaacgcagcttcgccagcctgagtttgcgtgaagtggcacgagaagcaggcattgctcccacctctttttatcggcatttccgcgacgtagacgaactgggtctgaccatggttgatgagagcggtttaatgctacgccaactcatgcgtcaggcgcgtcagcgtatcgccaaaggcgggagtgtgatccgcacctcggtctccacatttatggagttcatcggtaataatcctaacgccttccggttattattgcgggaacgctccggcacctccgctgcgtttcgtgccgccgttgcgcgtgaaattcagcacttcattgcggaacttgcggactatctggaactcgaaaaccatatgccgcgtgcgtttactgaagcgcaagccgaagcaatggtgacgattgtcttcagtgcgggggccgaggcgttggatgtcggcgtcgagcaacgccggcaattagaagagcgactggtactgcagctgcgaatgatttcgaaaggggcttattactggtatcgccgtgaacaagagaaaaccacaattattccgggaaatgtgaaggacgagtaa

SEQ ID NO: 9148 - protein, 234 aa, Escherichia coli
MFILWYSASSTFGKDSDIVMGVRAQQKEKTRRSLVEAAFSQLSAERSFASLSLREVAREAGIAPTSFYRHFRDVDELGLTMVDESGLMLRQLMRQARQRIAKGGSVIRTSVSTFMEFIGNNPNAFRLLLRERSGTSAAFRAAVAREIQHFIAELADYLELENHMPRAFTEAQAEAMVTIVFSAGAEALDVGVEQRRQLEERLVLQLRMISKGAYYWYRREQEKTTIIPGNVKDE

SEQ ID NO: 9149 - DNA, 360 bp, Escherichia coli
atgaaacaagcaaatcaagatagaggtacgctgctgctagcgttggttgctggcttatcgatcaatggtacttttgcagcgctgtttagctccattgtaccattttctgtattcccgattatttccctggtgttgacagtttactgcctgcatcaacgttatcttaatcgcactatgccggtaggcttgccgggtctggcagctgcttgttttattctcggcgtactgctgtacagcacggtagttcgtgcggaatatccggatatcggctctaacttcttcccggcagtactgtccgtcattatggtgttctggattggcgcgaagatgcgtaaccgtaagcaggaagttgctgagtaa

SEQ ID NO: 9150 - protein, 119 aa, Escherichia coli
MKQANQDRGTLLLALVAGLSINGTFAALFSSIVPFSVFPIISLVLTVYCLHQRYLNRTMPVGLPGLAAACFILGVLLYSTVVRAEYPDIGSNFFPAVLSVIMVFWIGAKMRNRKQEVAE

SEQ ID NO: 9151 - DNA, 1101 bp, Escherichia coli
atgacccccgaacaccttccaacagaacagtatgaagcgcagttagccgaaaaagtggtacgtttgcaaagtatgatggcaccgttttctgacctggttccggaagtgtttcgctcgccggtcagtcattatcggatgcgtgcggagttccgcatctggcacgatggcgatgacctgtaccacatcattttcgatcaacaaaccaaaagtcgtatccgtgtggatagcttccccgccgccagtgaacttatcaaccagttgatgacggcgatgattgcgggtgtgcgtaataatcccattctgcgccacaagttgttccagattgattacctcactacgctaagcaatcaagcggttgtttccttgctgtaccataaaaagctggatgatgagtggcgtcagcaggcggaagccctgcgcgatgcactgcgcgcgcagaatctgaatgtgcatctgattggtcgggcaacgaaaaccaaaatcgcgctggatcaggattacatcgacgaacgtctgccgatcgcggggaaagagatgatctaccgtcaggtagaaaacagctttacccaaccgaacgcggcgatgaatattcagatgctggaatgggcgctggacgtaaccaaaggctcaaaaggcgatttactggagctatactgcggcaacggtaacttttcattagcgctggcacgcaattttgatcgggtattagccaccgaaatcgccaagccgtcagtcgccgccgcgcaatacaacattgccgctaaccatattgataacgtacaaattattcgtatggcggcagaagaatttactcaggcgatgaatggtgtgcgcgagtttaaccgcctgcaaggaatcgacttaaagagttatcagtgcgaaaccatttttgtcgacccaccgcgcagcggtctggacagtgaaaccgagaaaatggtgcaggcgtatccacgtattctgtatatctcctgcaatccggaaacgttatgcaagaatctggaaacattaagccagacgcacaaggtcgaacgtctggctctatttgatcagttcccctacacgcaccatatggagtgcggcgtattactgaccgcgaagtaa

SEQ ID NO: 9152 - protein, 366 aa, Escherichia coli
MTPEHLPTEQYEAQLAEKVVRLQSMMAPFSDLVPEVFRSPVSHYRMRAEFRIWHDGDDLYHIIFDQQTKSRIRVDSFPAASELINQLMTAMIAGVRNNPILRHKLFQIDYLTTLSNQAVVSLLYHKKLDDEWRQQAEALRDALRAQNLNVHLIGRATKTKIALDQDYIDERLPIAGKEMIYRQVENSFTQPNAAMNIQMLEWALDVTKGSKGDLLELYCGNGNFSLALARNFDRVLATEIAKPSVAAAQYNIAANHIDNVQIIRMAAEEFTQAMNGVREFNRLQGIDLKSYQCETIFVDPPRSGLDSETEKMVQAYPRILYISCNPETLCKNLETLSQTHKVERLALFDQFPYTHHMECGVLLTAK

SEQ ID NO: 9153 - DNA, 1890 bp, Escherichia coli
ttgatgaaacctgcggcatccttcttctattgtggatgctttacaatgattaaaaaagcttcgctgctgacggcgtgttctgtcacggcattttccgcttgggcacaggataccagcccggatactctcgtcgttactgctaaccgttttgaacaaccgcgcagcactgtgcttgcgccaactactgttgtgacgcgtcaggatatcgaccgctggcagtcgacctcggtcaatgatgtgctgcgccgtcttccgggcgtggatatcacccaaaacggcggttcaggtcagctctcatctatttttattcgcggtacaaatgccagtcatgtgttggtgttaattgatggcgtccgcctgaatttggcgggggtgagtggttctgctgatcttagtcagttccctattgcgcttgtccagcgtgttgaatatatccgtgggccgcgctccgctgtttatggttcagatgcaataggcggggtcgtgaatatcatcacgacgcgcgatcaccccggaacggaaatttcagcagggtggggaagcaatagttatcagaactatgatgtttctacacagcaacaactgggggataagacacgggtaacgctgttgggcgattatgcccatactcatggttatgatgttgtcgcctatggtaataccggaacgcaagcgcagccagataacgatggttttttaagtaaaacgctttatggcgcgctggagcataattttactgatgtctggagcggctttgtgcgcggctatggctatgataatcgtaccaattatgacgcatattattctcccggcttgccactggtcgatacccgtaaactctatagccaaagttgggatgccggactgcgctataacggcgaactgattaaatcacaactgattaccagctacagccatagcaaagattacaactacgatccgcattatggtcgttatgattcgtccgcgacgctcgatgagatgaaacagtacaccgtccagtgggcaaacaacatcatcattggccacggtaatattggtgcgggtgttgactggcagaagcagagcacggcaccgggcacagcttatgttgaggatggatatgatcaacgtaataccggcatctatctgactgggctgcaacaagtcggcgattttacttttgaaggcgcaggacgcagcgacgataattctcagtttggtcgtcatggtacctggcaaaccagcgccggttgggagttcatcgaaggttatcgctttattgcttcctacggaacatcttataaggcaccaaatcttgggcaactgtatggcacctacggtaatccgaatctgaatcctgagaaaagcaaacaatgggaaggcgcgtttgaaggcttaactgctggggttaactggcgtatttccggatatcgtaacgatgtcagtgacttgatcgattatgatgatcacaccctgaaatattacaacgaagggaaagcgcggattaagggtgtcgaggcgaccgctaattttgataccggaccactgacgcatactgtgagttatgattatgttgatgcgcgcaatgcaattactgacacgccgttgttacgccgtgctaaacagcaggtgaaataccagctcgactggcagttgtatgacttcgactgggggattacttatcagtatttaggcactcgctatgataaggattactcatcttatccttatcaaaccgttaaaatgggcggtgtgagcttgtgggatcttgcggttgcgtatccggtcacctctcacctgacagttcgtggtaaaatagccaacctgttcgacaaagattatgagacagtctatggctaccaaactgcaggacgggaatacaccttgtctggcagctacaccttctga

SEQ ID NO: 9154 - protein, 629 aa, Escherichia coli
MMKPAASFFYCGCFTMIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGTYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 9155 - DNA, 858 bp, Escherichia coli
atggctaccaaactgcaggacgggaatacaccttgtctggcagctacaccttctgaaccacgtcccaccgtgctggtgtttgactccggcgtcggtgggttgtcggtctatgacgagatccggcatctcttaccggatctccattacatttatgctttcgataacgtcgctttcccgtatggcgaaaaaagcgaagtgtttattgttgagcgagtggtggaaattgtcaccgcagtgcaagaacgttatccccttgcgctggctgtggtcgcttgcaacaccgccagtaccgtttcacttcctgcattacgcgaaaagttcgacttcccggttgttggtgtcgtgccggcgattaaacctgctgcacgtctgacggcaaatggcattgtcggattactggcaacccgcggaactgttaaacgttcttatactcatgagctgatcgcgcgtttcgctaatgaatgccagatagaaatgctgggctcggcagagatggttgagttggctgaagcgaagctgcatggcgaagatgtttctctggatgcgctaaaacgtatcctacgcccgtggttaagaatgaaagagccgccagataccgttgtactggggtgtacccatttccctctactacaagaagaactgttacaggtgctgccagagggaacccggctggtggattctggcgcagcgattgctcgccgaacggcctggctgttagaacatgaagccccggatgcaaaatctgccgatgcgaatattgccttttgtatggcaatgacgccagaagctgaacaattattgcccgttttacagcgttacggcttcgaaacgctcgaaaaactggcagttttaggctga

SEQ ID NO: 9156 - protein, 285 aa, Escherichia coli
MATKLQDGNTPCLAATPSEPRPTVLVFDSGVGGLSVYDEIRHLLPDLHYIYAFDNVAFPYGEKSEVFIVERVVEIVTAVQERYPLALAVVACNTASTVSLPALREKFDFPVVGVVPAIKPAARLTANGIVGLLATRGTVKRSYTHELIARFANECQIEMLGSAEMVELAEAKLHGEDVSLDALKRILRPWLRMKEPPDTVVLGCTHFPLLQEELLQVLPEGTRLVDSGAAIARRTAWLLEHEAPDAKSADANIAFCMAMTPEAEQLLPVLQRYGFETLEKLAVLG

SEQ ID NO: 9157 - DNA, 126 bp, Escherichia coli; identical to SEQ ID NO: 637

SEQ ID NO: 9158 - protein, 41 aa, Escherichia coli; identical to SEQ ID NO: 638

SEQ ID NO: 9159 - DNA, 1029 bp, Escherichia coli
atgaaccactccttaaaaccctggaacacatttggcattgatcataatgctcagcacattgtatgtgccgaagacgaacaacaattactcaatgcctggcagcatgcaaccgcagaaggacaacccgttcttattctgggtgaaggaagtaatgtactttttctggaggactatcgcggcacggtgatcatcaaccggatcaaaggtatcgaaattcatgatgaacctgatgcgtggtatttacatgtaggagccggagaaaactggcatcgcctggtaaaatacactttgcaggaaggtatgcctggtctggaaaatctggcattaattcctggttgtatcggctcatcacctatccagaatattggtgcttatggcgtagaattacagcgagtttgcgcttatgttgattgtgttgaactggcgacaggcaagcaagtacgcttaactgccaaagagtgccgttttggctatcgagacagtatttttaaacatgaataccaggatcgcttcgccattgtagccgtaggtctgcgtctgccaaaagagtggcaacctgtactgacgtatggtgacttaactcgcctggatccttcaacggtaacgccacagcaagtatttgatgcggtgtgtcatatgcgcaccaccaaactccctgatccaaaagtgaacggtaatgcgggtagtttcttcaaaaatcctgttgtttctgccgaaactgctaacgcgttgttggcacaatttccaacagccccacattacccccaggtggatggttcagtaaaactggccgcgggttggcttattgatcagtgccagcttaaagggacgcaaattggtggggctgcggtacaccgtcaacaggcgctggttctcataaatgagcacgatgcaaaaagcgaagatgttgtacagctggcgcatcatgtaagacaaaaagtgggtgaaaaatttaatgtctggcttgagcctgaagtccgctttattggtgcatcaggtgaagtgagcgcagtggagacaatttcatga

SEQ ID NO: 9160 - protein, 342 aa, Escherichia coli
MNHSLKPWNTFGIDHNAQHIVCAEDEQQLLNAWQHATAEGQPVLILGEGSNVLFLEDYRGTVIINRIKGIEIHDEPDAWYLHVGAGENWHRLVKYTLQEGMPGLENLALIPGCIGSSPIQNIGAYGVELQRVCAYVDCVELATGKQVRLTAKECRFGYRDSIFKHEYQDRFAIVAVGLRLPKEWQPVLTYGDLTRLDPSTVTPQQVFDAVCHMRTTKLPDPKVNGNAGSFFKNPVVSAETANALLAQFPTAPHYPQVDGSVKLAAGWLIDQCQLKGTQIGGAAVHRQQALVLINEHDAKSEDVVQLAHHVRQKVGEKFNVWLEPEVRFIGASGEVSAVETIS

SEQ ID NO: 9161 - DNA, 966 bp, Escherichia coli
atgaaggataacaccgtgccactgaaattgatcgccctgttagcgaatggcgaatttcactctggcgagcagttgggtgaaacgctgggaatgagccgggcggctattaataaacacattcagacactgcgtgactggggcgttgatgtatttactgttccgggtaaaggatacagcttgcccgagccaatccagttacttaatgccgaaaagatattgagtcagctggatgacggcagtgtagccgtgctgccagttattgactccacgaatcagtatctcctggaccgcatcggagagcttaaatctggcgatgcctgtgttgcagaataccagcatgctggccgtggtcgtcgtggtcggaaatggttttcgccttttggcgcgaacttatatttgtcgatgttctggcgtctggaacagggcccggcggcggcgattggtttaagtctggttatcggtatcgtgatggcggaagtattacgcaagctgggtgcagataaagttcgtgttaaatggcctaatgacctctatctgcaggatcgcaagctggcaggcattcttgtggagctgactggcaaaaccggcgatgcggcgcaaatagtcattggtgcagggatcaacatggcaatgcgtcgtgttgaagagagtgtcgttaatcaagggtggatcacgctgcaggaagccgggatcaatctcgatcgtaatactcttgcggccatgctgatacgtgaattacgcgcggcgctggaactcttcgagcaagaaggattgacaccttatctttcgcgctgggaaaagttggataattttattaatcgcccagtgaaacttatcattggtgataaagaaatatttggcatttcacgcggaatagacaaacagggtgctttattacttgagcaggatggaataataaaaccctggatgggcggtgaaatatccctgcgtagtgcagaaaaataa

SEQ ID NO: 9162 - protein, 321 aa, Escherichia coli
MKDNTVPLKLIALLANGEFHSGEQLGETLGMSRAAINKHIQTLRDWGVDVFTVPGKGYSLPEPIQLLNAEKILSQLDDGSVAVLPVIDSTNQYLLDRIGELKSGDACVAEYQHAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLTPYLSRWEKLDNFINRPVKLIIGDKEIFGISRGIDKQGALLLEQDGIIKPWMGGEISLRSAEK

SEQ ID NO: 9163 - DNA, 1107 bp, Escherichia coli
ttgcttttcaacgatagcttcctgggagagattttttcttattattcctccccatctggtgttaccctcctgcccattaacccattcaacagaactgtgacgcgccatggcaaatatcgctttgccgatagagctatgaccgccagaaacatgcttatgagtataaaagagcaaacgttaatgacgccttacctacagtttgaccgcaaccagtgggcagctctgcgtgattccgtacctatgacgttatcggaagatgagatcgcccgtctcaaaggtattaatgaagatctctcgttagaagaagttgccgagatctatttacctctgtcacgtttgctgaacttctatataagctcgaatctgcgccgtcaggcagttctggaacagtttcttggtaccaacgggcaacgcattccttacattatcagtattgctggtagtgtcgcggtggggaaaagtacaaccgcccgtgtattgcaggcgctattaagccgttggccggaacatcgtcgtgttgaactgatcactacagatggcttccttcaccctaatcaggttctgaaagaacgtggtctgatgaagaagaaaggcttcccggaatcgtatgatatgcatcgcctggtgaagtttgtttccgatctcaaatccggcgtgccaaacgttacagcccctgtttactcgcatcttatttatgatgtgatcccggatggagataaaactgttgttcagcctgatattttaattcttgaagggttaaatgtcttacagagcgggatggattatccacacgatccacatcatgtatttgtttctgattttgtcgatttttcgatatatgttgatgcaccggaagacttacttcagacgtggtatatcaaccgttttctgaaattccgcgaaggggcttttacagacccggattcctattttcataactacgcgaaattaactaaagaagaagctattaagactgccatgacattgtggaaagagatcaactggctgaacttaaagcaaaatattctacctactcgcgagcgtgccagtttaatcctgacgaaaagtgctaatcatgcagtagaagaggtcagactacgcaaataa

SEQ ID NO: 9164 - protein, 368 aa, Escherichia coli
MLFNDSFLGEIFSYYSSPSGVTLLPINPFNRTVTRHGKYRFADRAMTARNMLMSIKEQTLMTPYLQFDRNQWAALRDSVPMTLSEDEIARLKGINEDLSLEEVAEIYLPLSRLLNFYISSNLRRQAVLEQFLGTNGQRIPYIISIAGSVAVGKSTTARVLQALLSRWPEHRRVELITTDGFLHPNQVLKERGLMKKKGFPESYDMHRLVKFVSDLKSGVPNVTAPVYSHLIYDVIPDGDKTVVQPDILILEGLNVLQSGMDYPHDPHHVFVSDFVDFSIYVDAPEDLLQTWYINRFLKFREGAFTDPDSYFHNYAKLTKEEAIKTAMTLWKEINWLNLKQNILPTRERASLILTKSANHAVEEVRLRK

SEQ ID NO: 9165 - DNA, 408 bp, Escherichia coli
  n 389, 390, 391, 392, 393: n is any nucleotide
atgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcgcacgtagactgcccggggcacgccgactatgttaaaaacatgatcaccggtgctgctcagatggacggcgcgatcctggtagttgctgcgactgacggcccgatgccgcagactcgtgagcacatcctgctggggcgtcaggtaggcgttccgtnnnnncattccattcattaa

SEQ ID NO: 9166 - protein, 135 aa, Escherichia coli
  Xaa 130, 131: Xaa is any amino acid
MSKEKFERTKPHVNVGTIGHVDHGKTTLTAAITTVLAKTYGGAARAFDQIDNAPEEKARGITINTSHVEYDTPTRHYAHVDCPGHADYVKNMITGAAQMDGAILVVAATDGPMPQTREHILLGRQVGVPXXHSIH

SEQ ID NO: 9167 - DNA, 408 bp, Escherichia coli; identical to SEQ ID NO: 9165
  n 389, 390, 391, 392, 393: n is any nucleotide

SEQ ID NO: 9168 - protein, 135 aa, Escherichia coli; identical to SEQ ID NO: 9166
  Xaa 130, 131: Xaa is any amino acid

SEQ ID NO: 9169 - DNA, 300 bp, Escherichia coli
  n 8, 9, 10, 11, 12: n is any nucleotide
atgaatgnnnnnaagccgcacaccaagttcgaatctgaagtgtacattctgtccaaagatgaaggcggtcgtcatactccgttcttcaaaggctaccgtccgcagttctacttccgtactactgacgtgactggtaccatcgaactgccggaaggtgtagagatggtaatgccgggcgacaacatcaaaatggttgttaccctgatccacccgatcgcgatggacgacggtctgcgtttcgcaatccgtgaaggcggccgtaccgttggcgcgggcgttgtagcaaaagttctgagctaa

SEQ ID NO: 9170 - protein, 99 aa, Escherichia coli
  Xaa 3, 4: Xaa is any amino acid
MNXXKPHTKFESEVYILSKDEGGRHTPFFKGYRPQFYFRTTDVTGTIELPEGVEMVMPGDNIKMVVTLIHPIAMDDGLRFAIREGGRTVGAGVVAKVLS

SEQ ID NO: 9171 - DNA, 384 bp, Escherichia coli
atgagtgcgaataccgaagctcaaggaagcgggcgcggcctggaagcgatgaagtgggtcgttgtggtggcattgctcctggtagcgattgtcggcaactacctttatcgcgacattatgctgccgctgcgtgcgctggccgtagtaattctgattgctgcagcgggtggtgtcgcgctgttaacgacaaaaggtaaagcaaccgttgcttttgcccgtgaagcgcgtaccgaagtccgtaaggtcatttggccgactcgccaggaaacattgcacaccacgctgattgtggctgcggttaccgcagtaatgtcactgatcctgtggggactggatggtattctggttcgcctggtatcctttatcactggcctgaggttctga

SEQ ID NO: 9172 - protein, 127 aa, Escherichia coli
MSANTEAQGSGRGLEAMKWVVVVALLLVAIVGNYLYRDIMLPLRALAVVILIAAAGGVALLTTKGKATVAFAREARTEVRKVIWPTRQETLHTTLIVAAVTAVMSLILWGLDGILVRLVSFITGLRF

SEQ ID NO: 9173 - DNA, 546 bp, Escherichia coli
atgtctgaagctcctaaaaagcgctggtacgtcgttcaggcgttttccggttttgaaggccgcgtagcaacgtcgctgcgtgagcatatcaaattacacaacatggaagagttgtttggtgaagtcatggtaccaaccgaagaagtggttgaaatccgtggcggtcagcgtcgcaaaagcgaacgtaaattcttccctggctacgtcctcgttcagatggtgatgaacgacgcgagctggcacctggtgcgcagcgtaccgcgtgtgatgggcttcatcggcggtacttccgatcgtcctgcgccaatcagcgataaagaagtcgatgcgattatgaaccgcctgcagcaggttggtgataagccgcgtccgaaaacgttgtttgaaccgggtgaaatggtccgtgttaatgatggtccgttcgctgacttcaacggcgttgttgaagaagttgattacgagaaatctcgtctgaaagtgtctgtttctatcttcggtcgtgcgacccctgtagagctggacttcagccaggttgaaaaagcttaa

SEQ ID NO: 9174 - protein, 181 aa, Escherichia coli
MSEAPKKRWYVVQAFSGFEGRVATSLREHIKLHNMEELFGEVMVPTEEVVEIRGGQRRKSERKFFPGYVLVQMVMNDASWHLVRSVPRVMGFIGGTSDRPAPISDKEVDAIMNRLQQVGDKPRPKTLFEPGEMVRVNDGPFADFNGVVEEVDYEKSRLKVSVSIFGRATPVELDFSQVEKA

SEQ ID NO: 9175 - DNA, 429 bp, Escherichia coli
atggctaagaaagtacaagcctatgtcaagctgcaggttgcagctggtatggctaacccgagtccgccagtaggtccggctctgggtcagcagggcgtaaacatcatggaattctgcaaagcgttcaacgcaaaaactgattccatcgaaaaaggtctgccgattccggtagtaatcactgtttacgctgaccgttctttcactttcgttaccaagactccgccggcagcagttctgctgaaaaaagcggctggtatcaagtctggttccggtaagccgaacaaagacaaagtgggtaaaatttcccgcgctcagctgcaggaaatcgcgcagaccaaagctgccgacatgactggtgccgacattgaagcgatgactcgctccatcgaaggtactgcacgttccatgggcctggtagtggaggactaa

SEQ ID NO: 9176 - protein, 142 aa, Escherichia coli
MAKKVQAYVKLQVAAGMANPSPPVGPALGQQGVNIMEFCKAFNAKTDSIEKGLPIPVVITVYADRSFTFVTKTPPAAVLLKKAAGIKSGSGKPNKDKVGKISRAQLQEIAQTKAADMTGADIEAMTRSIEGTARSMGLVVED

SEQ ID NO: 9177 - DNA, 705 bp, Escherichia coli
atggctaaactgaccaagcgcatgcgtgttatccgcgagaaagttgatgcaaccaaacagtacgacatcaacgaagctatcgctctgctgaaagaactggcgactgctaaattcgtagaaagcgtggacgtagctgttaacctcggcatcgacgctcgtaaatctgaccagaacgtacgtggtgcaactgtactgccgcacggtactggccgttccgttcgcgtagccgtatttacccagggtgcaaacgctgaagctgctaaagctgcaggtgctgaactggtaggtatggaagatctggctgaccagatcaagaaaggcgaaatgaactttgacgttgttattgcttctccggatgcaatgcgcgttgttggccagctgggccaggttctgggtccgcgcggcctgatgccaaacccgaaagtgggtactgtaacgccgaacgttgctgaagcggttaaaaacgctaaagctggccaggttcgttaccgtaacgacaaaaacggcatcatccacaccaccatcggtaaagtggactttgacgctgacaaactgaaagaaaacctggaagctctgctggttgcgctgaaaaaagcaaaaccgactcaggcgaaaggcgtgtacatcaagaaagttagcatctctaccaccatgggtgcaggtgttgcagttgaccaggctggcctgagcgcttctgtaaactaa

SEQ ID NO: 9178 - protein, 234 aa, Escherichia coli
MAKLTKRMRVIREKVDATKQYDINEAIALLKELATAKFVESVDVAVNLGIDARKSDQNVRGATVLPHGTGRSVRVAVFTQGANAEAAKAAGAELVGMEDLADQIKKGEMNFDVVIASPDAMRVVGQLGQVLGPRGLMPNPKVGTVTPNVAEAVKNAKAGQVRYRNDKNGIIHTTIGKVDFDADKLKENLEALLVALKKAKPTQAKGVYIKKVSISTTMGAGVAVDQAGLSASVN

SEQ ID NO: 9179 - DNA, 498 bp, Escherichia coli
atggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgcgaagctggcgtatacatgcgtgttgttcgtaacaccctgctgcgccgtgctgttgaaggtactccgttcgagtgcctgaaagatgcgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtctcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaa

SEQ ID NO: 9180 - protein, 165 aa, Escherichia coli
MALNLQDKQAIVAEVSEVAKGALSAVVADSRGVTVDKMTELRKAGREAGVYMRVVRNTLLRRAVEGTPFECLKDAFVGPTLIAYSMEHPGAAARLFKEFAKANAKFEVKAAAFEGELIPASQIDRLATLPTYEEAIARLMATMKEASAGKLVRTLAAVRDAKEAA

SEQ ID NO: 9181 - DNA, 366 bp, Escherichia coli
atgtctatcactaaagatcaaatcattgaagcagttgcagctatgtctgtaatggacgttgtagaactgatctctgcaatggaagaaaaattcggtgtttccgctgctgctgctgtagctgtagctgctggcccggttgaagctgctgaagaaaaaactgaattcgacgtaattctgaaagctgctggcgctaacaaagttgctgttatcaaagcagtacgtggcgcaactggcctgggtctgaaagaagctaaagacctggttgaatctgcaccggctgctctgaaagaaggcgtgagcaaagacgacgcagaagcactgaaaaaagctctggaagaagctggcgctgaagttgaagttaaataa

SEQ ID NO: 9182 - protein, 121 aa, Escherichia coli
MSITKDQIIEAVAAMSVMDVVELISAMEEKFGVSAAAAVAVAAGPVEAAEEKTEFDVILKAAGANKVAVIKAVRGATGLGLKEAKDLVESAPAALKEGVSKDDAEALKKALEEAGAEVEVK

SEQ ID NO: 9183 - DNA, 4062 bp, Escherichia coli
atgggtcgacttgtcagcgagctgaggaaccctatggtttactcctataccgagaaaaaacgtattcgtaaggattttggtaaacgtccacaagttctggatgtaccttatctcctttctatccagcttgactcgtttcagaaatttatcgagcaagatcctgaagggcagtatggtctggaagctgctttccgttccgtattcccgattcagagctacagcggtaattccgagctgcaatacgtcagctaccgccttggcgaaccggtgtttgacgtccaggaatgtcaaatccgtggcgtgacctattccgcaccgctgcgcgttaaactgcgtctggtgatctatgagcgcgaagcgccggaaggcaccgtaaaagacattaaagaacaagaagtctacatgggcgaaattccgctcatgacggacaacggtacctttgttatcaacggtactgagcgtgttatcgtttcccagctgcaccgtagtccgggggtcttttttgactccgacaaaggtaaaacccactcttcgggtaaggtgctgtataacgcgcgcatcatcccttaccgtggttcctggctggacttcgaattcgatccgaaggacaacctgttcgtacgtatcgaccgtcgccgtaaactacctgcgacaatcattctgcgtgccctgaactacaccacagagcagatcctcgacctgttctttgaaaaagttatctttgaaatccgtgataacaagttgcagatggaactggtgccggaacgcctgcgtggtgaaaccgcatcttttgacatcgaagctaacggtaaagtgtacgtagaaaaaggccgccgcattactgcgcgccatattcgccagctggaaaaagacgacgtcaagctgatcgaagttccggttgagtacatcgcaggtaaagtggttgctaaagactacattgatgagtctaccggcgagctgatctgcgcagcgaacatggagctgagcctggatctgctggctaagctgagccagtctggtcataagcgtatcgaaacgctgttcaccaacgatctggatcacggcccatatatctctgaaaccttacgtgtcgacccaactaacgaccgtctgagcgcactggtagaaatctaccgtatgatgcgccctggcgagccgccgactcgtgaagctgctgaaagcctgttcgagaacctgttcttctccgaagaccgctatgacttgtctgcggttggtcgtatgaagttcaaccgttctctgctgcgcgaagaaatcgaaggttccggtatcctgagcaaagacgacatcattgatgttatgaaaaagctcatcgatatccgtaacggtaaaggcgaagttgatgatatcgaccacctcggcaaccgtcgtatccgttctgttggcgaaatggcggaaaaccagttccgcgttggcctggtacgtgtagagcgtgcggtgaaagagcgtctgtctctgggcgatctggataccctgatgcctcaggatatgatcaacgccaagccgatttccgcagcagtgaaagagttcttcggttccagccagctgtctcagtttatggaccagaacaacccgctgtctgagattacgcacaaacgtcgtatctcggcactcggcccaggcggtctgacccgtgaacgtgcaggcttcgaagttcgagacgtacacccgactcactacggtcgcgtatgtccaatcgaaacccctgaaggtccgaacatcggtctgatcaactccctgtccgtgtacgcacagactaacgaatacggcttccttgagactccgtatcgtaaagtgaccgacggtgttgtaactgacgaaattcactatctgtctgctatcgaagaaggcaactacgttatcgcccaggcgaactccaacctggatgaagaaggccacttcgtagaagacctggtaacttgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggccgttccgactctgcgtgctgataagccgctggttggtacgggtatggaacgtgctgttgccgttgactccggtgtaactgcggttgctaaacgtggtggtgtcgttcagtacgtggatgcttcccgtatcgttatcaaagttaacgaagacgagatgtatccgggtgaagcaggtatcgacatctacaacctgaccaagtacacccgttctaaccagaacacctgtatcaaccagatgccgtgtgtgtctctgggtgaaccggtagaacgcggcgacgtgctggcagacggtccgtccaccgatctcggtgaactggcgcttggtcagaacatgcgcgtagcgttcatgccgtggaatggttacaacttcgaagactccatcctcgtatccgagcgtgttgttcaggaagaccgtttcaccaccatccatattcaggaactggcgtgtgtgtcccgtgataccaagctggggccggaagagatcaccgctgacatcccgaacgtgggtgaagctgctctctccaaactggatgaatccggtatcgtttacattggtgcggaagtgaccggtggcgacattctggttggtaaggtaacgccgaaaggtgaaactcagctgaccccagaagaaaaactgctgcgtgcgatcttcggtgagaaagcgtctgacgttaaagactcttctctgcgcgtaccaaacggtgtatccggtacggttatcgatgttcaggtctttactcgcgatggcgtagaaaaagacaaacgtgcgctggaaatcgaagaaatgcagctcaaacaggcgaagaaagacctgtctgaagaactgcagatcctcgaagcgggtctgttcagccgtatccgtgctgtgctggtagccggtggcgttgaagctgagaaactcgacaaactgccgcgcgatcgctggctggagctgggcctgaccgacgaagagaaacaaaatcagctggaacagctggctgagcagtatgacgaactgaaacacgagttcgagaagaaactcgaagcgaaacgccgcaaaatcacccagggcgacgatctggcaccgggcgtgctgaagattgttaaggtatatctggcggttaaacgccgtatccagcctggtgacaagatggcaggccgtcatggtaacaagggtgtaatttctaagatcaacccgatcgaagatatgccttacgatgaaaacggtactccggtagacatcgtactgaacccgctgggcgtaccgtctcgtatgaacattggtcagatcctcgaaacccacctgggtatggctgcgaaaggtatcggcgacaagatcaacgccatgctgaaacagcagcaagaagtcgcgaaactgcgcgaattcatccagcgtgcgtacgatctgggcgctgatgttcgtcagaaagttgacctgagtaccttcagcgatgaagaagttatgcgtctggctgaaaacctgcgcaaaggtatgccaatcgcaacgccggtcttcgacggtgcgaaagaagcagaaattaaagagctgctgaaacttggcgacctgccgacttctggtcagatccgcctgtacgacggtcgcactggtgaacagttcgagcgtccggtaaccgttggttacatgtacatgctgaaactgaaccacctggtcgacgacaagatgcacgcgcgttccaccggttcttacagcctggttactcagcagccgctgggtggtaaggcacagttcggtggtcagcgtttcggggagatggaagtgtgggcgctggaagcatatggcgcagcatacaccctgcaggaaatgctcaccgttaagtctgatgacgtgaacggccgtactaagatgtataaaaacatcgtggacggcaaccatcagatggagccgggcatgccagaatccttcaacgtattgttgaaagagattcgttcgctgggtatcaacatcgaactggaagacgagtaa

SEQ ID NO: 9184 - protein, 1353 aa, Escherichia coli
MGRLVSELRNPMVYSYTEKKRIRKDFGKRPQVLDVPYLLSIQLDSFQKFIEQDPEGQYGLEAAFRSVFPIQSYSGNSELQYVSYRLGEPVFDVQECQIRGVTYSAPLRVKLRLVIYEREAPEGTVKDIKEQEVYMGEIPLMTDNGTFVINGTERVIVSQLHRSPGVFFDSDKGKTHSSGKVLYNARIIPYRGSWLDFEFDPKDNLFVRIDRRRKLPATIILRALNYTTEQILDLFFEKVIFEIRDNKLQMELVPERLRGETASFDIEANGKVYVEKGRRITARHIRQLEKDDVKLIEVPVEYIAGKVVAKDYIDESTGELICAANMELSLDLLAKLSQSGHKRIETLFTNDLDHGPYISETLRVDPTNDRLSALVEIYRMMRPGEPPTREAAESLFENLFFSEDRYDLSAVGRMKFNRSLLREEIEGSGILSKDDIIDVMKKLIDIRNGKGEVDDIDHLGNRRIRSVGEMAENQFRVGLVRVERAVKERLSLGDLDTLMPQDMINAKPISAAVKEFFGSSQLSQFMDQNNPLSEITHKRRISALGPGGLTRERAGFEVRDVHPTHYGRVCPIETPEGPNIGLINSLSVYAQTNEYGFLETPYRKVTDGVVTDEIHYLSAIEEGNYVIAQANSNLDEEGHFVEDLVTCRSKGESSLFSRDQVDYMDVSTQQVVSVGASLIPFLEHDDANRALMGANMQRQAVPTLRADKPLVGTGMERAVAVDSGVTAVAKRGGVVQYVDASRIVIKVNEDEMYPGEAGIDIYNLTKYTRSNQNTCINQMPCVSLGEPVERGDVLADGPSTDLGELALGQNMRVAFMPWNGYNFEDSILVSERVVQEDRFTTIHIQELACVSRDTKLGPEEITADIPNVGEAALSKLDESGIVYIGAEVTGGDILVGKVTPKGETQLTPEEKLLRAIFGEKASDVKDSSLRVPNGVSGTVIDVQVFTRDGVEKDKRALEIEEMQLKQAKKDLSEELQILEAGLFSRIRAVLVAGGVEAEKLDKLPRDRWLELGLTDEEKQNQLEQLAEQYDELKHEFEKKLEAKRRKITQGDDLAPGVLKIVKVYLAVKRRIQPGDKMAGRHGNKGVISKINPIEDMPYDENGTPVDIVLNPLGVPSRMNIGQILETHLGMAAKGIGDKINAMLKQQQEVAKLREFIQRAYDLGADVRQKVDLSTFSDEEVMRLAENLRKGMPIATPVFDGAKEAEIKELLKLGDLPTSGQIRLYDGRTGEQFERPVTVGYMYMLKLNHLVDDKMHARSTGSYSLVTQQPLGGKAQFGGQRFGEMEVWALEAYGAAYTLQEMLTVKSDDVNGRTKMYKNIVDGNHQMEPGMPESFNVLLKEIRSLGINIELEDE

SEQ ID NO: 9185 - DNA, 4224 bp, Escherichia coli
gtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaaccagaacgtgacggccttttctgcgcccgtatctttgggccggtaaaagattacgagtgcctgtgcggtaagtacaagcgcctgaaacaccgtggcgtcatctgtgagaagtgcggtgttgaagtgacccagactaaagtacgccgtgagcgtatgggccacatcgaactggcttccccgactgcgcacatctggttcctgaaatcgctgccgtcccgtatcggcctgctgctcgatatgccgctgcgcgatatcgaacgcgtgctgtactttgaatcctatgtggttatcgaaggcggtatgaccaatctggagcgtcagcagatcctgactgaagaacagtatctggacgcgctggaagagttcggtgacgaattcgacgcgaagatgggtgcggaagcaatccaggccctgctgaagagcatggatctggagcaagagtgtgaacagctgcgtgaagagctgaacgaaaccaactccgaaaccaagcgtaagaagctgaccaagcgtatcaaactgctggaagcgttcgttcagtctggtaacaaaccagagtggatgatcctgaccgttctgccggtactgccgccagatctgcgtccgctggttccgctggatggtggtcgtttcgcgacttctgacctgaacgatctgtatcgtcgcgtcattaaccgtaacaaccgtctgaaacgtctgctggatctggctgcgccggacatcatcgtacgtaacgaaaaacgtatgctgcaggaagcggttgacgccctgttggataacggtcgtcgcggtcgtgcgatcactggttctaacaagcgtcctctgaaatctttggccgacatgatcaaaggtaaacagggtcgtttccgtcagaacctgctcggtaagcgtgttgactactccggtcgttctgtaatcaccgtaggtccatacctgcgtctgcatcagtgcggtctgccgaagaaaatggcactggaactgttcaaaccgttcatctacggcaagctggaactgcgtggtcttgctaccaccattaaagctgcgaagaaaatggttgagcgcgaagaagctgtcgtttgggatatcctggacgaagttatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagctggaagcgcgtgcgctgatgatgtctaccaacaacatcctgtccccggcgaacggcgaaccaatcatcgttccgtctcaggacgttgtactgggtctgtactacatgacccgcgactgtgttaacgccaaaggcgaaggcatggtgctgactggcccgaaagaagcagaacgtctgtatcgctctggtctggcttctctgcatgcgcgcgttaaagtgcgtatcaccgagtatgaaaaagatgctaacggtgaattagtagcgaaaaccagcctgaaagacacgactgttggccgtgccattctgtggatgattgtaccgaaaggtctgccttacaccatcgtcaaccaggcgctgggtaaaaaagcaatctccaaaatgctgaacacctgctaccgcattctcggtctgaaaccgaccgttatttttgcggaccagatcatgtacaccggctttgcatatgcagcgcgttctggtgcatctgttggtatcgatgacatggtcatcccggagaagaaacacgaaatcatctccgaggcagaagcagaagttgctgaaattcaggagcagttccagtctggtctggtaactgcgggcgaacgctacaacaaagttatcgatatctgggctgcggcgaacgatcgtgtatccaaagcgatgatggataacctgcaaactgaaaccgttattaaccgtgacggtcaggaagagaagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgctcgtaaaggtctggcggataccgcactgaaaactgcgaactccggttacctgactcgtcgtctggttgacgtggcgcaggacctggtggttaccgaagacgattgtggtactcatgaaggtatcatgatgactccggttatcgaaggtggtgacgttaaagagccgctgcgcgatcgcgtactgggtcgtgtaactgctgaagacgttctgaagccgggtactgctgatatcctcgttccgcgcaacacgctgctgcacgaacagtggtgtgacctgctggaagagaactctgtcgacgcggttaaagtacgttctgttgtatcttgtgacaccgactttggtgtatgtgcgcactgctacggtcgtgacctggcgcgtggccacatcatcaacaaaggtgaagcaatcggtgttatcgcggcacagtccatcggtgaaccgggtacacagctgaccatgcgtacgttccacatcggtggtgcggcatctcgtgcggctgctgaatccagcatccaggtgaaaaacaaaggtagcatcaagctcagcaacgtgaagtcggttgtgaactccagcggtaaactggttatcacttcccgtaacaccgaactgaaactgatcgacgaattcggtcgtaccaaagaaagctacaaagtaccttacggtgcggtactggcgaaaggcgatggcgaacaggttgctggcggcgaaaccgttgcaaactgggacccgcacaccatgccggttatcaccgaagtaagcggttttgtacgctttactgacatgatcgacggtcagaccattacgcgtcagaccgacgaattgaccggtctgtcttcgctggtggttctggattccgcagaacgtacagcaggtggtaaagatctgcgtccggcactgaaaatcgttgatgctcagggtaacgatgtactgatcccgggtaccgatatgcctgcgcagtacttcctgccgggtaaagcgattgttcagctggaagatggcgtacagatcagctctggtgacaccctggcgcgtattccgcaggaatccggcggtaccaaggacatcaccggtggtctgccacgcgttgcggacctgttcgaagcacgtcgtccgaaagagccggcaatcctggctgaaatcagcggtatcgtttccttcggtaaagaaaccaaaggtaaacgtcgtctggttatcaccccggtagacggtagcgatccgtacgaagagatgattccgaaatggcgtcagctcaacgtgttcgaaggtgaacgtgtagaacgtggtgacgtaatttccgacggtccggaagcgccgcacgacattctgcgtctgcgtggtgttcatgctgtgactcgttacatcgttaacgaagtacaggacgtataccgtctgcagggcgttaagattaacgataaacacatcgaagttatcgttcgtcagatgctgcgtaaagctaccatcgttaacgcgggcagctccgacttcctggaaggtgaacaggttgaatactctcgcgtcaagatcgcaaaccgcgaactggaagcgaacggcaaagtgggtgcaacttactcccgcgacctgctgggtatcaccaaagcgtctctggcaaccgagtccttcatctccgcggcatcgttccaggagaccactcgcgtgctgaccgaagcagccgttgcgggcaaacgcgatgaactgcgcggcctgaaagagaacgttatcgtgggtcgtctgatcccggcaggtaccggttacgcgtaccaccaggatcgtatgcgtcgccgtgctgcgggtgaagctccggctgcaccgcaggtgactgcagaagacgcatctgccagcctggcagaactgctgaacgcaggtctgggcggttctgataacgagtaa

SEQ ID NO: 9186 - protein, 1407 aa, Escherichia coli
MKDLLKFLKAQTKTEEFDAIKIALASPDMIRSWSFGEVKKPETINYRTFKPERDGLFCARIFGPVKDYECLCGKYKRLKHRGVICEKCGVEVTQTKVRRERMGHIELASPTAHIWFLKSLPSRIGLLLDMPLRDIERVLYFESYVVIEGGMTNLERQQILTEEQYLDALEEFGDEFDAKMGAEAIQALLKSMDLEQECEQLREELNETNSETKRKKLTKRIKLLEAFVQSGNKPEWMILTVLPVLPPDLRPLVPLDGGRFATSDLNDLYRRVINRNNRLKRLLDLAAPDIIVRNEKRMLQEAVDALLDNGRRGRAITGSNKRPLKSLADMIKGKQGRFRQNLLGKRVDYSGRSVITVGPYLRLHQCGLPKKMALELFKPFIYGKLELRGLATTIKAAKKMVEREEAVVWDILDEVIREHPVLLNRAPTLHRLGIQAFEPVLIEGKAIQLHPLVCAAYNADFDGDQMAVHVPLTLEAQLEARALMMSTNNILSPANGEPIIVPSQDVVLGLYYMTRDCVNAKGEGMVLTGPKEAERLYRSGLASLHARVKVRITEYEKDANGELVAKTSLKDTTVGRAILWMIVPKGLPYTIVNQALGKKAISKMLNTCYRILGLKPTVIFADQIMYTGFAYAARSGASVGIDDMVIPEKKHEIISEAEAEVAEIQEQFQSGLVTAGERYNKVIDIWAAANDRVSKAMMDNLQTETVINRDGQEEKQVSFNSIYMMADSGARGSAAQIRQLAGMRGLMAKPDGSIIETPITANFREGLNVLQYFISTHGARKGLADTALKTANSGYLTRRLVDVAQDLVVTEDDCGTHEGIMMTPVIEGGDVKEPLRDRVLGRVTAEDVLKPGTADILVPRNTLLHEQWCDLLEENSVDAVKVRSVVSCDTDFGVCAHCYGRDLARGHIINKGEAIGVIAAQSIGEPGTQLTMRTFHIGGAASRAAAESSIQVKNKGSIKLSNVKSVVNSSGKLVITSRNTELKLIDEFGRTKESYKVPYGAVLAKGDGEQVAGGETVANWDPHTMPVITEVSGFVRFTDMIDGQTITRQTDELTGLSSLVVLDSAERTAGGKDLRPALKIVDAQGNDVLIPGTDMPAQYFLPGKAIVQLEDGVQISSGDTLARIPQESGGTKDITGGLPRVADLFEARRPKEPAILAEISGIVSFGKETKGKRRLVITPVDGSDPYEEMIPKWRQLNVFEGERVERGDVISDGPEAPHDILRLRGVHAVTRYIVNEVQDVYRLQGVKINDKHIEVIVRQMLRKATIVNAGSSDFLEGEQVEYSRVKIANRELEANGKVGATYSRDLLGITKASLATESFISAASFQETTRVLTEAAVAGKRDELRGLKENVIVGRLIPAGTGYAYHQDRMRRRAAGEAPAAPQVTAEDASASLAELLNAGLGGSDNE

SEQ ID NO: 9187 - DNA, 1134 bp, Escherichia coli
atgaaaaccttcagcgatcgctggcgacaactggactgggatgacatccgcctgcgtatcaacggcaaaacggctgctgacgtagagcgggcgctaaatgcctcgcaactcacccgcgacgacatgatggcattgctatcacccgccgccagtggctatctggaaccactggcccagcgagcgcaacgtctgactcgtcagcgatttggcaacgtcgtcagcttctacgtcccgctttatctttccaatctttgcgctaacgactgtacttattgcggattttctatgagcaaccgcatcaagcgcaaaacgctggatgaagcggatattgccagagaaagcgccgctatacgggagatgggctttgaacatctgctattagtcactggtgaacatcaggcgaaagtggggatggattactttcgtcgtcatctccctgccctgcgtgaacagttctcttcactacagatggaagtgcaaccgctggcggaggcggaatatgccgagttaaaacagcttggcctcgatggagtaatggtttatcaggagacatatcatgaggcgacttatgcccatcatcatctgaaaggtaaaaaacaggacttcttctggcggctggaaacgccggatcggctagggcgtgcggggattgataagataggcctcggcgcgctaatcggcctttccgacagctggcgagttgactgctatatggttgtcgaacatttgctatggctgcaacagcattactggcaaagccgctactctgtctccttcccacgcctgcgtccatgtactggcggcattgagcctgcgtcgattatggatgaacgccagttagtgcaagccatctgcgctttccggctgcttgcaccggagattgaactgtcactctccacgcgggaatcaccgtggtttcgcgatcgcgtgattccgctggcaattaataacgtcagcgctttttcgaaaacgcagccaggtggctatgccgacaaccaccccgagctggaacagttctcaccgcacgacgatcgcagaccggaagcggttgctgccgcgttaaccgctcagggtttgcagccggtatggaaagactgggacagctatctgggacgcccatcgcaaaggccatga

SEQ ID NO: 9188 - protein, 377 aa, Escherichia coli
MKTFSDRWRQLDWDDIRLRINGKTAADVERALNASQLTRDDMMALLSPAASGYLEPLAQRAQRLTRQRFGNVVSFYVPLYLSNLCANDCTYCGFSMSNRIKRKTLDEADIARESAAIREMGFEHLLLVTGEHQAKVGMDYFRRHLPALREQFSSLQMEVQPLAEAEYAELKQLGLDGVMVYQETYHEATYAHHHLKGKKQDFFWRLETPDRLGRAGIDKIGLGALIGLSDSWRVDCYMVVEHLLWLQQHYWQSRYSVSFPRLRPCTGGIEPASIMDERQLVQAICAFRLLAPEIELSLSTRESPWFRDRVIPLAINNVSAFSKTQPGGYADNHPELEQFSPHDDRRPEAVAAALTAQGLQPVWKDWDSYLGRPSQRP

SEQ ID NO: 9189 - DNA, 1029 bp, Escherichia coli
gtggcgcagcctggctttgcgccgcgccagtggttgcccggtatgcggaggaagcaatgcagatcctgtttaacgatcaaccgatgcagtgcgccgccgggcaaacggttcacgaactactggagcaactcgaccaacaacaagcgggcgcggcactggcgattaatcagcaaatcgtcccgcgtgagcagtgggcgcaacatatcgtgcaggatggcgaccagatcctgctttttcaggttattgcagggggttgagatgttacgtattgcggacaaaacgtttgattcacatctgtttaccggcacagggaaattcgcctcttcacaactgatgatggaggcgatccgcgcttgcggcagccaactggtgacactggcgatgaaacgcgtcaacttgcgccagcacaacgacgctatcctcgaaccgcttatcgcggcgggtgtgaccctgctgccaaatacatccggggcgaaaacagcggaagaagccattttcgccgcccatctggctcgtgaagcgttaggcacaaactggttaaaattagagattcaccctgacgcccgctggctgttgcccgatcccatcgaaaccctgaaagccgccgaaaagctggtacaacagggatttgtcgtgctgccttactgcggggccgatccggtattgtgtaaacgtctggaagaagtcggctgtgcagcggtgatgccgctcggcgcgccgattggctcgaatcagggactggaaacccgcgccatgctggagattattatccagcaggccaccgttccggtggttgtcgatgctggcatcggcgttcccagccatgccgcgcaggcgctggaaatgggggccgacgcggtgttagtgaatacggcgattgccgtcgcggacgatcccgtcaacatggcgaaggcatttcgtctggcggtagaagcaggcctgctggcacgtcagtccggaccgggcagccgcagtcattttgctcatgccaccagcccgctgactggatttctggaggcatcggaatga

SEQ ID NO: 9190 - protein, 342 aa, Escherichia coli
MAQPGFAPRQWLPGMRRKQCRSCLTINRCSAPPGKRFTNYWSNSTNNKRARHWRLISKSSRVSSGRNISCRMATRSCFFRLLQGVEMLRIADKTFDSHLFTGTGKFASSQLMMEAIRACGSQLVTLAMKRVNLRQHNDAILEPLIAAGVTLLPNTSGAKTAEEAIFAAHLAREALGTNWLKLEIHPDARWLLPDPIETLKAAEKLVQQGFVVLPYCGADPVLCKRLEEVGCAAVMPLGAPIGSNQGLETRAMLEIIIQQATVPVVVDAGIGVPSHAAQALEMGADAVLVNTAIAVADDPVNMAKAFRLAVEAGLLARQSGPGSRSHFAHATSPLTGFLEASE

SEQ ID NO: 9191 - DNA, 201 bp, Escherichia coli
atgcagatcctgtttaacgatcaaccgatgcagtgcgccgccgggcaaacggttcacgaactactggagcaactcgaccaacaacaagcgggcgcggcactggcgattaatcagcaaatcgtcccgcgtgagcagtgggcgcaacatatcgtgcaggatggcgaccagatcctgctttttcaggttattgcagggggttga

SEQ ID NO: 9192 - protein, 66 aa, Escherichia coli
MQILFNDQPMQCAAGQTVHELLEQLDQQQAGAALAINQQIVPREQWAQHIVQDGDQILLFQVIAGG

SEQ ID NO: 9193 - DNA, 756 bp, Escherichia coli
atgaatgaccgtgactttatgcgttatagccgccaaatcctgctcgacgatatcgctctggacgggcagcaaaaactgctcgacagccaggtgctgattattggtcttggcgggctgggtacacctgctgcgctatacctggcgggggctggcgtcgggacgctggtactggcagatgacgacgatgtgcatttaagcaatctgcaacgacaaatcctctttaccactgaagatatcgatcgcccgaaatcacaggtcagccaacagcgactgacacagttgaatcccgacattcaactgatggcattacaacaacgattaacgggtgagacgttaaaagatgcggttgcacaagccgatgtggtgctcgactgtactgacaatatggcgactcgccaggagattaatgccacctgcgtggcactcaacacgccgcttatcaccgccagcgcggtcggatttggcggtcagttgatggtactgacgccgccctgggagcagggatgttaccgctgcctgtggccagataaccaggagccagaacgcaactgccgcacggcgggcgtggttggcccggtggtcggggttatgggcactttacaggcactggaagcgattaagttattaagtggtatagagacgcctgcgggagaactccgactgttcgacggtaagtcgagccagtggcgcagcctggctttgcgccgcgccagtggttgcccggtatgcggaggaagcaatgcagatcctgtttaa

SEQ ID NO: 9194 - protein, 251 aa, Escherichia coli
MNDRDFMRYSRQILLDDIALDGQQKLLDSQVLIIGLGGLGTPAALYLAGAGVGTLVLADDDDVHLSNLQRQILFTTEDIDRPKSQVSQQRLTQLNPDIQLMALQQRLTGETLKDAVAQADVVLDCTDNMATRQEINATCVALNTPLITASAVGFGGQLMVLTPPWEQGCYRCLWPDNQEPERNCRTAGVVGPVVGVMGTLQALEAIKLLSGIETPAGELRLFDGKSSQWRSLALRRASGCPVCGGSNADPV

SEQ ID NO: 9195 - DNA, 636 bp, Escherichia coli
atgtatcagcctgagtttcctcctgtaccctttcgtttaggactgtacccggtggttgacagcgtacagtggatcgaacgtctgttggatgcaggcgtacgtactctccagctacgcatcaaagatcggcgcgatgaagaggtagaagccgatgtggtggcggcaattgcgctgggccgccgctataacgcgcgattgtttatcaacgattactggcggctggcgattaagcatcaggcgtatggcgtccatctggggcaggaagatttgcaagccaccgatctcagcgccatccgcgcggcaggcctgcggctgggcgtttcgacccatgacgatatggagatcgacgtcgcgctggcggcacgtccttcttatatcgcgctgggacatgtgtttccgacacaaaccaaacagatgccttctgcaccgcagggactggaacagctggcacggcatgttgagcgcctggcggattatcccaccgtggcgattggcggtatcagtctggcgcgcgcgcctgcggtgatagcaacgggtgtcggcagtatcgccgtcgtcagcgccattactcaagccgcagactggcgtttggcaacggcacagctgctggaaattgcaggagttggcgatgaatga

SEQ ID NO: 9196 - protein, 211 aa, Escherichia coli
MYQPEFPPVPFRLGLYPVVDSVQWIERLLDAGVRTLQLRIKDRRDEEVEADVVAAIALGRRYNARLFINDYWRLAIKHQAYGVHLGQEDLQATDLSAIRAAGLRLGVSTHDDMEIDVALAARPSYIALGHVFPTQTKQMPSAPQGLEQLARHVERLADYPTVAIGGISLARAPAVIATGVGSIAVVSAITQAADWRLATAQLLEIAGVGDE

SEQ ID NO: 9197 - DNA, 1908 bp, Escherichia coli
ttggaacgagctatgtctgcaacaaaactgacccgccgcgaacaacgcgcccaggcccaacattttatcgacaccctggaaggctccgcctttcccaactcaaaacgcatttacatcactggcacacaccccggcgtacgcgtgccgatgcgtgagattcagcttagcccgacgctaattggcggcagcaaagaacagccgcagtacgaagaaaacgaagcgattccggtctacgacacctccggcccgtatggcgatccgcagattgccattaacgtgcagcaagggctggcaaaactacgccagccgtggatcgatgcgcgcggcgataccgaagaacttaccgtgcgcagttccgattacacaaaagcgcggctggcagatgatggcctcgacgagctgcgttttagcggcgtattaaccccaaaacgcgccaaagcaggccaccgcgtcacacaactgcactacgcccgcaagggtatcatcacgccagaaatggaattcatcgccattcgcgagaatatgggtcgcgagcgcatacgtagcgaagttttacgccaccagcatccgggaatgagctttggcgcacgtctgccggaaaatatcactgcggaatttgtccgtgatgaagttgctgccggacgtgcgattatcccggccaacattaatcatccggaatcggagccgatgattattggccgtaacttcctagtaaaagttaacgccaatatcggcaactcagcggtcacttcttccatcgaagaagaagtggaaaaactggtatggtccacacgctggggagcggataccgtgatggatctttccactggtcgctatattcacgaaacccgcgagtggattttgcgtaacagcccggtgccgatcggtacagtgccgatctaccaggcactggagaaggtgaacgggatcgctgaagatcttacctgggaagtcttccgcgacaccctgctggaacaagccgagcaaggtgtggattacttcacgatccatgcgggggtgctgctgcgctacgtgccgatgaccgcgaaacgcctgaccggtatcgtctctcgcggcggttcgattatggcgaaatggtgcctctcccatcatcaggaaaatttcctctatcaacgcttccgcgaaatttgtgaaatctgtgctgcttatgacgtttcgctatcgctgggcgacggcctgcgccccggttctattcaggacgccaacgatgaagcacagtttgccgagctgcatacgctgggtgaactgactaaaatcgcctgggaatatgacgtacaggtgatgattgaaggcccaggccacgtgccgatgcagatgattcgccgcaatatgaccgaggagttagagcactgccacgaagcgccgttttacactctggggccgctaactaccgatatcgcgccgggctatgaccacttcacgtcagggattggcgcggcgatgattggctggtttggttgtgcaatgctctgctacgtaacgccgaaagagcatctgggcctgccaaataaagaagatgttaaacaggggcttatcacctataagattgccgctcacgccgccgacctggcgaaagggcatccgggcgcgcaaattcgcgataacgccatgtcgaaagcccgcttcgaatttcgctgggaagaccagtttaatctggccctcgacccgtttactgcccgcgcttatcacgatgaaaccctgccgcaagagtccggtaaagtcgcccatttttgctccatgtgtggaccgaaattctgctcgatgaaaatcagccaggaagtgcgtgattacgccgccgcgcaaaccattgaagtgggaatggcggatatgtcggagaacttccgcgccagaggcggagaaatctacctgcgtaaggaggaagcgtga

SEQ ID NO: 9198 - protein, 635 aa, Escherichia coli
MERAMSATKLTRREQRAQAQHFIDTLEGSAFPNSKRIYITGTHPGVRVPMREIQLSPTLIGGSKEQPQYEENEAIPVYDTSGPYGDPQIAINVQQGLAKLRQPWIDARGDTEELTVRSSDYTKARLADDGLDELRFSGVLTPKRAKAGHRVTQLHYARKGIITPEMEFIAIRENMGRERIRSEVLRHQHPGMSFGARLPENITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEVFRDTLLEQAEQGVDYFTIHAGVLLRYVPMTAKRLTGIVSRGGSIMAKWCLSHHQENFLYQRFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQTIEVGMADMSENFRARGGEIYLRKEEA

SEQ ID NO: 9199 - DNA, 477 bp, Escherichia coli
atgcttaaccagctcgataacctgacggagcgcgtcagaggaagtaacaaactggttgatcgctggctacatgtacgtaagcatctgctcgtggcttactacaatctggttggcattaagcctggcaaagaatcgtacatgaggctaaacgaaaaagcccttgatgatttttgtcagagcctggtcgattacttgtctgccggacatttcagtatttatgagcgcattcttcataagctggaaggcaatgggcaactcgcacgcgccgcgaagatttggccacaactcgaagccaatactcaacagattatggatgactacgattccagtctggaaaccgccatcgatcatgataattaccttgagtttcaacaggttttatctgacatcggcgaggcactggaagcgcgctttgtgctggaagataagctgattctactggtgcttgacgccgcccgcgtcaaatatcctgcttga

SEQ ID NO: 9200 - protein, 158 aa, Escherichia coli
MLNQLDNLTERVRGSNKLVDRWLHVRKHLLVAYYNLVGIKPGKESYMRLNEKALDDFCQSLVDYLSAGHFSIYERILHKLEGNGQLARAAKIWPQLEANTQQIMDDYDSSLETAIDHDNYLEFQQVLSDIGEALEARFVLEDKLILLVLDAARVKYPA

SEQ ID NO: 9201 - DNA, 693 bp, Escherichia coli
ttgccatatggcgaagcggcaaatttcgatcttgtgggtcagcgcgcactacaaatcggcgaatggcagggggaacctgtttggttagtacaactgcagcggcgtcacgatatggggtcggtacgtcaggtcattgatctcgatgttgggctgtttcaactggccggacgtggcgtgcaactggcggagttttaccgatcgcataaatactgtggttactgcgggcatgaaatgtatccaagcaaaaccgaatgggcgatgctgtgcagccattgccgtgagcgttactacccgcaaatcgccccctgcattattgttgccatccgtcgcgatgattcgatcctcctcgcccagcatacccgccatcgtaacggtgtccatacagtacttgccggattcgtcgaagtgggtgaaaccctcgagcaggcagtcgcgcgggaagtgatggaagagagcggaattaaagttaaaaacttgcgttacgtgacctcccaaccgtggccgtttcctcagtcgttaatgaccgcgtttatggcggaatatgacagcggcgagatcgtgatcgacccgaaagaattgcttgaggcgcactggtatcgctatgacgatttgccgttactcccgccgcccggcaccgtagcgcgccgtctgatagaagatacagtggcgatgtgtcgggcagagtatgagtga

SEQ ID NO: 9202 - protein, 230 aa, Escherichia coli
MPYGEAANFDLVGQRALQIGEWQGEPVWLVQLQRRHDMGSVRQVIDLDVGLFQLAGRGVQLAEFYRSHKYCGYCGHEMYPSKTEWAMLCSHCRERYYPQIAPCIIVAIRRDDSILLAQHTRHRNGVHTVLAGFVEVGETLEQAVAREVMEESGIKVKNLRYVTSQPWPFPQSLMTAFMAEYDSGEIVIDPKELLEAHWYRYDDLPLLPPPGTVARRLIEDTVAMCRAEYE

SEQ ID NO: 9203 - DNA, 1065 bp, Escherichia coli
atgaccgaacttaaaaacgatcgttatctgcgggcgctgctgcgccagcccgttgatgtcactccagtatggatgatgcgccaggcgggtcgctatctaccggaatataaagccacgcgcgcccaggcgggcgattttatgtcgctgtgcaaaaatgccgagctggcgtgcgaagtgactttgcaaccgctgcgtcgctatccgctggatgcggcgatcctcttttccgatatcctcaccgtgccagacgcgatgggtttagggctctattttgaagccggagaaggtccgcgttttacctcgccagtcacctgcaaagccgatgtcgataaactgccaattccggacccggaagatgagctgggttacgtgatgaacgcggtgcgtaccattcgtcgcgaactgaaaggcgaagtgccgctgattggtttttccggcagcccgtggacgctggcgacttacatggttgaaggcggtagcagcaaagccttcaccgtgatcaaaaagatgatgtatgccgatccgcaggcgctgcacgcgctgctcgataaactggcgaaaagcgtcacgttgtatctgaatgcgcagattaaagccggtgctcaggcagtcatgattttcgacacctggggcggcgtgcttaccgggcgcgattatcaacagttctcgctttattacatgcataaaattgttgatggtttactgcgtgaaaacgacggtcgccgcgtgccagtcacgctgtttaccaaaggtggcggacagtggctggaagcgatggcagaaaccggttgcgatgcgctgggcctcgactggacaacggacatcgccgatgcgcgccgtcgcgtgggcaataaagtcgcgctgcagggtaatatggacccgtcgatgctgtacgcgccgcctgcccgcattgaagaagaagtggcgtctatacttgccggtttcggtcacggcgaaggccatgtctttaaccttggtcacggcattcatcaggatgtgccgccagaacatgcaggcgtgtttgtggaggcagtgcatcgcttgtctgaacagtatcaccgctaa

SEQ ID NO: 9204 - protein, 354 aa, Escherichia coli
MTELKNDRYLRALLRQPVDVTPVWMMRQAGRYLPEYKATRAQAGDFMSLCKNAELACEVTLQPLRRYPLDAAILFSDILTVPDAMGLGLYFEAGEGPRFTSPVTCKADVDKLPIPDPEDELGYVMNAVRTIRRELKGEVPLIGFSGSPWTLATYMVEGGSSKAFTVIKKMMYADPQALHALLDKLAKSVTLYLNAQIKAGAQAVMIFDTWGGVLTGRDYQQFSLYYMHKIVDGLLRENDGRRVPVTLFTKGGGQWLEAMAETGCDALGLDWTTDIADARRRVGNKVALQGNMDPSMLYAPPARIEEEVASILAGFGHGEGHVFNLGHGIHQDVPPEHAGVFVEAVHRLSEQYHR

SEQ ID NO: 9205 - DNA, 672 bp, Escherichia coli
atggatctcgcgtcattacgcgctcaacaaattgaactggcttcttctgtgatccgcgaggatcgactcgataaagatccgccggatctgatcgccggagccgatgtcggatttgagcagggcggcgaagtgacgcgagcggcgatggtgctgctgaaatacccctcgcttgagctggtggagtataaagtggcccgcatcgccaccaccatgccttacattcctggttttctctcctttcgtgaatatcctgcgctgctggcagcgtgggagatgctgtcacaaaagccggatttagtgtttgtcgatggtcatgggatctcgcatcctcgccgtcttggcgtcgccagccattttggtttgctggtggatgtgccgaccattggcgtagcgaaaaaacggctctgcggtaaattcgaaccgctctccagcgaaccgggcgcgctggccccgctgatggataaaggcgagcagctggcctgggtctggcgcagcaaagcgcgctgtaacccgttgtttatcgctaccggccatcgggtcagcgtggacagcgcgctggcgtgggtacaacgctgcatgaaaggctatcgtctgccggagccaacgcgctgggcggacgcagtggcctcggaacgtccggcgttcgtgcgctatacagcaaatcagccctaa

SEQ ID NO: 9206 - protein, 223 aa, Escherichia coli
MDLASLRAQQIELASSVIREDRLDKDPPDLIAGADVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQP

SEQ ID NO: 9207 - DNA, 591 bp, Escherichia coli
atgttacaaaacccaattcatctgcgtctggagcgcctggaaagctggcagcacgtcacttttatggcctgcttatgcgaacgtatgtaccccaattacgccgtattctgtcagcaaaccggcttcggcgatgggcagatttaccgccgcattctcgatctcatttgggaaacgctgaccgtcaaagacgcaaaagtaaatttcgacagccaactggagaaatttgaagaagcgattccttcagccgacgatttcgatctgtacggcgtttatccggcaatcgatgcttgcgtggcgttaagtgaactggtccattcgcgtttaagtggcgaaacgctcgaacacgcggtggaagtgagtaagacttccatcacgaccgtggcgatgctggaaatgactcaggctggtcgcgaaatgagcgatgaagagctcaaagaaaacccagctgtagagcaagaatgggacattcagtgggaaatattccgacttttagctgagtgcgaagaacgcgatatcgagctgataaaaggccttagggcagacctgcgtgaggcgggtgagagcaatattggtataatttttcagcaataa

SEQ ID NO: 9208 - protein, 196 aa, Escherichia coli
MLQNPIHLRLERLESWQHVTFMACLCERMYPNYAVFCQQTGFGDGQIYRRILDLIWETLTVKDAKVNFDSQLEKFEEAIPSADDFDLYGVYPAIDACVALSELVHSRLSGETLEHAVEVSKTSITTVAMLEMTQAGREMSDEELKENPAVEQEWDIQWEIFRLLAECEERDIELIKGLRADLREAGESNIGIIFQQ

SEQ ID NO: 9209 - DNA, 273 bp, Escherichia coli
atgaacaagactcaactgattgatgtaattgcagagaaagcagaactgtccaaaacccaggctaaagctgctctggagtccactctggctgcaattactgagtctctgaaagaaggcgatgctgtacaactggttggtttcggtaccttcaaagtgaaccaccgcgctgagcgtactggccgcaacccgcagaccggtaaagaaatcaaaattgccgcagctaacgtaccggcatttgtttctggcaaggcactgaaagacgcagttaagtaa

SEQ ID NO: 9210 - protein, 90 aa, Escherichia coli
MNKTQLIDVIAEKAELSKTQAKAALESTLAAITESLKEGDAVQLVGFGTFKVNHRAERTGRNPQTGKEIKIAAANVPAFVSGKALKDAVK

SEQ ID NO: 9211 - DNA, 636 bp, Escherichia coli
atgctggctggcgctctgtttctcactgcttgtagtcacaactcttcacttcctccctttaccgccagtggatttgctgaagaccagggcgcggtacgcatctggcgaaaagacagcggcgataatgtgcatctgcttgccgtgtttagcccgtggcgcagtggcgataccacgacgcgagagtatcgctggcagggcgataacctcacgctcatcaatatcaatgtttacagcaaacccccggtgaatattcgcgcgcgttttgacgatcgcggcgatctgagctttatgcaacgcgaatccgatggggaaaagcagcagctttctaacgaccaaatcgatttataccgttatcgtgctgatcagatccgccagattagcgatgccttacgtcaggggagagtcgtgctgcgccaggggcgctggcatgcgatggagcagactgtgaccacctgcgaagggcaaaccattaaacctgatttagattcgcaggcgatagcgcatatcgagcgccgccagagccgctcttctgttgatgtcagcgtggcatggctggaagcgcccgaaggttcgcaattactgttggtggcaaactctgatttctgtcgctggcaacccaacgagaaaacgttctga

SEQ ID NO: 9212 - protein, 211 aa, Escherichia coli
MLAGALFLTACSHNSSLPPFTASGFAEDQGAVRIWRKDSGDNVHLLAVFSPWRSGDTTTREYRWQGDNLTLININVYSKPPVNIRARFDDRGDLSFMQRESDGEKQQLSNDQIDLYRYRADQIRQISDALRQGRVVLRQGRWHAMEQTVTTCEGQTIKPDLDSQAIAHIERRQSRSSVDVSVAWLEAPEGSQLLLVANSDFCRWQPNEKTF

SEQ ID NO: 9213 - DNA, 561 bp, Escherichia coli
atgagtaaaaatgactcgctacccgcagcaggcgagtcatttttactcgtttatcatgccagattacccgtcatatcagcgtttcgccgttggcacggaagatgcaatacccgaagtaagacaaccactggaggattaaccatgaaacggaacacgaaaattgccctggtaatgatggcgctttcagcaatggcgatgggatcgacatctgcatttgctcacggcggacatggtatgtggcagcaaaatgccgcgcctttgaccagcgaacaacagacagcgtggcagaaaatccataatgacttttacgctcaaagcagcgcactgcaacagcaactggtgacaaagcgttatgaatacaatgccctgttagccgcgaacccaccggatagcagcaaaattaacgcgctcgccaaagagatggagaatttgcgtcagtcgttagatgagttacgggtgaaacgagatattgcgatggctgaagcgggtattccgcgcggtaccggaatgggttacggcggctgcggtggtggcggtcatatgggtatgggccactggtaa

SEQ ID NO: 9214 - protein, 186 aa, Escherichia coli
MSKNDSLPAAGESFLLVYHARLPVISAFRRWHGRCNTRSKTTTGGLTMKRNTKIALVMMALSAMAMGSTSAFAHGGHGMWQQNAAPLTSEQQTAWQKIHNDFYAQSSALQQQLVTKRYEYNALLAANPPDSSKINALAKEMENLRQSLDELRVKRDIAMAEAGIPRGTGMGYGGCGGGGHMGMGHW

SEQ ID NO: 9215 - DNA, 1368 bp, Escherichia coli
atgcaacgttctaaagactccttagctaaatggttaagcgcgatcctccccgtggtcattgttgggctggtggggctgtttgcggtgacagtgattcgcgattatgggcgcgagactgccgccgccagacaaacgctgctggaaaaaggcagtgtacttattcgtgctcttgaatccggctcgcgcgtcggcatggggatgcgcatgcatcatgcgcagcagcaggccttacttgaagaaatggccgggcagcctggagtacgttggtttgcggtcacggatgaacaaggaacaatcgtgatgcatagcaactccggcatggtgggaaaacagctttattccccgcaggaaatgcagcagttacatccgggaaatgaagaagcgtggcggcggatcgatagcgcagacggcgagcctgttctggaaatttatcgccagtttcaaccgatgtttgctactggaatgcaccggatgcgccatatgcagcagtatgccgcgacaccacaagcaatttttatcgctttcgacgccagtaacattgtgagtgccgaagatcgtgagcagagaaacaccctgattatcctcttcgccctggcgacggtcttgctggcaagcgtgttgtcattcttctggtatcgccgatatctgcgctcgcggcagctattgcaggatgaaatgaagcgcaaagagaagctggtggcgctggggcatcttgcggcaggtgttgcccacgaaatccgtaacccactttcctcgattaaagggctggcgaaatactttgccgaacgcgcgccagcagggggagaagcgcatcaactggcgcaggtgatggcgaaagaagccgaccgtttaaaccgcgtggtaagcgagctgctggaactggttaagccaacgcatctggctttgcaggcggtggagctcaacacgctgattaaccactcattacagctggtaagccaggatgcaaacagccgggagatccagttacgctttaccgccaacgacacattaccggaaattcaggccgatccggacaggctgactcaggtcctgttgaatctctatctcaacgctattcaggcgattggtcagcatggcgtgattagcgtgacggccagcgaaagcggcgcgggcgtgaaaatcagcgttaccgacagcggtaagggaattgcggcggatcagcttgaagccatcttcactccgtacttcaccaccaaagccgaaggcaccggactggggctggcggttgtgcataatattgttgaacaacacggtggtacaattcaggtcgcaagccaggagggaaaaggcgcaacgttcaccctttggcttccggtcaatattacgcgtaaggacccacaaggatga

SEQ ID NO: 9216 - protein, 455 aa, Escherichia coli
MQRSKDSLAKWLSAILPVVIVGLVGLFAVTVIRDYGRETAAARQTLLEKGSVLIRALESGSRVGMGMRMHHAQQQALLEEMAGQPGVRWFAVTDEQGTIVMHSNSGMVGKQLYSPQEMQQLHPGNEEAWRRIDSADGEPVLEIYRQFQPMFATGMHRMRHMQQYAATPQAIFIAFDASNIVSAEDREQRNTLIILFALATVLLASVLSFFWYRRYLRSRQLLQDEMKRKEKLVALGHLAAGVAHEIRNPLSSIKGLAKYFAERAPAGGEAHQLAQVMAKEADRLNRVVSELLELVKPTHLALQAVELNTLINHSLQLVSQDANSREIQLRFTANDTLPEIQADPDRLTQVLLNLYLNAIQAIGQHGVISVTASESGAGVKISVTDSGKGIAADQLEAIFTPYFTTKAEGTGLGLAVVHNIVEQHGGTIQVASQEGKGATFTLWLPVNITRKDPQG

SEQ ID NO: 9217 - DNA, 1326 bp, Escherichia coli
atgacgcacgataatatcgatattctggtggtggatgatgacattagccactgcactattttgcaggctttgctgcgcggctggggctataacgtcgcgctggcgaacagcgggcgacaggcgctggagcaggtgcgggaacaggtttttgatcttgtgctttgcgatgtgcgaatggcagagatggatggtatcgccacgctaaaagagatcaaaacattaaaccccgcgattccggtgctgattatgaccgcgtactccagcatcgagacggcggtagaggcgttgaaaaccggggcgctggattatctcatcaagccgctggatttcgataacctacagtcgacgctggaaaaggcgctcgcgcatacacacagtgttgacgctgaaacgcctgcggtgtctgccagccagttcggtatggtcggtaaaagcccggcgatgcaacacctgctcagtgaaatcgccctcgtcgcgccatcggaagccacggtgctgatccacggcgattccggcaccggtaaagagctggtcgccagggcgattcacgccagtagcgcacgtagcgaaaaaccgctggtaacgctcaactgcgcggcgctcaacgaatccttgctggagtctgaattgttcggtcacgaaaaaggggcgtttaccggggccgacaaacgccgggaagggcgctttgttgaggcggacggcggcacgttgtttctcgatgaaattggcgatatctcgccgatgatgcaggtgcgtctgctacgtgcgattcaggagcgcgaagttcagcgtgtcggtagcaaccagactatttcggttgatgtccggctgattgcggcaacccatcgcgatcttgccgcagaggtgaatgccgggcgttttcgccaggatctctactatcggctgaacgtggtggcgattgaagtaccatcgctgcggcaacggcgggaagatattcctctgctggctggccattttcttcagcgctttgccgaacgtaatcgcaaggcggtaaaaggctttacgccccaggcgatggatctgctgattcattacgactggccgggaaatattcgtgaactggaaaacgcggtggaacgggcggtggtgctgctgaccggggaatatatttccgaacgcgagctgccgctggcgattgccagtacgccgatcccgctggtacaaagtcaggatattcagccgctggtggaagtcgaaaaagaggtgattctggcggcgctggagaaaacgggcggcaacaaaaccgaagccgcccgccagttagggatcacgcgcaaaacgctattggcaaaactgtcgcgttag

SEQ ID NO: 9218 - protein, 441 aa, Escherichia coli
MTHDNIDILVVDDDISHCTILQALLRGWGYNVALANSGRQALEQVREQVFDLVLCDVRMAEMDGIATLKEIKTLNPAIPVLIMTAYSSIETAVEALKTGALDYLIKPLDFDNLQSTLEKALAHTHSVDAETPAVSASQFGMVGKSPAMQHLLSEIALVAPSEATVLIHGDSGTGKELVARAIHASSARSEKPLVTLNCAALNESLLESELFGHEKGAFTGADKRREGRFVEADGGTLFLDEIGDISPMMQVRLLRAIQEREVQRVGSNQTISVDVRLIAATHRDLAAEVNAGRFRQDLYYRLNVVAIEVPSLRQRREDIPLLAGHFLQRFAERNRKAVKGFTPQAMDLLIHYDWPGNIRELENAVERAVVLLTGEYISERELPLAIASTPIPLVQSQDIQPLVEVEKEVILAALEKTGGNKTEAARQLGITRKTLLAKLSR

SEQ ID NO: 9219 - DNA, 1290 bp, Escherichia coli
atgaaagtattagtgattggtaacggcgggcgcgagcacgcgctggcctggaaagcggctcagtcgccgctggttgaaactgtttttgttgctccgggtaatgcaggcactgcgctggaacccgcgctacagaacgtcgctatcggcgtaaccgatatcccggcgctgctggatttcgcacaaaacgaaaaggtagatctaaccatcgtcggcccggaagcgccgctggtgaaaggcgtagtcgataccttccgcgccgccgggctgaaaatcttcggcccaaccgcaggtgctgcacaactggaaggttctaaagcattcaccaaagactttctggcccgccataacattcccacagcggaataccagaacttcaccgaggtagaacctgcgctggcgtatctgcgtgagaaaggcgcgccaatcgtcattaaagcggacggtctggccgccgggaaaggcgttatcgtggcgatgacgctggaagaagctgaagccgccgtgcgcgacatgctggcgggcaacgcgtttggcgacgcgggtcatcgcattgttatcgaagagttcctcgacggcgaagaagcgagctttatcgtgatggtggacggcgagcatgtgctgccgatggccaccagccaggatcacaaacgcgtaggcgataaagataccgggccgaacaccggcgggatgggcgcttactcccctgcgccagtagtgaccgatgaggttcatcagcgcacgatggagcgtatcatctggccaaccgtgaaaggcatggcggcggaaggcaacacctacactggttttctctacgcgggcctgatgatcgacaaacagggcaatccgaaggttattgaatttaactgccgctttggcgatccggaaacccagccgattatgctgcgcatgaagtccgatctggttgagctctgcctggcggcctgtgaaggcaagctggacgagaaaacgtccgagtgggatgaacgcgcttctctcggcgtggtgatggctgcgggtggatatccgggcgattaccgcaccggcgatgtgatccacggcctgccgctggaagaagtggcagacggcaaagtgttccacgcgggcacgaaactagcggatgacgagcaggtagtgaccagcggcgggcgcgtactgtgcgttaccgcgctgggtcataccgtggcagaagcgcagaaacgcgcttatgccttaatgaccgatatccattgggacgactgcttctgccggaaagatatcggctggcgcgctatcgaacgcgagcagaactaa

SEQ ID NO: 9220 - protein, 429 aa, Escherichia coli
MKVLVIGNGGREHALAWKAAQSPLVETVFVAPGNAGTALEPALQNVAIGVTDIPALLDFAQNEKVDLTIVGPEAPLVKGVVDTFRAAGLKIFGPTAGAAQLEGSKAFTKDFLARHNIPTAEYQNFTEVEPALAYLREKGAPIVIKADGLAAGKGVIVAMTLEEAEAAVRDMLAGNAFGDAGHRIVIEEFLDGEEASFIVMVDGEHVLPMATSQDHKRVGDKDTGPNTGGMGAYSPAPVVTDEVHQRTMERIIWPTVKGMAAEGNTYTGFLYAGLMIDKQGNPKVIEFNCRFGDPETQPIMLRMKSDLVELCLAACEGKLDEKTSEWDERASLGVVMAAGGYPGDYRTGDVIHGLPLEEVADGKVFHAGTKLADDEQVVTSGGRVLCVTALGHTVAEAQKRAYALMTDIHWDDCFCRKDIGWRAIEREQN

SEQ ID NO: 9221 - DNA, 1590 bp, Escherichia coli
atgcaacaacgtcgtccagtccgccgcgctctgctcagtgtttctgacaaagccggtatcgtcgaattcgcccaggcactttccgcacgcggtgtggagctgctgtctacagggggcacagcccgtctgttagcagaaaaaggtctgccggtaaccgaagtttccgattacaccggtttcccggagatgatggatggacgcgtgaagaccctgcatccgaaagtacatggtggaattctgggccgtcgcggccaggacgataccattatggaagaacatcagatccagcctatcgatatggtggttgttaacctgtatccgttcgcccagaccgttgctcgtgaaggctgctcgctggaagatgcggttgagaacatcgatatcggcggcccgacgatggtgcgctctgccgccaagaaccataaagatgtcgcaatcgtggtgaagagcagcgactacgacgccattattaaagagatagatgccaatgaaggctccctgactctggaaactcgctttgaccttgccatcaaagccttcgaacacaccgccgcctacgacagcatgattgccaactacttcggcagcatggttccggcttaccacggtgaaagcaaagaagccgccggtcgcttcccacgcacgctgaacctgaacttcattaagaagcaggatatgcgttacggcgagaacagccaccagcaggctgccttctatatagaagagaatgtgaaagaagcctccgttgctactgcaacccaggttcaaggtaaagccctctcttataacaacatcgccgacaccgatgcggcgctggagtgcgtgaaagagttcgccgagccggcatgtgtgattgtgaaacacgccaacccttgcggcgtggctatcggcaattccattcttgatgcttacgatcgcgcgtacaaaaccgacccaacctccgcattcggcggcatcattgcctttaaccgcgaactggatgctgaaaccgcgcaggccatcatttctcgtcagttcgtcgaagtgattattgcgccgtccgccagcgaagaagccctgaaaatcaccgccgccaagcaaaacgtacgcgttctgacctgcggtcagtggggcgagcgtgttccgggtcttgatttcaaacgcgtgaacggcggtctgctggttcaggatcgcgatctggggatggtcggtgcagaagaactgcgcgtcgtcaccaaacgccagccgaccgaacaggaattgcgtgatgcgctgttctgctggaaagtggcgaagttcgtgaaatccaacgctatcgtctatgccaaaaacaatatgaccatcggtattggcgcgggccagatgagccgcgtgtactccgcgaaaatcgccggtattaaagccgccgatgaaggtctggaagtgaaaggttcctcgatggcttctgacgcgttcttcccgttccgcgacggtattgatgccgccgccgctgcgggcgtgacctgtgtaatccagcctggcggttccatccgtgatgacgaagtgattgccgccgccgacgagcacggtattgcgatgctcttcaccgacatgcgccacttccgccattaa

SEQ ID NO: 9222 - protein, 529 aa, Escherichia coli
MQQRRPVRRALLSVSDKAGIVEFAQALSARGVELLSTGGTARLLAEKGLPVTEVSDYTGFPEMMDGRVKTLHPKVHGGILGRRGQDDTIMEEHQIQPIDMVVVNLYPFAQTVAREGCSLEDAVENIDIGGPTMVRSAAKNHKDVAIVVKSSDYDAIIKEIDANEGSLTLETRFDLAIKAFEHTAAYDSMIANYFGSMVPAYHGESKEAAGRFPRTLNLNFIKKQDMRYGENSHQQAAFYIEENVKEASVATATQVQGKALSYNNIADTDAALECVKEFAEPACVIVKHANPCGVAIGNSILDAYDRAYKTDPTSAFGGIIAFNRELDAETAQAIISRQFVEVIIAPSASEEALKITAAKQNVRVLTCGQWGERVPGLDFKRVNGGLLVQDRDLGMVGAEELRVVTKRQPTEQELRDALFCWKVAKFVKSNAIVYAKNNMTIGIGAGQMSRVYSAKIAGIKAADEGLEVKGSSMASDAFFPFRDGIDAAAAAGVTCVIQPGGSIRDDEVIAAADEHGIAMLFTDMRHFRH

SEQ ID NO: 9223 - DNA, 123 bp, Escherichia coli
ttgcgcaacgctcgcgaatttttctctttcaatggtgatcacaattttgacagtgtttaccgtgggaaaaatacagaaattacattgatgattgtggataactctgtgcgtaaaaaggtataa

SEQ ID NO: 9224 - protein, 40 aa, Escherichia coli
MRNAREFFSFNGDHNFDSVYRGKNTEITLMIVDNSVRKKV

SEQ ID NO: 9225 - DNA, 126 bp, Escherichia coli; identical to SEQ ID NO: 637

SEQ ID NO: 9226 - protein, 41 aa, Escherichia coli; identical to SEQ ID NO: 638

SEQ ID NO: 9227 - DNA, 420 bp, Escherichia coli
ttgcatatcaattatttgcatgatgaagggaatctcatgtcagttctgtatatccaaattcgtcgtaatcaaattactgttcgcgatcttgaaagcaaacgtgaagtgtcaggagatgctgccttcagtaaccagcgcctgttaatcgccaatttctttgttgcagaaaaagttctgcaagatcttgttctgcaactccacccacgttcaacctggcattcttttttgccagcaaaacgtatggatattgttgtgagcgcgctggaaatgaatgagggcggtttgtcacaggttgaggaacgcattcttcatgaagtggtcgcaggggcaacgttaatgaaatatcgccagttccacatccatgcgcaatcagtggtactcagtgatagtgcggtcctggcaatgtttaagcagaaataa

SEQ ID NO: 9228 - protein, 139 aa, Escherichia coli
MHINYLHDEGNLMSVLYIQIRRNQITVRDLESKREVSGDAAFSNQRLLIANFFVAEKVLQDLVLQLHPRSTWHSFLPAKRMDIVVSALEMNEGGLSQVEERILHEVVAGATLMKYRQFHIHAQSVVLSDSAVLAMFKQK

SEQ ID NO: 9229 - DNA, 444 bp, Escherichia coli
atggttattagtattcgacgctcacggcatgaggagggggaggaactcgttgcgatttggtgtcgttctgtcgatgccactcacgattttttatcagcagagtatcgggccgagctggaagagctggtgcattcctttctgccggaagcaccgttgtgggtcgcggttaatgagcgggatcggccggttgggtttatgttgttaagtgggcagcatatggatgcgctgtttatcgatcctgatgtgcgcggctgcggcgtgggtcggatgctggtgaagcatgcgctctcaatggccccggaactgacaaccaatgttaatgagcaaaatgagcaggcggttgggttctataagaaggtgggttttaaggttacgggacgctctgaggtggacgatttggggaaaccgtatccattgctgaatctggcatatgtgggggtgtag

SEQ ID NO: 9230 - protein, 147 aa, Escherichia coli
MVISIRRSRHEEGEELVAIWCRSVDATHDFLSAEYRAELEELVHSFLPEAPLWVAVNERDRPVGFMLLSGQHMDALFIDPDVRGCGVGRMLVKHALSMAPELTTNVNEQNEQAVGFYKKVGFKVTGRSEVDDLGKPYPLLNLAYVGV

SEQ ID NO: 9231 - DNA, 930 bp, Escherichia coli
atgccgattcgtgtgccggacgagctacccgccgtcaatttcttgcgtgaagaaaacgtctttgtgatgacaacttctcgcgcgtctggtcaggaaattcgtccgctaaaggtgcttatccttaacctgatgccgaagaagatcgaaactgaaaatcagtttctgcgcctgctttcaaactcacctttgcaggtcgatattcagcttttgcgcatcgattcccgtgaatcgcgcaacacgcccgcagagcatctgaataacttctactgtaactttgaagatattcaggaacaaaactttgacggtctgatagttaccggcgcgccgctgggcctggtggagtttaatgatgtcgcttactggccgcagatcaaacaggtgctggagtggtcgaaagatcacgtcacctcgacgctgtttgtctgctgggctgtacaggccgcgctcaatatcctctatggtattcctaagcaaacccgcaccgacaaactctctggcgtttacgagcatcatattctccatcctcatgcgcttctgacgcgtggctttgatgattcattcttggcaccgcattcgcgctatgctgactttccggcagcgttgattcgtgattataccgatctggaaattctggcagagacggaagaaggggatgcatatctgtttgccagcaaagataagcgcattgcctttgtgacgggccatcccgaatatgatgcgcaaacgctggcgcaggaatatttccgcgatgtggaagccgggctagacccggatgtaccgtataactatttcccgcacaatgatccgcaaaatacaccgcgagcgagctggcgtagtcacggtaatttgctgtttaccaactggctcaactattacgtctaccagatcacgccatatgatctacggcacatgaatccaacgctggattaa

SEQ ID NO: 9232 - protein, 309 aa, Escherichia coli
MPIRVPDELPAVNFLREENVFVMTTSRASGQEIRPLKVLILNLMPKKIETENQFLRLLSNSPLQVDIQLLRIDSRESRNTPAEHLNNFYCNFEDIQEQNFDGLIVTGAPLGLVEFNDVAYWPQIKQVLEWSKDHVTSTLFVCWAVQAALNILYGIPKQTRTDKLSGVYEHHILHPHALLTRGFDDSFLAPHSRYADFPAALIRDYTDLEILAETEEGDAYLFASKDKRIAFVTGHPEYDAQTLAQEYFRDVEAGLDPDVPYNYFPHNDPQNTPRASWRSHGNLLFTNWLNYYVYQITPYDLRHMNPTLD

SEQ ID NO: 9233 - DNA, 1602 bp, Escherichia coli
atgactgaacaggcaacaacaatcgatgaactggcttttacaaggccgtatggcgagcaggagaagcaaattcttactgccgaagcggtagaatttctgactgagctggtgacgcattttacgccacaacgcaataaacttctggcagcgcgtattcagcagcagcaggatatcgataacggaatgttgcctgattttatttcggaaacagcttccattcgtgatgctgactggaaaattcgcgggattccttcggacttagaagatcgtcgcgtagagattaccggacctgtagagcgcaagatggtgatcaacgcgctcaacgccaatgtgaaagtctttatggccgatttcgaagattcactggcaccagactggaacaaagtgatcgatgggcaaattaacctgcgcgatgcggttaacggcaccatcagctatagcaatgaagcaggcaaaatttatcagctcaagcccaatccagcggttttgatttgtcgggtacgcggtctgcacttgccggaaaaacatgtcacctggcgtggtgagacaatccccggtagcctgtttgattttgcgctctatttcttccacaactatcaggcactgttggcaaagggcagcggtccctatttctatctgccgaaaacccagtcctggcaggaagcggcctggtggagcgaagtcttcagctatgcagaagatcgctttaatctgccgcgcggcaccatcaaggcgacgttgctgattgaaacgctgcccgccgtgttccagatggatgaaatccttcacgcgctgcgtgaccatattgttggtctgaactgcggtcgttgggattacatcttcagttatatcaaaacattgaaaaactatcccgatcgcgtcctgccagacagacaggcagtgacgatggataaacccttcctgaatgcttactcacgcctgttgattaaaacctgccataaacgcggtgcttttgcgatgggcggcatggcggcgtttattccaagcaaagatgaagagcgcaataaccaggtgctcgacaaagtaaaagcggataaatcgctggaagccaataacggtcacgatggcacatggatcgctcacccgggccttgctgatacggcaatggcggtattcaacgatattctcggctcccgcaaaaaccagcttgaggtgatgcgcgaacaagacgcgccgattactgccgatcagctgctggcaccttgtgatggtgaacgcaccgaagaaggtatgcgcgccaacattcgcgtggctgtgcagtacatcgaagcgtggatctctggcaatggctgtgtgccgatttatggcctgatggaagatgcggcgacggctgaaatttcccgtacctcaatctggcagtggatccatcatcaaaaaacgttgagcaatggcaaaccggtgactaaagccttgttccgccagatgctgggcgaagagatgaaagtcattgccagcgaactgggcgaagaacgtttctcccatgggcgttttgacgatgccgcacgcttgatggaacagatcaccacttccgatgagttaattgatttcctgaccctgccaggctaccgcctgttagcgtaa

SEQ ID NO: 9234 - protein, 533 aa, Escherichia coli
MTEQATTIDELAFTRPYGEQEKQILTAEAVEFLTELVTHFTPQRNKLLAARIQQQQDIDNGMLPDFISETASIRDADWKIRGIPSDLEDRRVEITGPVERKMVINALNANVKVFMADFEDSLAPDWNKVIDGQINLRDAVNGTISYSNEAGKIYQLKPNPAVLICRVRGLHLPEKHVTWRGETIPGSLFDFALYFFHNYQALLAKGSGPYFYLPKTQSWQEAAWWSEVFSYAEDRFNLPRGTIKATLLIETLPAVFQMDEILHALRDHIVGLNCGRWDYIFSYIKTLKNYPDRVLPDRQAVTMDKPFLNAYSRLLIKTCHKRGAFAMGGMAAFIPSKDEERNNQVLDKVKADKSLEANNGHDGTWIAHPGLADTAMAVFNDILGSRKNQLEVMREQDAPITADQLLAPCDGERTEEGMRANIRVAVQYIEAWISGNGCVPIYGLMEDAATAEISRTSIWQWIHHQKTLSNGKPVTKALFRQMLGEEMKVIASELGEERFSHGRFDDAARLMEQITTSDELIDFLTLPGYRLLA

SEQ ID NO: 9235 - DNA, 1305 bp, Escherichia coli
atgaaaacccgtacacaacaaattgaagaattacagaaagagtggactcaaccgcgttgggaaggcattactcgcccgtacagcgcggaagatgtggtgaaattacgcggttcagtcaatccggaatgcaccctggcgcaactgggcgcggcgaaaatgtggcgtctgctgcacggcgagtcgaaaaaaggctacatcaacagcctcggtgcactgactggtggtcaggcgctgcaacaggcgaaagcgggtattgaagcagtctatctgtcgggatggcaggtagcggcggacgctaacctggcggccagcatgtatccggatcagtcgctctatccggcaaactcggtgccagcggtggtggagcggatcaacaatactttccgccgtgcggatcagatccaatggtccgcgggcattgagccgggcgatccgcgctatgtcgattacttcctgccgatcgtcgccgatgcggaggccggttttggcggtgtactgaatgcctttgaactgatgaaagcgatgattgaagccggtgcagcggcagttcacttcgaagatcagctggcatcagtgaagaaatgtggtcacatgggcggcaaagttttggtgccaactcaggaagctattcagaaactggtcgcggcgcgtctggcagctgatgtgacgggcgttccaaccctgctggttgctcgtaccgatgccgatgcggcggatctgattacctccgattgcgacccacatgacagcgaatttattactggcgagcgtaccagtgaaggcttcttccgtactcatgcgggtattgagcaagcgatcagccgtggcctggcgtatgcgccatatgctgacctggtatggtgtgaaacctccacgccggacctggaactggcgcgtcgctttgcacaagccatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactatgttgagaaagtgcagcagccggaatttgccgccgcgaaagatggctataccttcgtatctcaccagcaggaagtgggtacaggttacttcgataaagtgacgaccattattcagggcggcacgtcgtcggttaccgcactgactggctccactgaagaatcgcagttctaa

SEQ ID NO: 9236 - protein, 434 aa, Escherichia coli
MKTRTQQIEELQKEWTQPRWEGITRPYSAEDVVKLRGSVNPECTLAQLGAAKMWRLLHGESKKGYINSLGALTGGQALQQAKAGIEAVYLSGWQVAADANLAASMYPDQSLYPANSVPAVVERINNTFRRADQIQWSAGIEPGDPRYVDYFLPIVADAEAGFGGVLNAFELMKAMIEAGAAAVHFEDQLASVKKCGHMGGKVLVPTQEAIQKLVAARLAADVTGVPTLLVARTDADAADLITSDCDPHDSEFITGERTSEGFFRTHAGIEQAISRGLAYAPYADLVWCETSTPDLELARRFAQAIHAKYPGKLLAYNCSPSFNWQKNLDDKTIASFQQQLSDMGYKFQFITLAGIHSMWFNMFDLANAYAQGEGMKHYVEKVQQPEFAAAKDGYTFVSHQQEVGTGYFDKVTTIIQGGTSSVTALTGSTEESQF

SEQ ID NO: 9237 - DNA, 1725 bp, Escherichia coli
atgccgcgtggcctggaattactgattgcacaaaccattttgcaaggtttcgacgctcagtatggtcgattcctcgaagtgacttccggggcgcagcagcgtttcgagcaagccgactggcatgctgtccagcaggcgatgaaaaaccgtattcatctttacgatcatcacgtgggtctggtcgtggagcaactgcgctgcattactaacggccaaagcacggacgcggcatttttactgcgcgttaaagagcattacacccggctgttgccagattacccgcgcttcgagattgcggagagctttttcaactccgtgtactgtcggttatttgaccaccgctcgcttactcccgagcggctttttatctttagctcccagccagagcgccgctttcgtaccattccacgcccactggcgaaagactttcaccccgatcacggctgggaatctctgctgatgcgcgttatcagcgatctgccgctgcgtctgcgttggcagaataaaagccgtgacattcattacatcgttcgccatctgacggaaacgctggggacagacaacctcgcggaaagtcatttacaggtggcgaacgaactgttttaccgcaataaggcagcctggctggtgggcaaactaataacgccttccggcacgttgccatttttattgccgatccaccagacggacgacggcgagttatttattgatacctgcctgacgacgaccgccgaagcgagcattgtttttggctttgcgcgttcttattttatggtttatgcaccgctgcccgcagcgctggtcgagtggctacgggaaattctgccaggtaaaaccaccgctgaattgtatatggctatcggctgccagaagcacgctaaaaccgaaagctaccgcgaatatctcgtttatctacagggctgtaatgagcagttcattgaagcgccgggtattcgtggaatggtgatgttggtgtttacgttgccgggttttgatcgggtatttaaagtcatcaaagacaggttcgcgccgcagaaagagatgtctgccgctcacgttcgtgcctgctatcaactggtgaaagagcacgatcgcgtgggccgaatggcggacacccaggagtttgaaaactttgtgctggagaagcggcatatttccccggcattaatggaattactgctccaggaagcagcggaaaaaatcaccgatctcggcgaacaaattgtgattcgccatctctatatcgaacgacggatggtgccgctcaatatctggctggaacaagtggaaggtcagcagctgcgcgacgccattgaagagtacggcaatgccattcgccagcttgccgctgccaacatcttccctggggatatgttatttaaaaactttggcgtcacccgtcacgggcgcgtggtgttttatgattacgatgaaatttgctacatgacggaagtgaatttccgcgacatcccgctgccgcgctacccggaagacgaacttgccagcgaaccgtggtacagcgtctcgccgggtgatgttttcccggaagagttccgtcactggttatgtgccgacccgcgtattggtccgctatttgaagagatgcacgccgacttgttccgcgctgattactggcgcgcactacaaaaccgcatacgtgaagggcatgtggaagatgtttatgcgtatcggcgcaggcagcggtttagcgttcgattcgtataa

SEQ ID NO: 9238 - protein, 574 aa, Escherichia coli
MPRGLELLIAQTILQGFDAQYGRFLEVTSGAQQRFEQADWHAVQQAMKNRIHLYDHHVGLVVEQLRCITNGQSTDAAFLLRVKEHYTRLLPDYPRFEIAESFFNSVYCRLFDHRSLTPERLFIFSSQPERRFRTIPRPLAKDFHPDHGWESLLMRVISDLPLRLRWQNKSRDIHYIVRHLTETLGTDNLAESHLQVANELFYRNKAAWLVGKLITPSGTLPFLLPIHQTDDGELFIDTCLTTTAEASIVFGFARSYFMVYAPLPAALVEWLREILPGKTTAELYMAIGCQKHAKTESYREYLVYLQGCNEQFIEAPGIRGMVMLVFTLPGFDRVFKVIKDRFAPQKEMSAAHVRACYQLVKEHDRVGRMADTQEFENFVLEKRHISPALMELLLQEAAEKITDLGEQIVIRHLYIERRMVPLNIWLEQVEGQQLRDAIEEYGNAIRQLAAANIFPGDMLFKNFGVTRHGRVVFYDYDEICYMTEVNFRDIPLPRYPEDELASEPWYSVSPGDVFPEEFRHWLCADPRIGPLFEEMHADLFRADYWRALQNRIREGHVEDVYAYRRRQRFSVRFV

SEQ ID NO: 9239 - DNA, 825 bp, Escherichia coli
atggtcgcacccattcccgcaaaacgcggcagaaaacccgccgttgccaccgcaccagcgactggacaggttcagtctttaacgcgtggcctgaaattactggagtggattgccgaatccaatggcagtgtggcactcacggaactggcacagcaagccgggttacccaattccacgacccaccgcctgctaaccacgatgcagcaacagggctttgtccgtcaggtcggcgaactgggtcactgggcaatcggcgcacacgcctttatggtcggtagcagctttctccagagccgtaatttgttagcgattgttcaccctatcctgcgcaatctaatggaagagtctggcgaaacggtcaatatggcggtgcttgatcaaagcaatcacgaagcgattattatcgaccaggtacagtgtactcacctgatgcgtatgtccgcgcctatcggcggtaaattgccgatgcacgcttccggtgcgggtaaagcctttctggcccaactgagcgaagaacaggtgacgaagctgctgcaccgcaaagggttacatgcctatacccacgcgacgctggtgtctcctgtgcatttaaaagaagatctcgcccaaacgcgcaaacggggttattcatttgacgatgaggaacatgcgctggggctgcgttgccttgcagcgtgtattttcgatgagcaccgcgaaccgtttgccgcaatttcaatttccgggccgatttcacgtattaccgatgaccgcgtgaccgagtttggcgcgatggtgattaaagcggcgaaggaagtgacgctgtcgtacggtggaatacgctga

SEQ ID NO: 9240 - protein, 274 aa, Escherichia coli
MVAPIPAKRGRKPAVATAPATGQVQSLTRGLKLLEWIAESNGSVALTELAQQAGLPNSTTHRLLTTMQQQGFVRQVGELGHWAIGAHAFMVGSSFLQSRNLLAIVHPILRNLMEESGETVNMAVLDQSNHEAIIIDQVQCTHLMRMSAPIGGKLPMHASGAGKAFLAQLSEEQVTKLLHRKGLHAYTHATLVSPVHLKEDLAQTRKRGYSFDDEEHALGLRCLAACIFDEHREPFAAISISGPISRITDDRVTEFGAMVIKAAKEVTLSYGGIR

SEQ ID NO: 9241 - DNA, 120 bp, Escherichia coli
gtggcaacggcgggttttctgccgcgttttgcgggaatgggtgcgaccatgacagtctcctttttctgtatcgtggaaatcattttcatttttattatcagcgaatgcaatagttgctga

SEQ ID NO: 9242 - protein, 39 aa, Escherichia coli
MATAGFLPRFAGMGATMTVSFFCIVEIIFIFIISECNSC

SEQ ID NO: 9243 - DNA, 3684 bp, Escherichia coli
gtgagcagcaaagtggaacaactgcgtgcgcagttaaatgaacgtattctggtgctggacggcggtatgggcaccatgatccagagctatcgactgaacgaagccgattttcgtggtgaacgctttgccgactggccatgcgatctcaaaggcaacaacgacctgctggtgctcagcaaaccggaagtgatcgccgctatccacaacgcctactttgaagcgggcgcggatatcatcgaaaccaacaccttcaactccacgactattgcgatggcggattaccaaatggaatccctgtcggcggaaatcaactttgcagcggcgaaactggcgcgcgcctgtgccgacgagtggactgcccgcacgccggagaaaccgcgctacgttgccggtgttctcggcccgaccaaccgcacggcgtctatttctccggacgtcaacgatccggcattccgcaacatcacttttgaccagctggtggcggcttatcgagaatccaccaaagcgctggtggaaggtggcgcggacctgatcctgattgaaaccgttttcgacacccttaacgccaaagcggcggtctttgcggtgaaaacggagtttgaagcgctgggcgttgagctgccgattatgatctccggcaccatcaccgacgcctccgggcgcacgctctccgggcagaccactgaagcgttttacaactccctgcgccacgccgaagcgctgacctttggcctgaactgtgcgctggggccagacgaactgcgccagtacgtacaggaactgtcgcgtattgcggaatgctatgtcaccgcccacccgaacgccgggctgcccaacgcctttggtgaatacgatctcgacgccgacacgatggcaaaacagatacgtgaatgggcagaagcgggctttctcaatatcgtcggcggctgctgcggcaccacgccacaacatattgcagcgatgagtcgtgcagtagaaggattagcgccgcgcaaactaccggaaattcccgtagcctgccgtttgtccggcctggagccgctgaacattggcgaagatagcctgtttgtgaacgtgggtgaacgcaccaacgtcaccggttccgctaagttcaagcgcctgatcaaagaagagaaatacagcgaggcgctggatgtggcgcgtcagcaggtggaaaacggtgcgcagattatcgatatcaacatggatgaagggatgctcgacgccgaagcggcgatggtgcgttttctcaatctgattgccggtgaaccggatatcgctcgcgtgccgattatgatcgactcctcaaaatgggacgttattgaaaaaggtctgaagtgtatccagggcaaaggcattgttaactctatctcgatgaaagagggtgtcgacgcctttatccatcacgcgaaactgttgcgtcgctacggtgcggcagtagtggtaatggcttttgacgaacagggccaggccgatacccgcgcacggaaaatcgagatttgccgtcgggcgtacaaaatcctcaccgaagaggttggcttcccggctgaagatatcatcttcgacccgaacatcttcgcggtcgcaactggcattgaagagcacaacaattacgcacaggactttatcggcgcgtgtgaagacatcaaacgtgaactgccgcacgcactgatttccggcggcgtttctaacgtgtcgttctcgtttcgtggcaacgatccggtgcgcgaagccattcacgcggtgttcctctactacgctattcgcaatggcatggatatggggatcgtcaacgccgggcaactggcgatttacgacgacctgcctaccgaactacgcgacgcggtggaggatgtgatcctcaaccgtcgcgacgatggcaccgagcgtttactggagcttgccgagaaatatcgcggcagcaaaaccgacgacaccgctaacacccagcaggcggagtggcgctcgtgggaagtgaataaacgtctggaatactcgctggtcaaaggcattaccgagtttatcgagcaggataccgaagaagcccgccagcaggctacgcgtccgattgaagtgattgaaggcccgttgatggacggcatgaacgtggtcggcgacctgtttggcgagggcaaaatgttcctgccgcaggtggtgaaatcggcgcgcgtcatgaaacaggcggtggcgtatctcgaaccgtttattgaagccagcaaagagcagggtaaaaccaacggcaagatggtgatcgccaccgtgaaaggcgatgtccacgacatcggtaaaaatatcgttggcgtggtgctgcaatgtaacaactacgaaattgtcgatctcggcgtgatggtgcctgcggaaaaaattctccgtaccgctaaagaagtgaatgctgatttgattggcctttcagggctgatcacgccgtcgctggacgagatggttaacgtggcgaaagagatggagcgtcagggcttcaccattccgctattgattggcggcgcgaccacctcaaaagcgcacacggcggtgaaaatcgagcagaactacagcggcccgacggtgtatgtgcagaacgcatcgcgcaccgttggtgtggtggcggcgttgctttccgacactcagcgcgatgatttcgttgctcgtacccgcaaggagtacgaaaccgtgcgtattcagcacggacgaaagaaaccacgcacaccaccggtcacgctggaagcggcgcgtgataacgacttcgcttttgactggcaggcttacacgccgccggtggcgcaccgtctcggtgtgcaggaagtcgaagccagcatcgaaacgctgcgtaattacatcgactggacgccgttctttatgacctggtcgctggccgggaagtatccgcgcattctggaagatgaagtggtaggtgttgaggcgcagcggctgtttaaagacgccaacgacatgctggataaattaagcgccgaaaaaatgctgaacccgcgtggcgtggtgggcctgttcccggcaaaccgtgtgggtgatgacattgaaatctaccgtgacgaaacgcgtacccatgtgattaatgtcagccaccatctacgccaacagaccgaaaaaaccggcttcgctaactactgtctcgctgacttcgttgcgccgaagctttctggtaaagcagattacatcggcgcatttgccgtgactggcgggctggaagaggacgcactggctgatgcctttgaagcacagcatgatgattacaacaaaatcatggtgaaagcgcttgccgaccgtctggcggaagcctttgctgagtatctccatgagcgtgtgcgtaaagtctactggggctatgcgccgaacgagaacctcagcaacgaagagctgatccgcgaaaactaccagggcatccgtccggcaccgggctaccctgcctgcccggaacatacggaaaaagccacaatctgggagctgctggaagtggaaaaacataccggtatgaaactcacggaatccttcgccatgtggccgggtgcatcggtttcgggttggtacttcagtcatccagacagcaagtattacgcggtggcgcaaattcagcgcgatcaggttgaagactatgcccgccgtaaaggaatgagcgttaccgaagtcgagcgttggttggcaccgaatctggggtatgatgccgagtaa

SEQ ID NO: 9244 - protein, 1227 aa, Escherichia coli
MSSKVEQLRAQLNERILVLDGGMGTMIQSYRLNEADFRGERFADWPCDLKGNNDLLVLSKPEVIAAIHNAYFEAGADIIETNTFNSTTIAMADYQMESLSAEINFAAAKLARACADEWTARTPEKPRYVAGVLGPTNRTASISPDVNDPAFRNITFDQLVAAYRESTKALVEGGADLILIETVFDTLNAKAAVFAVKTEFEALGVELPIMISGTITDASGRTLSGQTTEAFYNSLRHAEALTFGLNCALGPDELRQYVQELSRIAECYVTAHPNAGLPNAFGEYDLDADTMAKQIREWAEAGFLNIVGGCCGTTPQHIAAMSRAVEGLAPRKLPEIPVACRLSGLEPLNIGEDSLFVNVGERTNVTGSAKFKRLIKEEKYSEALDVARQQVENGAQIIDINMDEGMLDAEAAMVRFLNLIAGEPDIARVPIMIDSSKWDVIEKGLKCIQGKGIVNSISMKEGVDAFIHHAKLLRRYGAAVVVMAFDEQGQADTRARKIEICRRAYKILTEEVGFPAEDIIFDPNIFAVATGIEEHNNYAQDFIGACEDIKRELPHALISGGVSNVSFSFRGNDPVREAIHAVFLYYAIRNGMDMGIVNAGQLAIYDDLPTELRDAVEDVILNRRDDGTERLLELAEKYRGSKTDDTANTQQAEWRSWEVNKRLEYSLVKGITEFIEQDTEEARQQATRPIEVIEGPLMDGMNVVGDLFGEGKMFLPQVVKSARVMKQAVAYLEPFIEASKEQGKTNGKMVIATVKGDVHDIGKNIVGVVLQCNNYEIVDLGVMVPAEKILRTAKEVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHGRKKPRTPPVTLEAARDNDFAFDWQAYTPPVAHRLGVQEVEASIETLRNYIDWTPFFMTWSLAGKYPRILEDEVVGVEAQRLFKDANDMLDKLSAEKMLNPRGVVGLFPANRVGDDIEIYRDETRTHVINVSHHLRQQTEKTGFANYCLADFVAPKLSGKADYIGAFAVTGGLEEDALADAFEAQHDDYNKIMVKALADRLAEAFAEYLHERVRKVYWGYAPNENLSNEELIRENYQGIRPAPGYPACPEHTEKATIWELLEVEKHTGMKLTESFAMWPGASVSGWYFSHPDSKYYAVAQIQRDQVEDYARRKGMSVTEVERWLAPNLGYDAE

SEQ ID NO: 9245 - DNA, 450 bp, Escherichia coli
atgcaacgtcaatataaaaaatacattcttcttttttggggtgtcatggatgttatcgcgatagccacatatctgttctactcgcttggtaatggtcgtatccctttttattccgatatcgttcattcactttctttacttaaggatatcggtgttgaaggcggtttttacgcttatgcagtcgccactgttacgctacaaatagtattattgctctctttattcttttctgcgcaatgttttttaagacaaaaattatttagtttctcttttttggcgattcaggagtttatgcgttttgctaccgtaagctgttcaatctccgtaataccgttgttacttaattatttttattcacaggatctggtcttaaatatttcgttgtttatcttctcagaggtcacaaaagtgacaacgattatctggtgtaaacgacaggggaaagtgtga

SEQ ID NO: 9246 - protein, 149 aa, Escherichia coli
MQRQYKKYILLFWGVMDVIAIATYLFYSLGNGRIPFYSDIVHSLSLLKDIGVEGGFYAYAVATVTLQIVLLLSLFFSAQCFLRQKLFSFSFLAIQEFMRFATVSCSISVIPLLLNYFYSQDLVLNISLFIFSEVTKVTTIIWCKRQGKV

SEQ ID NO: 9247 - DNA, 1632 bp, Escherichia coli
gtgctaactttgcttcacctgctttctgccgtcgccctgctggtctgggggactcatattgttcgaacaggcgtaatgcgcgtcttcggcgcgcgtctgcgtactgtccttagccggagcgtcgaaaaaaagccgctcgccttttgcgcggggatcggcgttaccgcactggtgcagagcagtaatgccaccaccatgctggtgacctcgttcgtcgctcaggatctggttgctctcgcgcctgcgctggtgattgtgctgggtgcagatgtcgggacggcgctgatggcgcgtattctcaccttcgatttatcctggctgtcaccgttacttatttttatcggcgtgatttttttcctcggacgcaaacagtcacgcgccgggcaactgggccgcgtcggtattggtcttgggctgattttactggcgctggagttgattgtgcaggccgtaacgccgatcactcaggcaaacggcgttcaggtgatctttgcctcgctgactggcgacattttgctggatgcgctgattggtgcgatgttcgccattatcagctactccagccttgccgcggtactgctgaccgcgactctgaccgccgcaggcattatctctttcccagtggcgctttgtctggtgattggtgcaaacctcggttccggcctgctggcgatgctcaacaacagtgccgccaatgccgcagcccgccgtgtcgcgctgggtagcctgctgtttaagctggtgggtagcctgattatcctgccgtttgttcatttgctggcagagacaatggggaagttgccattgccaaaagcggaattggtgatctatttccacgtcttctacaaccttgtacgctgcctggtcatgttgccattcgttgacccgatggcacggttttgcaaaacgattattcgcgatgaaccggaactggatacccagctacggcctaaacatctggatgtcagcgcgctggatacgcccacgcttgctctggcgaacgctgcccgcgaaaccctgcgcattggcgacgccatggaacagatgatggaagggctgaataaagtgatgcacggcgagccacggcaggagaaagagctgcgtaagctggctgatgacatcaacgttctctataccgccattaagctgtatctggcgcggatgccaaaagaggaactggcagaagaagagtcgcgccgctgggcggagatcatcgaaatgtcgctcaaccttgaacaggcctccgatatcgtcgagcgcatggggagtgaaattgccgacaaatcgctggctgcaaggcgagcattttcgcttgatggcttgaaggaactggatgcgctctatgagcaattgctcagtaatttaaaactggcaatgtcggttttcttctctggcgatgttaccagcgcccgtcgtttgcgccgcagcaaacatcgttttcgcattcttaatcgccgctattcccacgcccacgtcgatcgcctgcatcagcaaaacgtgcagagtattgaaaccagttcgctacatttaggcttactgggagatatgcagcgtctgaactcgctgttttgttcggtggcttacagtgtgctggaacagccggatgaagatgaaggacgggacgagtattaa

SEQ ID NO: 9248 - protein, 543 aa, Escherichia coli
MLTLLHLLSAVALLVWGTHIVRTGVMRVFGARLRTVLSRSVEKKPLAFCAGIGVTALVQSSNATTMLVTSFVAQDLVALAPALVIVLGADVGTALMARILTFDLSWLSPLLIFIGVIFFLGRKQSRAGQLGRVGIGLGLILLALELIVQAVTPITQANGVQVIFASLTGDILLDALIGAMFAIISYSSLAAVLLTATLTAAGIISFPVALCLVIGANLGSGLLAMLNNSAANAAARRVALGSLLFKLVGSLIILPFVHLLAETMGKLPLPKAELVIYFHVFYNLVRCLVMLPFVDPMARFCKTIIRDEPELDTQLRPKHLDVSALDTPTLALANAARETLRIGDAMEQMMEGLNKVMHGEPRQEKELRKLADDINVLYTAIKLYLARMPKEELAEEESRRWAEIIEMSLNLEQASDIVERMGSEIADKSLAARRAFSLDGLKELDALYEQLLSNLKLAMSVFFSGDVTSARRLRRSKHRFRILNRRYSHAHVDRLHQQNVQSIETSSLHLGLLGDMQRLNSLFCSVAYSVLEQPDEDEGRDEY

SEQ ID NO: 9249 - DNA, 690 bp, Escherichia coli
atggaactgcttttattgagtaactcgacgctgccgggtaaagcctggctggaacacgcgctgccgctgattgctgaacagttgcaggggcgccgttctgcggtatttattcctttcgctggcgtaacgcagacctgggatgattacacagcgaaaacggctgcggttctcgctccgctgggtgtttctgtcaccggtattcatagcgttgtcgatcccgttgccgcgattgaaaatgcggaaattgtgattgtcggcggcggtaatactttccagttgctgaaacagtgccgcgagcgcgggctgctggcacccattactgacgtggtgaaacgtggcgcgctgtatattggctggagcgcaggcgctaaccttgcttgcccaaccattcgtaccaccaacgatatgccgattgtcgatccgcaaggtttcgatgcgctaaatctgttcccgctacaaatcaacccgcacttcaccaacgcgctgccggaaggccataaaggtgaaacccgtgagcagcgtattcgcgaactgctggtcgtcgcgccagaactgacgattattggtctgccggaaggtaactggatcacagtaagtaaaggtcacgctacgctgggtggcccgaacaccacttatgtgtttaaggctggtgaagaagcggtgccgctggaagcgggtcaccgtttttaa

SEQ ID NO: 9250 - protein, 229 aa, Escherichia coli
MELLLLSNSTLPGKAWLEHALPLIAEQLQGRRSAVFIPFAGVTQTWDDYTAKTAAVLAPLGVSVTGIHSVVDPVAAIENAEIVIVGGGNTFQLLKQCRERGLLAPITDVVKRGALYIGWSAGANLACPTIRTTNDMPIVDPQGFDALNLFPLQINPHFTNALPEGHKGETREQRIRELLVVAPELTIIGLPEGNWITVSKGHATLGGPNTTYVFKAGEEAVPLEAGHRF

SEQ ID NO: 9251 - DNA, 1230 bp, Escherichia coli
atgaaaacaacagctctgcgtctttatggcaaacgtgacctgcgtctggaaacctttgaccttcctgaaatgcaggaggatgaaatcctcgcgacggtggtcactgacagcctgtgcctctcttcctggaaagaggccaatctgggtgaaaaccataaaaaagtacccgacgatgtggcgaccaatcccatcatcatcggccacgaattttgcggcgatattctggccgtgggtaaaaagtggcagcacaaattccagccgggtcagcgttatgtgattcaggccaacctgcaactccccgaccgcccggattgccccggctactccttcccgtgggtaggcggcgaagcgacgcatgtggttattcccaacgaggtcatggaacaagattgcctgctggcatacgacggcgaaacctattttgaaggctcgctggttgaaccgctttcctgcgtgattggcgcgttcaacgccaactatcatcttcaggaaggtagttataaccacacgatggggattcgcccgcaagggcgcacgctgatcctcggcggcaccggaccaatgggactgttggcgattgattatgcgctacatggacccgttaacccttcgctgctcgtcattaccgataccgacaacgacaaattgagttatgcacgcaagcactatccatcagaaccgcaaacactgattcattatctcaatgccgccgatgcagcatttgatacgttaatggcactgagtggcggtcacggcttcgatgatattttcgtctttgtgcctaatgaaggactggtgactctcgcctcttccttgctggcgacagatggttgtctgaatttcttcgccggaccgcaggataagcacttcagcgcgccaattaatttctacgatgtgcattatgcatttacccactacgtgggcacatcaggcggcaataccgacgacatgcgcgcagcggtcaaattgattgaagagaaaaaagtgcaggccgcaaaagtggtaacacatattcttgggctgaatgccgcgggcgaaaccacgcttgaattgcctgccgtcggcggcggcaaaaagctggtgtataccgggaaatacctgccgctgacgtcactcacgcagattcaggatcaagcactggcggcaattctggcgcgtcatcaggggatctggtccggtgaggcggagcaatacctgctcgcccatgcagaggcaatttcccatgattaa

SEQ ID NO: 9252 - protein, 409 aa, Escherichia coli
MKTTALRLYGKRDLRLETFDLPEMQEDEILATVVTDSLCLSSWKEANLGENHKKVPDDVATNPIIIGHEFCGDILAVGKKWQHKFQPGQRYVIQANLQLPDRPDCPGYSFPWVGGEATHVVIPNEVMEQDCLLAYDGETYFEGSLVEPLSCVIGAFNANYHLQEGSYNHTMGIRPQGRTLILGGTGPMGLLAIDYALHGPVNPSLLVITDTDNDKLSYARKHYPSEPQTLIHYLNAADAAFDTLMALSGGHGFDDIFVFVPNEGLVTLASSLLATDGCLNFFAGPQDKHFSAPINFYDVHYAFTHYVGTSGGNTDDMRAAVKLIEEKKVQAAKVVTHILGLNAAGETTLELPAVGGGKKLVYTGKYLPLTSLTQIQDQALAAILARHQGIWSGEAEQYLLAHAEAISHD

SEQ ID NO: 9253 - DNA, 825 bp, Escherichia coli
atggaacagagaaaaattacacgcagcgatctggtgagcatgtttctgcgctccaacctgcaacaggcatcctttaactttgaacgtattcacgggctgggtttttgctacgacatgatccccgccatcaaacgactttacccattaaaagaggatcaggttgcggcgctcaggcgacacctggtgttcttcaataccacgccagccgtatgtggcccggtcatcggcgtcactgccgccatggaagaggcgcgagccaacggcgcggaaattgatgacggtaccattaacggcatcaaagtcggtctgatgggaccattggcaggagttggcgatccactggtctggggaacgctgcgcccgattaccgccgcgctcggcgcatctctggcactttcgggcaacattctcggccccctactgttcttctttattttcaacgcggtgcgtctggcgatgaagtggtatggcctacagctcggctttcgcaaaggggtgaatatcgtcagcgatatgggcggtaatttgctgcaaaaactcaccgaaggcgcgtcgattctcgggctgtttgtgatgggcgtgctggtgaccaaatggacgtcaatcaacgtaccgttggtggtttcacaaacgcctgccgccgatggtgccaccgtcaccataaccgtgcagaacatcctcgaccaactttgccctggtttgctggcgctcggtctgacgctgctgatggttcgtctgctcaacaaaaaaattaacccggtatggctgattttcgccctgtttggtttagggattatcggtaatgcgctgggcttcctgtcctga

SEQ ID NO: 9254 - protein, 274 aa, Escherichia coli
MEQRKITRSDLVSMFLRSNLQQASFNFERIHGLGFCYDMIPAIKRLYPLKEDQVAALRRHLVFFNTTPAVCGPVIGVTAAMEEARANGAEIDDGTINGIKVGLMGPLAGVGDPLVWGTLRPITAALGASLALSGNILGPLLFFFIFNAVRLAMKWYGLQLGFRKGVNIVSDMGGNLLQKLTEGASILGLFVMGVLVTKWTSINVPLVVSQTPAADGATVTITVQNILDQLCPGLLALGLTLLMVRLLNKKINPVWLIFALFGLGIIGNALGFLS

SEQ ID NO: 9255 - DNA, 798 bp, Escherichia coli
atggaaataagtaccctacaaatcattgctatatttcttttttcctgtattgccggaatgggcagcgtgctggatgaatttcagactcatcgtccgttaattgcctgtacggtgattggtttaattctcggtgatttaaaaaccggaattatgctcggtggtacgctggaattgatagctctcggctggatgaacgtcggcgcggcgcaatctccggattctgcactcgccagcataatctccgccattctggttatcgttggtcagcaaagcatcgccaccggaatcgccatcgcgttgcctgtggctgcggcaggccaggtgctgacggtgtttgcccgtaccatcaccgtagtgttccagcacgcggcggataaagcagcggaagaagcacggtttcgcactctcgatattctgcatgtctccgcgcttggcgtgcaggcactgcgcgttgctattccggcactgattgtctcgctgttcgtcagcgctgatatggtgagcaatatgctgagcgccattcccgaatttgtgacccgtggactgcagattgctggcggttttatcgtggtggtcggttacgccatggtgcttcgcatgatgggcgtgaaatatttgatgcctttctttttcctcggtttcctcgcaggtggctacctcgatctcagtctgctggcgttcggtggcgtcggcgtgatcatggccctgctctacatccagttaaatccacagtggcgtaaagctgaaccacatccccagaccaccactatcaccgcccttgaccaacttgatgattaa

SEQ ID NO: 9256 - protein, 265 aa, Escherichia coli
MEISTLQIIAIFLFSCIAGMGSVLDEFQTHRPLIACTVIGLILGDLKTGIMLGGTLELIALGWMNVGAAQSPDSALASIISAILVIVGQQSIATGIAIALPVAAAGQVLTVFARTITVVFQHAADKAAEEARFRTLDILHVSALGVQALRVAIPALIVSLFVSADMVSNMLSAIPEFVTRGLQIAGGFIVVVGYAMVLRMMGVKYLMPFFFLGFLAGGYLDLSLLAFGGVGVIMALLYIQLNPQWRKAEPHPQTTTITALDQLDD

SEQ ID NO: 9257 - DNA, 495 bp, Escherichia coli
atgaacattacgctcgcccgcattgatgaccgcctgatccacggccaggtcactaccgtctggtctaaagtggctaacgcccaacgcattattatctgcaatgacgaagtttataacgatgaagttcgccggacattattgcgtcaggctgcgccaccgggaatgaaggttaacgtggtcaatattgaaaaagccgtcgcggtttatcacaacccgcaatatcaggacgaaaccgttttttatcttttcactcgcccacaggatgccttagcaatggttcgccagggggtaaaaataggtaccctgaatattggcggtatggcctggcgtcctggtaagaaacagttaaccaaagcagtttcattagatgacgatgatattaacgcatttcatgagttaaataatcttggcgtcatactggatttacgcgtcgtagcgtcagatccctcaatcaatattatcgacaaaataaacgaacagttaatcgcaaattaa

SEQ ID NO: 9258 - protein, 164 aa, Escherichia coli
MNITLARIDDRLIHGQVTTVWSKVANAQRIIICNDEVYNDEVRRTLLRQAAPPGMKVNVVNIEKAVAVYHNPQYQDETVFYLFTRPQDALAMVRQGVKIGTLNIGGMAWRPGKKQLTKAVSLDDDDINAFHELNNLGVILDLRVVASDPSINIIDKINEQLIAN

SEQ ID NO: 9259 - DNA, 408 bp, Escherichia coli
atggtcaatgccattttttgcgcccacggcaaattagcctgcgccatgctggaatcggttcagatggtgtacggcgatgccagggtcgaggcagttgaatttgtgcccggcgagaacgccggagacattgtggcaaagctggagaagttagtgagcattcacaatcatgacgagtggctaatcgccgtggatttacagtgcggcagcccgtggaatgcggcagcgatgcttgcgatgcgcaatcctcgtctgcgggtaatcagcggcctttctctgccgctggcgctcgaactggttgataaccaggacagcatgaatgttgatgaactgtgtgaacacctgacgcaaatcgcaaagcaaacctgcgtcgtctggagacaggtagcaacagcagaggaggatttctga

SEQ ID NO: 9260 - protein, 135 aa, Escherichia coli
MVNAIFCAHGKLACAMLESVQMVYGDARVEAVEFVPGENAGDIVAKLEKLVSIHNHDEWLIAVDLQCGSPWNAAAMLAMRNPRLRVISGLSLPLALELVDNQDSMNVDELCEHLTQIAKQTCVVWRQVATAEEDF

SEQ ID NO: 9261 - DNA, 807 bp, Escherichia coli
atgcaaacgtggttaaatttgcaggataaaatcattattgtcaccggtggcgcatccggtattggtctggcgattgtagaggaattattagcacaaggcgcgaatgtacagatggtcgatattcacggtggcgatggtcaatatgaaagccataaaggttatcagttctggccgaccgatatttccagcgccaaagagataaatcatacggtagcagaaattatccagcgttttggtcgcatcgacggtctggttaacaacgccggggtcaatttcccgcgtctgctggtcgatgagaaagcgcctgccgggcagtatgaactcaacgaagctgcattcgaaaaaatggtcaatatcaaccagaaaggcgtttttctgatgtcgcaggcggtggcgcgacagatggtcaaacaacatgatggcgtgattgtgaatgtttcctcagaaagtgggctggaaggctcagaaggccaaagctgttacgccgcgaccaaagccgcgctcaatagcttcacgcgctcctggtcgaaagagctgggcaagcacggtatccgtgtggtcggtatcgcgccggggattctggaaaaaacaggactgcgcacgccggaatatgaagaagcgctggcgtggacgcgcaatatcaccgtcgagcagctgcgtgaaggctataccaaaaacgccattcctattgggcgcgccggaagattagcagaagtggctgattttgtttgttatctgctgtctgaacgcgccagctatatcaccggagtaaccactaacattgcaggcggcaaaacgcgcggctaa

SEQ ID NO: 9262 - protein, 268 aa, Escherichia coli
MQTWLNLQDKIIIVTGGASGIGLAIVEELLAQGANVQMVDIHGGDGQYESHKGYQFWPTDISSAKEINHTVAEIIQRFGRIDGLVNNAGVNFPRLLVDEKAPAGQYELNEAAFEKMVNINQKGVFLMSQAVARQMVKQHDGVIVNVSSESGLEGSEGQSCYAATKAALNSFTRSWSKELGKHGIRVVGIAPGILEKTGLRTPEYEEALAWTRNITVEQLREGYTKNAIPIGRAGRLAEVADFVCYLLSERASYITGVTTNIAGGKTRG

SEQ ID NO: 9263 - DNA, 948 bp, Escherichia coli
atggaaaacagtgacgatatccgtttgattgtgaagattgcccaactctattacgaacaggatatgacgcaggcgcaaattgcgcgcgaactgggtatttatcgcactaccatcagccgcttgcttaaacgaggccgcgatcagggaattgtcaccatcgccatcaactatgactacaacgaaaatctctggctggagcagcaagtgaagcaaaagtttggcctgaaagacgttgtggtggtgtcaggaaatgatgaggatgaagatattcaactggcgatgatggggttacacggcgcgcaactgctggatcgcttgctggaacctggcgatattgtcggtttttcctggggccgcgcggtgagcgcactggttgaaaacttgccgcaggcggggcaatcgcggcagttaatttgcgtgccgattattggcggcccgtccggtaaactcgaaagccgctatcacgtaaacacattaacctacagcgcggcagcgaagctgaaaggggaatcgcatctcgcggattttccggcgctgctggataacccattaattcgtaatgggatcatgcagtctcagcactttaaaaccatctctgcctactgggataatctggatgtcgccctggtgggaattggctcaccggccattcgcgacggcgctaactggcatgcgttttatggtggtgaagagagtgacgacctgaatgcccgccaggttgctggcgatatttgctcgcgcttttttgatattcacggcgcaatggttgaaacgaatatgagcgaaaaaacactctctatcgaaatgaataaattaaagcaggcacggtattccattggcattgccatgagcgaagaaaaatacagcggaattgttggtgcactgcgtggaaaatatattaattgtctggtaacgaatagcagcacagctgaactattactgaaataa

SEQ ID NO: 9264 - protein, 315 aa, Escherichia coli
MENSDDIRLIVKIAQLYYEQDMTQAQIARELGIYRTTISRLLKRGRDQGIVTIAINYDYNENLWLEQQVKQKFGLKDVVVVSGNDEDEDIQLAMMGLHGAQLLDRLLEPGDIVGFSWGRAVSALVENLPQAGQSRQLICVPIIGGPSGKLESRYHVNTLTYSAAAKLKGESHLADFPALLDNPLIRNGIMQSQHFKTISAYWDNLDVALVGIGSPAIRDGANWHAFYGGEESDDLNARQVAGDICSRFFDIHGAMVETNMSEKTLSIEMNKLKQARYSIGIAMSEEKYSGIVGALRGKYINCLVTNSSTAELLLK

SEQ ID NO: 9265 - DNA, 873 bp, Escherichia coli
atgctgcccgactcatcagtccgtttaaataaatacatcagcgaaagcggaatttgctcacgccgcgaagcggatcgctatatcgagcaaggcaatgtgttccttaatggcaagcgagccaccattggcgatcaggtgaaacccggcgacgttgtgaaagtaaatggtcagttgattgagcctcgggaatccgaagatttggtacttatcgccctgaacaagcccgtcggtattgtcagcaccaccgaagatggcgagcgcgataacattgtcgatttcgttaaccacagcaaacgcgtgttcccgattggccgcctggataaagattcccaggggctgattttcctcaccaatcacggcgatctggtgaataagatcctccgtgcgggtaacgatcatgagaaagagtatctggtgacggttgataaaccgattaccgatgaatttattcgtggtatgggggcgggagtaccgatcctcgggacggtaactaaaaagtgcaaagtcaaaaaagaagcaccgtttgtcttccgcattaccctggtgcaggggctgaaccgtcagattcgtcgcatgtgcgagcactttggttacgaagtgaaaaagctggaacgtacgcgcattatgaacgtcagcttaagcggcattccgctgggtgagtggcgcgatttaaccgacgatgagttaatcgatctctttaagctcattgaaaattcctcttccgaggcaaaacctaaagcgaaggccaaaccgaaaacggtaggcatcaaacgtccagtcgttaagatggaaaaaacggcggaaaaaggcggtcgcccggcgtccaacggtaagcgttttacctcgccggggcgcaaaaagaaggggcgttaa

SEQ ID NO: 9266 - protein, 290 aa, Escherichia coli
MLPDSSVRLNKYISESGICSRREADRYIEQGNVFLNGKRATIGDQVKPGDVVKVNGQLIEPRESEDLVLIALNKPVGIVSTTEDGERDNIVDFVNHSKRVFPIGRLDKDSQGLIFLTNHGDLVNKILRAGNDHEKEYLVTVDKPITDEFIRGMGAGVPILGTVTKKCKVKKEAPFVFRITLVQGLNRQIRRMCEHFGYEVKKLERTRIMNVSLSGIPLGEWRDLTDDELIDLFKLIENSSSEAKPKAKAKPKTVGIKRPVVKMEKTAEKGGRPASNGKRFTSPGRKKKGR

SEQ ID NO: 9267 - DNA, 273 bp, Escherichia coli
atggcactcccccgtattacccaaaaagagatgactgaacgcgagcagcgtgaacttaaaacactgctggatcgggcgcggattgcgcatggtcgcgtactgaccaactccgaaactaacagcattaagaaagagtacatcgataaattaatggtcgagcgtgaggctgaagcgaaaaaagcccgccaattgaagaaaaagcaggcttataaaccggatcctgaggcgtcatttagctggtcagcaaatacgtcgacgcgcggcagacgctga

SEQ ID NO: 9268 - protein, 90 aa, Escherichia coli
MALPRITQKEMTEREQRELKTLLDRARIAHGRVLTNSETNSIKKEYIDKLMVEREAEAKKARQLKKKQAYKPDPEASFSWSANTSTRGRR

SEQ ID NO: 9269 - DNA, 1350 bp, Escherichia coli
atgtctgaaattgttgtctccaaatttggcggtaccagcgtagctgattttgacgccatgaaccgcagcgctgatattgtgctttctgatgccaacgtacgtttagttgtcctctcggcttctgctggtatcactaatctactggtcgctttagctgaaggactggaacctggcgagcgattcgaaaaactcgacgcaatccgcaatatccagtttgccattctggaacgtctgcgttacccgaacgttatccgtgaagagattgaacgtctgctggagaatattactgttctggcagaagcggcggcgctggcaacgtctccggccctgacagatgaactggtcagccacggcgagctgatgtcgaccctgctgtttgtcgagatcctgcgcgaacgcgatgttcaggcacagtggtttgatgtacgtaaagtgatgcgtaccaacgatcgatttggtcgtgcagagccagatgtagccgcgctggcggaactggccgcgctgcagctgctcccacgcctcaatgaaggcttagtgatcacccagggatttatcggcagcgaaaataaaggtcgtacaacgacgcttggccgtggaggcagcgattatacggcagccttgctggcggaggctttacacgcatctcgtgttgatatctggaccgacgtcccgggcatctacaccaccgatccacgcgtggtttccgcagcaaaacgcattgatgaaatcgcgtttgccgaagcggcagagatggcaacttttggtgcaaaagtactgcatccggcaacgttgctacccgcagtacgcagcgatatcccagtctttgtcggctccagcaaagacccacgcgcaggtggtacgctggtgtgcaataaaactgaaaatccgccgctgttccgcgcgctggcgcttcgtcgcaatcagactctgctcactttgcacagcctgaatatgctgcattctcgcggtttcctcgcggaagttttcggcatcctcgcgcggcataatatttcggtagacttaatcaccacgtcagaagtgagtgtggcattaacccttgataccaccggttcaacctccactggcgatacgttgctgacgcaatctctgctgatggagctgtctgcactgtgccgggtggaagtggaagagggtctggcgctggtcgcgttgattggcaatgacctgtcaaaagcctgcggcgttggcaaagaggtattcggcgtactggaaccgttcaacattcgcatgatttgttacggcgcatccagccataacctgtgcttcctggtgcccggcgaagatgccgagcaggtagtgcagaagctgcattttaatttgtttgagtaa

SEQ ID NO: 9270 - protein, 449 aa, Escherichia coli
MSEIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDVAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHFNLFE

SEQ ID NO: 9271 - DNA, 1650 bp, Escherichia coli
atgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaagatctggcgaaagagtgcgatctggcgggcgcgattaagtcgatgttctctggcgagaagatcaaccgcactgaaaaccgcgccgtactgcacgtagcgctgcgtaaccgtagcaataccccgattctggttgatggcaaagatgttatgccggaagtcaacgcagtgctggagaagatgaaaaccttctcggaagcgattatttccggtgagtggaaaggctataccggcaaggcaatcactgacgtagtgaacatcgggatcggcggttctgacctcggcccgtacatggtgactgaagcactgcgtccatacaaaaaccacctgaacatgcactttgtttctaacgtcgatgggactcacatcgcggaagtgctgaaaaaagtaaacccggaaaccacgctgttcctggtagcatctaaaaccttcaccactcaggaaaccatgaccaacgcccatagcgcgcgtgactggttcctgaaagcggcaggtgatgagaaacacgttgcgaaacacttcgctgcgctctcaaccaacgccaaagccgttggcgagtttggtattgatactgccaacatgttcgaattctgggactgggtcggcggtcgttactctttgtggtcagcgattggcctgtcgattgttctctccatcggctttgataacttcgttgaactgctttctggcgcacacgcgatggacaagcatttctccaccacgcctgccgagaaaaacctgcctgtactgctggcgctgattggcatctggtacaacaatttctttggcgcggaaactgaagcgattctgccgtatgaccagtatatgcaccgtttcgcggcgtacttccagcagggcaatatggaatccaacggtaagtatgttgaccgtaacggtaaggttgtggattaccagactggcccgattatctggggtgaacctggcacgaacggtcagcacgcgttctatcagctgatccaccagggaaccaaaatggtaccgtgcgatttcatcgctccggctatcacccataacccgctctctgatcatcaccagaaactgctgtctaacttctttgctcagaccgaagcgctggcgtttggtaaatcccgcgaagtggttgagcaggaatatcgcgatcagggtaaagatccggcaacgcttgactacgtggtgccgttcaaagtgttcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggagctgggtaaacaactggcgaaccgtattctgccagagctgaaagatgataaagaaatcagcagccacgatagctcgaccaatggtctgattaaccgctataaagcgtggcgcggttaa

SEQ ID NO: 9272 - protein, 549 aa, Escherichia coli
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 9273 - DNA, 249 bp, Escherichia coli
gtggtcgtggttgtggtggtcccggtattagaaccatcaccgccaccggttgccgcgagcgcgacacccaccgccgagcttacggtgctgacgctggtcgcggaggaactccccgccgaaaccgacgttgctgccgatcctgccgcttcgcccacctgtacaggtgcagcccacgcagaagtcgccgcaagcgcagatatggcaaaaatgccatacagaacttttttcataacaatttcccttcattga

SEQ ID NO: 9274 - protein, 82 aa, Escherichia coli
MVVVVVVPVLEPSPPPVAASATPTAELTVLTLVAEELPAETDVAADPAASPTCTGAAHAEVAASADMAKMPYRTFFITISLH

SEQ ID NO: 9275 - DNA, 639 bp, Escherichia coli
gtgaagcgacctgcactcattcttatctgcctgctattacaggcctgttcagccacgactaaagagctgggcaattcactgtgggacagtctgttcggcacgccaggcgtacagctgacggacgatgatattcaaaatatgccctacgccagccagtacatgcagcttaatggcgggccgcagttatttgtggtgctggccttcgctgaagacggacaacaaaaatgggtcactcaggatcaggccactctcgtcacacaacatggtcgtctggtgaagactttgcttggtggcgacaacctgattgaagtgaataaccttgccactgacccgctgattaaacccgcacaaattgttgatggtgcaacatggacgcgcacgatgggctggaccgagtaccagcaggtacgctacgccaccgcacgctcagtcttcaaatgggatggcaccgataccgtcaaagtcggcagcgatgaaaccccggttcgcgtgctggacgaagaagtctccaccgaccaggcgcgctggcataaccgctattggatcgacagcgaagggcaaattcgccagtcggaacagtatctcggcgcggattatttcccggtgaaaaccactctcatcaaggcggcaaaacaatga

SEQ ID NO: 9276 - protein, 212 aa, Escherichia coli
MKRPALILICLLLQACSATTKELGNSLWDSLFGTPGVQLTDDDIQNMPYASQYMQLNGGPQLFVVLAFAEDGQQKWVTQDQATLVTQHGRLVKTLLGGDNLIEVNNLATDPLIKPAQIVDGATWTRTMGWTEYQQVRYATARSVFKWDGTDTVKVGSDETPVRVLDEEVSTDQARWHNRYWIDSEGQIRQSEQYLGADYFPVKTTLIKAAKQ

SEQ ID NO: 9277 - DNA, 738 bp, Escherichia coli
atgattaaacaaactattgtcgcattgattttgagtgtgggggcgtcatcggtcttcgcggcgggaaccgtcaaggtattcagcaatggcagcagtgaggccaaaacgctgacgggtgcagagcatttaatcgatctggtaggccaaccacggctggcaaacagttggtggcccggagcggtgattagcgaagagctggccacggcggcagcattgcgtcagcagcaggcgttgctgacacggctggcagaactggctgcagattccagcgccgacgatgccgccgcgattaacgccttacgccagcaaattcaggcgttgaaggtgacgggcaggcaaaaaatcaatcttgatcctgatatcgtccgcgttgccgaacgcggtaacccgccgttgcagggcaactacacgctgtgggtcggaacgccgccgtccacggtcacgttgttcgggcttatcagtcgtcctggcaagcagtcattcactccaggtcgcgacgtggcgagctatctctctgaccagagcctgctcagcggtgcggatcgcagctacgcgtgggtggtttacccgtccggacgcacgcaaaaagcgccggtggcttattggaacaagcgtcacgtagagccgatgcccggcagcattatttatgttggcctcgcggactccgtctggagtgagacacctgatgcccttaacgccgacattcttcagactctgacgcagcggataccccaataa

SEQ ID NO: 9278 - protein, 245 aa, Escherichia coli
MIKQTIVALILSVGASSVFAAGTVKVFSNGSSEAKTLTGAEHLIDLVGQPRLANSWWPGAVISEELATAAALRQQQALLTRLAELAADSSADDAAAINALRQQIQALKVTGRQKINLDPDIVRVAERGNPPLQGNYTLWVGTPPSTVTLFGLISRPGKQSFTPGRDVASYLSDQSLLSGADRSYAWVVYPSGRTQKAPVAYWNKRHVEPMPGSIIYVGLADSVWSETPDALNADILQTLTQRIPQ

SEQ ID NO: 9279 - DNA, 2097 bp, Escherichia coli
atgaaaaaaagacatctgcttagcttactggcgctgggcattagcacagcttgctacggcgaaatatatcctgcgcccattggtccgtcgcaatcggatttcggtggcgtaggattattacaaacgcccaccgcgcgcatggcgcgggaaggggagctgagcctgaactatcgcgataacgatcagtaccgttattactcagcttcagtgcaactcttcccgtggctggaaacaacgctgcgctacaccgacgtgcgcacccggcagtacagcagcgtcgaagcattctctggcgatcaaacgtataaagataaagccttcgatctcaaactgcgtttgtgggaagagagttactggctgccgcaagtggcggttggtgcgcgggatattggcggtacggggctgtttgatgcggaatatcttgttgccagcaaagcctgggggccgttcgattttacgctcggtctgggctggggatatctgggcaccagcggtaatgtgaaaaatccgctctgttcagccagtgataaatattgctatcgcgataacagctacaaacaggcgggatctatcgacggtagccagatgttccacggcccggcctcactgtttggcggcgtggaataccagacgccctggcaaccgctgcgcctgaaactggagtatgaaggcaataattatcagcaggattttgccgggaagctggagcaaaaaagtaagtttaacgtcggggcgatttatcgcgttaccgattgggccgacgttaaccttagctatgaacgtggcaacacctttatgtttggcgttacgctgcgcaccaactttaacgatctgcgcccgtcctacaacgataacgcccgcccgcaatatcaaccgcagccgcaggatgccattttgcagcactcggtggtggcgaatcagttaacgctgttgaaatacaacgccggactggccgatccgcagatccaggcgaaaggcgatacgctgtatgttaccggcgagcaggtgaaatatcgtgattcgcgcgaagggatcatccgtgctaatcggatcgtgatgaacgatctgccggatgggatcaaaacgatccgcattacggaaaatcgccttaacatgccgcaggtgacgacggaaaccgatgtcgccagcctgaaaaatcatctcggcggagagccgttgggccacgaaacgacgctggcgcaaaaacgcgtcgagccagtggttccgaagtccaccgagcagggctggtatatcgacaaatcacgctttgatttccatatcgatccggtgctgaaccagtcggtcggtggcccggaaaacttttacatgtatcagctgggcgtgatgggaacggcggatttgtggctgacggaccatctgctgaccaccggcagcctgtttgctaaccttgccaacaactacgacaagtttaactacaccaatccgccgcaggactcgcacttaccgcgcgttcgtacccatgtgcgcgagtatgtgcagaacgatgtctatgtgaataacctgcaagccaactacttccagcatctgggcaacggcttctacggtcaggtctacggaggttatctcgaaaccatgtttggcggtgcgggggcagaagtgttgtatcgcccgctggacagcaactgggcgtttggtctggatgccaactacgttaaacagcgcgactggcgtagcgcaaaagatatgatgaaattcaccgattacagcgtgaaaaccggacatctgaccgcgtactggacgccatctttcgcccaggacgtgttagtgaaagcgagcgtcgggcagtatctggctggggataaaggcggcacgctggagatcgccaaacgctttgatagcggcgtggtagtggggggctatgccacgatcacgaatgtttcgaaagaggagtacggcgaaggggacttcaccaaaggcgtgtatgtctctgtaccgctggatctcttctcgtctggcccgacacgcagccgtgcggcgattggctggacgccgctgacgcgtgacggtggtcagcaacttgggcgtaagttccagttgtatgatatgaccagcgaccgtagcgtcaatttccgctaa

SEQ ID NO: 9280 - protein, 698 aa, Escherichia coli
MKKRHLLSLLALGISTACYGEIYPAPIGPSQSDFGGVGLLQTPTARMAREGELSLNYRDNDQYRYYSASVQLFPWLETTLRYTDVRTRQYSSVEAFSGDQTYKDKAFDLKLRLWEESYWLPQVAVGARDIGGTGLFDAEYLVASKAWGPFDFTLGLGWGYLGTSGNVKNPLCSASDKYCYRDNSYKQAGSIDGSQMFHGPASLFGGVEYQTPWQPLRLKLEYEGNNYQQDFAGKLEQKSKFNVGAIYRVTDWADVNLSYERGNTFMFGVTLRTNFNDLRPSYNDNARPQYQPQPQDAILQHSVVANQLTLLKYNAGLADPQIQAKGDTLYVTGEQVKYRDSREGIIRANRIVMNDLPDGIKTIRITENRLNMPQVTTETDVASLKNHLGGEPLGHETTLAQKRVEPVVPKSTEQGWYIDKSRFDFHIDPVLNQSVGGPENFYMYQLGVMGTADLWLTDHLLTTGSLFANLANNYDKFNYTNPPQDSHLPRVRTHVREYVQNDVYVNNLQANYFQHLGNGFYGQVYGGYLETMFGGAGAEVLYRPLDSNWAFGLDANYVKQRDWRSAKDMMKFTDYSVKTGHLTAYWTPSFAQDVLVKASVGQYLAGDKGGTLEIAKRFDSGVVVGGYATITNVSKEEYGEGDFTKGVYVSVPLDLFSSGPTRSRAAIGWTPLTRDGGQQLGRKFQLYDMTSDRSVNFR

SEQ ID NO: 9281 - DNA, 123 bp, Escherichia coli
gtgggcatctcccatcaacgtcgcatctggcaaaacacacagcccaaaaaaatcacccattcaggtgattcccagccaccagcaatgcgcgaaaaatcgacaatgttcctctggaacaaatga

SEQ ID NO: 9282 - protein, 40 aa, Escherichia coli
MGISHQRRIWQNTQPKKITHSGDSQPPAMREKSTMFLWNK

SEQ ID NO: 9283 - DNA, 411 bp, Escherichia coli
atgacgtcactctctcgtccgcgcgtggagtttatctccaccattttgcagaccgtactcaatcttggcctgttgtgcctcggcctgattttggttgtcttcctcggcaaagaaacggtgcatctggctgatgtgctgtttgcgccagaacaagccagtaaatatgagctggtagaagggctggtggtttactttctctatttcgaatttatcgcgctgattgtgaagtactttcagtccggttttcacttcccgctacgttactttgtctatattgggatcaccgccattgtgcgcttgatcatcgtcgatcataaatcgccactggatgtgttgatctactcggcagcgatcctgttactggtgatcaccctgtggctgtgtaattcgaaacggctgaagcgggagtaa

SEQ ID NO: 9284 - protein, 136 aa, Escherichia coli
MTSLSRPRVEFISTILQTVLNLGLLCLGLILVVFLGKETVHLADVLFAPEQASKYELVEGLVVYFLYFEFIALIVKYFQSGFHFPLRYFVYIGITAIVRLIIVDHKSPLDVLIYSAAILLLVITLWLCNSKRLKRE

SEQ ID NO: 9285 - DNA, 891 bp, Escherichia coli
atggcaatggtccaaccgaaatcgcaaaaagcacgtttgtttattactcacctgctactgctactttttatcgcggcaattatgttcccgctgctgatggtcgtcgccatctcgctgcgtcaggggaacttcgcgaccggtagtctgatcccggagcaaatctcctgggatcactggaaactggcgttaggttttagcgtggaacaggctgatggtcgcattacgccaccgccattcccggtactgctgtggctgtggaactcggtaaaggtcgccgggatttccgcgattggcattgtggcgctctccaccacctgcgcctacgctttcgcccgtatgcgctttccaggcaaagcgacgctgctgaaaggaatgctgattttccagatgttcccggcagtactttcactggtcgcgttgtatgcgttgtttgatcgtctgggtgagtacattccattcattggcctgaatactcacggcggcgtaattttcgcgtatctgggcgggattgcgctgcatgtctggaccatcaaaggttatttcgaaaccatcgacagttcgctggaagaagcggcggcgctggatggtgcgacaccgtggcaggccttccgccttgtcctgttgccgctgtcagtaccgattctggcggttgtgttcatcctgtcgtttatcgctgccattactgaagttccggtcgcgtcgctattactgcgtgacgtaaacagctacaccctggccgtggggatgcagcaatacctcaacccgcaaaactacctgtggggtgactttgccgccgctgccgtgatgtctgcattaccgatcaccatcgtcttcttgctggctcaacgctggctggtcaacggcctgacggcaggtggtgtgaaaggttaa

SEQ ID NO: 9286 - protein, 296 aa, Escherichia coli
MAMVQPKSQKARLFITHLLLLLFIAAIMFPLLMVVAISLRQGNFATGSLIPEQISWDHWKLALGFSVEQADGRITPPPFPVLLWLWNSVKVAGISAIGIVALSTTCAYAFARMRFPGKATLLKGMLIFQMFPAVLSLVALYALFDRLGEYIPFIGLNTHGGVIFAYLGGIALHVWTIKGYFETIDSSLEEAAALDGATPWQAFRLVLLPLSVPILAVVFILSFIAAITEVPVASLLLRDVNSYTLAVGMQQYLNPQNYLWGDFAAAAVMSALPITIVFLLAQRWLVNGLTAGGVKG

SEQ ID NO: 9287 - DNA, 1545 bp, Escherichia coli
atggatgtcattaaaaagaaacattggtggcaaagcgacgcgctgaaatggtcagtgttaggtctgctcggcctgctggtgggttaccttgttgttttaatgtacgcacaaggggaatacctgttcgccattaccacgctgatattgagctcagcggggctgtatattttcgccaatcgtaaagcctacgcctggcgctatgtttacccgggaatggctggaatgggattattcgtcctcttccctctggtctgcaccatcgccattgccttcaccaactacagcagcactaaccagctgacttttgaacgtgcgcaggaagtgttgctagatcgctcctggcaagcaggcaaaatctataattttggtctttatccggcgggcgatgagtggcaactggcgctcagcgacggcgaaaccggcaaaaattacctctccgacgcttttaaatttggcggcgagcaaaaactgcaactgaaagaaacgaccgcccagcccgaaggcgaacgcgcgaatctgcgcgtaattacccagaatcgtcaggcactgagtgacattaccgccattctgccggatggcaacaaagtgatgatgagctccctgcgccagttttctggcacgcagccgctctacacactcgacggtgacggcacgttgacgaataaccagagcggcgtgaaatatcggccgaataaccaaattggtttttaccaatccattaccgccgacggtcactggggggatgaaaagctaagccccggttacaccgtgaccaccggctggaaaaactttacccgcgtctttaccgacgaaggcattcagaaaccgttcctcgccattttcgtctggaccgtggtgttctcgctgatcactgtctttttaacggtggcggtcggcatggttctggcgtgtctggtgcagtgggaagcgttgcgcggcaaagcggtctatcgcgtcctgcttattctgccctacgcggtgccatcgttcatttcaatcttgattttcaaagggttgtttaaccagagttttggtgaaatcaacatgatgttgagcgcgctgtttggcgtgaagcccgcctggttcagcgatccgaccaccgcccgcacgatgctgattatcgtcaacacctggctgggttatccgtacatgatgatcctctgcatgggcttgctgaaggcgattccggacgatttgtatgaagcctcagcaatggatggcgcaggtccattccagaacttctttaagattacgctgccgctgctgattaaaccgctgacgccgctgatgatcgccagcttcgcctttaactttaacaacttcgtgctgattcaactgttaaccaacggcggcccggatcgtcttggcacgaccacgccagccggttataccgacctgcttgttaactacacctaccgtatcgcttttgaaggcggcgggggtcaggacttcggtctggcagcagcaattgccacgctgatcttcctgctggtgggcgcgctggcgatagtgaacctgaaagccacgcgaatgaagtttgattaa

SEQ ID NO: 9288 - protein, 514 aa, Escherichia coli
MDVIKKKHWWQSDALKWSVLGLLGLLVGYLVVLMYAQGEYLFAITTLILSSAGLYIFANRKAYAWRYVYPGMAGMGLFVLFPLVCTIAIAFTNYSSTNQLTFERAQEVLLDRSWQAGKIYNFGLYPAGDEWQLALSDGETGKNYLSDAFKFGGEQKLQLKETTAQPEGERANLRVITQNRQALSDITAILPDGNKVMMSSLRQFSGTQPLYTLDGDGTLTNNQSGVKYRPNNQIGFYQSITADGHWGDEKLSPGYTVTTGWKNFTRVFTDEGIQKPFLAIFVWTVVFSLITVFLTVAVGMVLACLVQWEALRGKAVYRVLLILPYAVPSFISILIFKGLFNQSFGEINMMLSALFGVKPAWFSDPTTARTMLIIVNTWLGYPYMMILCMGLLKAIPDDLYEASAMDGAGPFQNFFKITLPLLIKPLTPLMIASFAFNFNNFVLIQLLTNGGPDRLGTTTPAGYTDLLVNYTYRIAFEGGGGQDFGLAAAIATLIFLLVGALAIVNLKATRMKFD

SEQ ID NO: 9289 - DNA, 1191 bp, Escherichia coli
atgaaaataaaaacaggtgcacgcatcctcgcattatccgcattaacgacgatgatgttttccgcctcggctctcgccaaaatcgaagaaggtaaactggtaatctggattaacggcgataaaggctataacggtctcgctgaagtcggtaagaaattcgagaaagataccggaattaaagtcaccgttgagcatccggataaactggaagagaaattccctcaggttgcggcaactggcgatggccctgacattatcttctgggcgcacgaccgctttggcggctacgctcaatctggcctgttggcagaaatcaccccggacaaagcgttccaggacaagctgtatccgtttacctgggatgccgtacgttacaacggcaagctgattgcttacccgatcgctgtcgaagcgttatcactgatttataacaaagatctgctaccgaacccgccaaaaacctgggaagagatcccggcgctggataaagaactgaaagcgaaaggtaagagcgcgctgatgttcaacctgcaagaaccatacttcacctggccgctaattgcggctgacgggggttatgcgttcaagtatgaaaacggcaagtacgacattaaagacgtaggcgtggataacgctggcgcgaaagcgggtctgaccttcctggttgatctgattaaaaacaaacacatgaatgcagacaccgattactccatcgcagaagctgcctttaataaaggcgaaacagcgatgactatcaacggcccgtgggcatggtccaacatcgacaccagtaaagtgaattatggtgtaacggtactgccgaccttcaaaggtcaaccatctaaaccgttcgttggcgtgctgagcgcaggtattaacgccgccagtccgaacaaagagctggcgaaagagttcctcgaaaactatctgctgactgacgaaggtctggaagcggtcaataaagacaaaccgctgggtgcagtagcgctgaagtcctatcaggatgaacttgcgaaagatccacgtattgccgccaccatggataacgctcagaaaggtgaaattatgccgaacatcccgcagatgtccgctttctggtatgccgtgcgtactgcggtgatcaacgccgccagcggtcgtcagactgtggatgctgcgctgaaagatgcacagactcgtatcaccaagtaa

SEQ ID NO: 9290 - protein, 396 aa, Escherichia coli
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYQDELAKDPRIAATMDNAQKGEIMPNIPQMSAFWYAVRTAVINAASGRQTVDAALKDAQTRITK

SEQ ID NO: 9291 - DNA, 1116 bp, Escherichia coli
atggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaagcggatgaatgacactccgcctgcagaacgcggcgttggtatggtgtttcagtcttacgcgctctatccccacctgtcagtagcagaaaacatgtcatttggcctgaaactggcgggcgcgaaaaaagaagtgattaaccagcgagttaaccaggttgcggaagtgctgcaactggcgcatttgctggatcgcaaaccgaaagcgctctccggtggtcagcgtcagcgtgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgctggtcgcgtggcgcaggttgggaaaccgctggagctgtatcactatccggcagaccgttttgtcgccggatttatcggttcgccaaagatgaacttcctgccagtaaaagtgaccgccaccgcaatcgatcaagtgcaggtggagctgccgatgccgaatcgtcagcaagtctggctaccggtcgaaagccgtgatgtccaggttggagccaatatgtcactgggtattcgcccggagcatctactgccgagtgatatcgctgacgtcatccttgagggtgaagttcaggtcgttgagcaactcggcaacgaaacgcaaatccatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaa

SEQ ID NO: 9292 - protein, 371 aa, Escherichia coli
MASVQLQNVTKAWGEVVVSKDINLDIHEGEFVVFVGPSGCGKSTLLRMIAGLETITSGDLFIGEKRMNDTPPAERGVGMVFQSYALYPHLSVAENMSFGLKLAGAKKEVINQRVNQVAEVLQLAHLLDRKPKALSGGQRQRVAIGRTLVAEPSVFLLDEPLSNLDAALRVQMRIEISRLHKRLGRTMIYVTHDQVEAMTLADKIVVLDAGRVAQVGKPLELYHYPADRFVAGFIGSPKMNFLPVKVTATAIDQVQVELPMPNRQQVWLPVESRDVQVGANMSLGIRPEHLLPSDIADVILEGEVQVVEQLGNETQIHIQIPSIRQNLVYRQNDVVLVEEGATFAIGLPPERCHLFREDGTACRRLHKEPGV

SEQ ID NO: 9293 - DNA, 1341 bp, Escherichia coli
atgatgattactctgcgcaaacttcctctggcggttgccgtcgcagcgggcgtaatgtctgctcaggcaatggctgttgatttccacggctatgcacgttccggtattggctggacaggtagcggcggcgaacaacagtgtttccagactaccggtgctcaaagtaaataccgtcttggcaacgaatgtgaaacttatgctgaattaaaattgggtcaggaagtgtggaaagagggcgataagagcttctatttcgacactaacgtggcctattccgtcgcgcaacagaatgactgggaagctaccgatccggccttccgtgaagcaaacgtgcagggtaaaaacctgatcgaatggctgccaggctccaccatctgggcaggtaagcgcttctaccaacgtcatgacgttcatatgatcgacttctactactgggatatttctggtcctggtgccggtctggaaaacatcgatgttggcttcggtaaactctctctggcagcaacccgctcctctgaagcgggtggttcttcctctttcgccagcaacaatatttatgactataccaacgaaaccgcgaacgacgttttcgatgtgcgtttagcgcagatggaaatcaacccgggcggcacattagaactgggtgtcgactacggtcgtgccaacctgcgtgataactatcgtctggttgatggcgcatcgaaagacggctggttattcactgctgaacatactcagagtgtcctgaagggctttaacaagtttgttgttcagtacgctactgactcgatgacctcgcagggtaaaggtctgtcgcagggttctggcgtcgcgtttgataacgaaaaatttgcctacaatatcaataacaacggtcacatgctgcgtatcctcgaccacggtgcgatctccatgggcgacaactgggacatgatgtacgtgggtatgtaccaggatatcaactgggataacgacaacggcaccaagtggtggaccgtcggtattcgcccgatgtacaagtggacgccaatcatgagcaccgtgatggaaatcggctacgacaacgtcgaatcccagcgcaccggcgacaagaacaatcagtacaaaattacccttgcacaacaatggcaggctggcgacagcatctggtcacgcccggctattcgtgtcttcgcaacctacgccaagtgggatgagaaatggggttatgactacaccggtagctcttcaaccaacccatactacggcaaggctgtgtcggctgatttcaacggcggtagcttcggtcgtggcgacagcgacgagtggaccttcggtgcccagatggaaatctggtggtaa

SEQ ID NO: 9294 - protein, 446 aa, Escherichia coli
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGSSSTNPYYGKAVSADFNGGSFGRGDSDEWTFGAQMEIWW

SEQ ID NO: 9295 - DNA, 921 bp, Escherichia coli
atgaaaatgaataaaagtctcatcgctctctgtttatcagcagggttgctggcaagcgcacctggaatcagtcttgccgatgttaactacgtaccgcaaaacaccagcgacgcgccagccattccatctgccgcgctgcaacaactcacctggacaccggtcgatcaatctaaaacccagactactcaactgtcgaccggcggccaacaactgaatgtccctggcatcagtggtccggttgctgcgtacagcgtcccggcaaacattggtgaactgacactgacgctgaccagcgaagtgaacaaacaaaccagcgtatttgcgccgaatgtgctgattcttgatcagaacatgactccatcagccttcttccccagcagttatttcacctaccaggaacccggcgtgatgagtgcagatcggctggaaggcgttatgcgcctgacaccggcgttggggcagcaaaaactttatgttctggtctttaccacggaaaaagatctccagcagacgactcaactgctcgacccggctaaagcctatgccaaaggcgtcggtaactcgatcccggatattcccgatccggttgctcgtcataccaccgatggcttactgaaactgaaagtgaaaacgaactccagctccagcgtgttggtaggaccactatttggttcttccgctccagctccggttacggtaggcaacacggcggcaccagctgtggctgcacccgctccggcaccggtgaagaaaagcgagccgatgctcaacgacacggaaagttattttaataccgcgatcaaaaacgctgtcgcgaaaggtgatgttgataaggcgttaaaactgcttgatgaagctgaacgcctggggtcgacatctgcccgttccacctttatcagcagtgtaaaaggcaaggggtaa

SEQ ID NO: 9296 - protein, 306 aa, Escherichia coli
MKMNKSLIALCLSAGLLASAPGISLADVNYVPQNTSDAPAIPSAALQQLTWTPVDQSKTQTTQLSTGGQQLNVPGISGPVAAYSVPANIGELTLTLTSEVNKQTSVFAPNVLILDQNMTPSAFFPSSYFTYQEPGVMSADRLEGVMRLTPALGQQKLYVLVFTTEKDLQQTTQLLDPAKAYAKGVGNSIPDIPDPVARHTTDGLLKLKVKTNSSSSVLVGPLFGSSAPAPVTVGNTAAPAVAAPAPAPVKKSEPMLNDTESYFNTAIKNAVAKGDVDKALKLLDEAERLGSTSARSTFISSVKGKG

SEQ ID NO: 9297 - DNA, 153 bp, Escherichia coli
gtgctgattttgcaacaactggtgcgtctcctggcgcacctttttttctcctcctgtactattgttgcgtttttgttgcgcattagttcacttaatttgctttacatctcccgtaaatatttttctgcgatacaatgcctttacgttatgtaa

SEQ ID NO: 9298 - protein, 50 aa, Escherichia coli
MLILQQLVRLLAHLFFSSCTIVAFLLRISSLNLLYISRKYFSAIQCLYVM

SEQ ID NO: 9299 - DNA, 498 bp, Escherichia coli
atgtcacaccccgcgttaacgcaactgcgtgcgctgcgctattttacagagatccctgccctggagccgcaactgctcgactggctgttgctggaagattccatgacaaaacgttttgaacagcagggaaaaacggtgagcgtgacgatgatccgcgaagggtttgtcgagcagaatgaaatccccgaagaactgccactgctgccgaaagagtctcgttactggttacgtgaaattttgttatgtgccgatggtgaaccgtggcttgccggtcgtaccgtcgttcctgtgtcaacgttaagcgggccggagctggcgttacaaaaattaggtaaaacgccgttaggacgctatctgttcacatcatcgacattaacccgggactttattgagataggccgtgatgccggactgtgggggcgacgttcccgcctgcgattaagcggtaaaccgctgttgctaacagaactgtttttaccggcgtcaccgttgtactaa

SEQ ID NO: 9300 - protein, 165 aa, Escherichia coli
MSHPALTQLRALRYFTEIPALEPQLLDWLLLEDSMTKRFEQQGKTVSVTMIREGFVEQNEIPEELPLLPKESRYWLREILLCADGEPWLAGRTVVPVSTLSGPELALQKLGKTPLGRYLFTSSTLTRDFIEIGRDAGLWGRRSRLRLSGKPLLLTELFLPASPLY

SEQ ID NO: 9301 - DNA, 873 bp, Escherichia coli
atggagtggagtctgacgcagaataagctgctggcgtttcatcgcttaatgcgtacggataagccaattggcgcgttactgctgctctggccaacattatgggcgttgtgggtggcgacaccgggcgttccccagctctggatcctggcggtgtttgtcgcgggcgtctggctgatgcgcgctgctggttgtgtggtgaatgattatgctgaccgcaagtttgatggtcatgttaagcgcacggcgaaccgaccacttcccagcggcgcggtaacggagaaagaggcgcgcgcgctgtttgtagtgctggtactgatttcatttttactggtgctgacgctgaatacgatgactattctgttgtcgattgccgcgctggcgctggcgtgggtatacccgtttatgaagcggtatacccatctaccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccaccgcaatcctgttcggccaatacgataaattgattattggtatttttcagattggcgtactagcgctgatggcgatcatcggtgagttaaatggcttaggctggggatattactggtcaattctggtagctggcgcgctgtttgtttatcaacaaaaactgattgccaaccgcgagcgtgaagcctgctttaaagcatttatgaataataactatgttggtctggtactgtttttagggctggcaatgagttactggcatttctga

SEQ ID NO: 9302 - protein, 290 aa, Escherichia coli
MEWSLTQNKLLAFHRLMRTDKPIGALLLLWPTLWALWVATPGVPQLWILAVFVAGVWLMRAAGCVVNDYADRKFDGHVKRTANRPLPSGAVTEKEARALFVVLVLISFLLVLTLNTMTILLSIAALALAWVYPFMKRYTHLPQVVLGAAFGWSIPMAFAAVSESVPLSCWLMFLANILWAVAYDTQYAMVDRDDDVKIGIKSTAILFGQYDKLIIGIFQIGVLALMAIIGELNGLGWGYYWSILVAGALFVYQQKLIANREREACFKAFMNNNYVGLVLFLGLAMSYWHF

SEQ ID NO: 9303 - DNA, 2484 bp, Escherichia coli
atgactttctgctatccttgccgcgcatttgcattattaaccagaggctttacatcgtttatgtccggctggccacgaatttactacaaattactgaatttaccattaagcatcctggtaaaaagcaagtctattccggcggatcctgccccggaactggggctggatacctctcgtccaattatgtacgttttaccgtacaactcgaaagctgacttgctgacgttgcgcgcccagtgtctggcacatgacctgcctgacccgttagagccgctggaaatcgacggcacgctactgccgcgctatgtgttcattcacggcgggccgcgtgtgttcacctattacacgccgaaagaagagtctattaagctgttccacgactatctcgatttgcaccgcagcaacccaaatctggatgtgcagatggtgccagtatcggtgatgtttggtcgcgcgccggggcgtgaaaaaggcgaagtgaacccgccgctgcgtatgcttaacggtgtacagaaatttttcgctgtactgtggctcggtcgcgacagttttgtgcgtttctcgccgtcagtttcgctgcgccgtatggcggatgaacacggcacggataaaactatcgctcagaaactggcgcgcgtggcgcgtatgcactttgcccgtcaacgcctggctgccgtgggtccacgtctgcctgctcgtcaggatctgtttaataagctgctcgcctcccgcgccattgcgaaagcggtagaagatgaagcgcgcagcaaaaaaatctcccatgaaaaagcgcagcagaacgcgattgcgctgatggaagagattgcggcgaatttctcttacgagatgatccgcctgactgaccgcattctgggcttcacctggaaccgactttaccagggtatcaacgtccataacgccgagcgcgttcgccagctggcccacgacggccatgagctagtgtatgtgccttgccaccgcagtcacatggactacctgctgctttcttacgtgctgtatcaccaggggctggtgccgccgcatatcgccgccgggatcaacctgaacttctggccggccgggccgattttccgccgtctgggggcgttctttattcgccgtacgtttaaaggcaataaactttattccaccgttttccgtgagtatctcggcgaactgttcagccgtggttattccgtcgagtatttcgtggaaggcggtcgttcccgtacggggcgtttgctggatccgaaaaccggtacgctatcgatgaccattcaggcgatgctgcgtggcggcactcgtccgattacgctgattccgatctatatcggttatgagcacgtcatggaagtgggtacttacgccaaagaactgcgcggtgcgacgaaagagaaagagagcctgccgcagatgctgcgtggtttaagcaagctgcgtaatctcggtcagggttacgtcaacttcggtgaaccaatgccgttgatgacctaccttaaccagcacgtaccagactggcgtgaatctatcgatcccatcgaagcggtgcgtccggcctggttaacgccgacggtcaataatattgctgccgatctgatggtacgcattaacaacgcaggcgcggcaaacgccatgaacctgtgctgtactgcgcttctggcgtcacgtcagcgctcactcacccgcgagcagttaaccgagcaactcaactgctacctggatctgatgcgcaacgtgccttactccacggactctaccgttccttcagccagcgccagcgagcttatcgatcacgcgctgcaaatgaacaagtttgaagttgagaaagacactatcggcgacatcatcattctgccgcgcgagcaagcggtgctgatgacctactatcgcaacaacattgcacatatgttggtgctgccttcgctgatggcggcaattgtcacccagcatcgccacatctcccgcgacgtattgatggagcacgtcaatgtgctttacccaatgctgaaagcggagctgttcctgcgctgggatcgcgacgagttaccggacgttattgatgcgctggcaaatgagatgcaacgtcaggggctgattaccctgcaagatgatgagttgcatatcaacccggcgcattctcgcacgctacagctgctggccgcaggcgcgcgcgaaacgctgcaacgttatgccatcaccttctggctgttgagtgccaacccgtcgatcaaccgcggtacgctggaaaaagagagccgcaccgtcgcgcaacgtctctccgtgctgcacggtatcaacgcgccggagttcttcgacaaggcggtgttcagttctctggtgctgacactgcgtgatgaagggtatatcagcgatagcggcgacgccgaaccggcagaaacgatgaaggtgtatcagttgctggcggagttgattacatcagacgtgcgtttgacgattgagagtgcgacgcagggcgaagggtaa

SEQ ID NO: 9304 - protein, 827 aa, Escherichia coli
MTFCYPCRAFALLTRGFTSFMSGWPRIYYKLLNLPLSILVKSKSIPADPAPELGLDTSRPIMYVLPYNSKADLLTLRAQCLAHDLPDPLEPLEIDGTLLPRYVFIHGGPRVFTYYTPKEESIKLFHDYLDLHRSNPNLDVQMVPVSVMFGRAPGREKGEVNPPLRMLNGVQKFFAVLWLGRDSFVRFSPSVSLRRMADEHGTDKTIAQKLARVARMHFARQRLAAVGPRLPARQDLFNKLLASRAIAKAVEDEARSKKISHEKAQQNAIALMEEIAANFSYEMIRLTDRILGFTWNRLYQGINVHNAERVRQLAHDGHELVYVPCHRSHMDYLLLSYVLYHQGLVPPHIAAGINLNFWPAGPIFRRLGAFFIRRTFKGNKLYSTVFREYLGELFSRGYSVEYFVEGGRSRTGRLLDPKTGTLSMTIQAMLRGGTRPITLIPIYIGYEHVMEVGTYAKELRGATKEKESLPQMLRGLSKLRNLGQGYVNFGEPMPLMTYLNQHVPDWRESIDPIEAVRPAWLTPTVNNIAADLMVRINNAGAANAMNLCCTALLASRQRSLTREQLTEQLNCYLDLMRNVPYSTDSTVPSASASELIDHALQMNKFEVEKDTIGDIIILPREQAVLMTYYRNNIAHMLVLPSLMAAIVTQHRHISRDVLMEHVNVLYPMLKAELFLRWDRDELPDVIDALANEMQRQGLITLQDDELHINPAHSRTLQLLAAGARETLQRYAITFWLLSANPSINRGTLEKESRTVAQRLSVLHGINAPEFFDKAVFSSLVLTLRDEGYISDSGDAEPAETMKVYQLLAELITSDVRLTIESATQGEG

SEQ ID NO: 9305 - DNA, 369 bp, Escherichia coli
atggccaataataccactggattcatccgaattattaaagctgctggctattcctggaaaggtttacgcgctgcatggatcaacgaagcggcattccgtcaggaaggcgtagcggtattgttagcggtggttatcgcctgctggctggatgtggacgcgattacccgcgtgctgcttatcagctccgtgatgctggtgatgattgtggaaattctcaatagcgccatcgaagctgtggttgaccgaattggctctgaataccatgagctttccggacgcgctaaagatatgggatccgccgcagtgctgattgccattatcgtcgccgtgattacctggtgcatcctgttatggtcgcattttggataa

SEQ ID NO: 9306 - protein, 122 aa, Escherichia coli
MANNTTGFIRIIKAAGYSWKGLRAAWINEAAFRQEGVAVLLAVVIACWLDVDAITRVLLISSVMLVMIVEILNSAIEAVVDRIGSEYHELSGRAKDMGSAAVLIAIIVAVITWCILLWSHFG

SEQ ID NO: 9307 - DNA, 609 bp, Escherichia coli
atgaaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtttattgcaggaagaggaagaagggttgccgctggtaggtcgtgtggctgccggtgaaccgcttctggcgcaacagcatattgaaggtcattatcaggtcgatccttccttgttcaagccgaatgctgatttcctgctgcgtgtcagcgggatgtcgatgaaagatatcggcattatggatggcgatttgctggcagtgcataaaactcaggatgtacgtaacggtcaggtcgttgtcgcacgtattgatgacgaagttaccgttaaacgcctgaaaaaacagggcaataaagtcgaactgttgccagaaaacagcgagtttaaaccaattgtcgttgaccttcgtcagcagagcttcaccattgaggggctggcggttggggttattcgcaacggcgactggctgtaa

SEQ ID NO: 9308 - protein, 202 aa, Escherichia coli
MKALTARQQEVFDLIRDHISQTGMPPTRAEIAQRLGFRSPNAAEEHLKALARKGVIEIVSGASRGIRLLQEEEEGLPLVGRVAAGEPLLAQQHIEGHYQVDPSLFKPNADFLLRVSGMSMKDIGIMDGDLLAVHKTQDVRNGQVVVARIDDEVTVKRLKKQGNKVELLPENSEFKPIVVDLRQQSFTIEGLAVGVIRNGDWL

SEQ ID NO: 9309 - DNA, 1380 bp, Escherichia coli
atgccgcctggcgtcgcggtttgtttttcatctctcttcatcaggcttgtctgcatggcattcctcacttcatctgataaagcactctggcatctcgccttacccatgattttctccaatatcaccgttccgttgctgggactggtcgatacggcggtaattggtcatcttgatagtccggtttatttaggcggcgtggcggttggtgcaacggcgaccagctttctctttatgttgttgctgtttttacgcatgagcaccaccgggctgactgcacaggcttatggtgccaaaaatcctcaggcattagcccgtgcgctggtgcaaccgttgctgttggcgttgggggccggggcgttaattgcgctgctgcgtacgccgattatcgatctggcgctgcatattgttggtggtagtgaagcagtcctggaacaggcgcgacgctttcttgaaatccgctggttaagcgcaccggcgtcgctggcgaatctggtattacttggctggttactcggcgtgcaatatgcccgtgcgccagtaattttgttagtggtcggcaatatcctcaacattgtgctggatgtctggctggtgatggggctgcatatgaacgtgcagggcgcggctctggcgacggttattgcggaatatgcaacattgctgattggtctgctaatggtgcgtaaaattctcaaactacgcggaatctccggcgaaatgctgaaaacagcctggcgaggaaacttccgtcacttgctggcgcttaaccgcgatatcatgctgcgctcgctgttgctgcaactctgtttcggcgcgatcactgtacttggcgcgcgactggggagtgacattatcgctgttaacgcagttctgatgacgctactcacctttaccgcctatgcgctggatggttttgcctacgcggttgaagcacattccggtcaggcatacggtgcgcgcgacggtagtcaattgctggatgtctggcgggcagcgtgccgccagtcggggatcgtagcgttactgttttcggtggtttatttgctggcaggggaacacatcattgcgttgctgacgtcgttaacccagattcagcagctggctgaccgctatcttatctggcaggtgattttgccgttggtcggcgtctggtgttatctgctggacggcatgtttataggcgcaacgcgtgccgccgaaatgcgtaacagtatggcggtggccgccgcaggttttgcactgacgctccttacgctgccgtggctggggaatcatggtttgtggctggcgttaaccgtctttctggcgttacgcgggctttctctggcggctatctggcggcgtcactggcgtaacgatacctggtttgtcgcaacgtga

SEQ ID NO: 9310 - protein, 459 aa, Escherichia coli
MPPGVAVCFSSLFIRLVCMAFLTSSDKALWHLALPMIFSNITVPLLGLVDTAVIGHLDSPVYLGGVAVGATATSFLFMLLLFLRMSTTGLTAQAYGAKNPQALARALVQPLLLALGAGALIALLRTPIIDLALHIVGGSEAVLEQARRFLEIRWLSAPASLANLVLLGWLLGVQYARAPVILLVVGNILNIVLDVWLVMGLHMNVQGAALATVIAEYATLLIGLLMVRKILKLRGISGEMLKTAWRGNFRHLLALNRDIMLRSLLLQLCFGAITVLGARLGSDIIAVNAVLMTLLTFTAYALDGFAYAVEAHSGQAYGARDGSQLLDVWRAACRQSGIVALLFSVVYLLAGEHIIALLTSLTQIQQLADRYLIWQVILPLVGVWCYLLDGMFIGATRAAEMRNSMAVAAAGFALTLLTLPWLGNHGLWLALTVFLALRGLSLAAIWRRHWRNDTWFVAT

SEQ ID NO: 9311 - DNA, 210 bp, Escherichia coli
atgaataaagatgaagccggcggtaactggaaacagtttaaaggtaaagtgaaagagcaatggggcaaactgaccgatgatgatatgacgatcattgaaggaaaacgtgatcagttagtgggtaaaatccaggaacgctacggttatcagaaagatcaggcagaaaaagaggttgatagttgggaaaaacgccatgattaccgctggtaa

SEQ ID NO: 9312 - protein, 69 aa, Escherichia coli
MNKDEAGGNWKQFKGKVKEQWGKLTDDDMTIIEGKRDQLVGKIQERYGYQKDQAEKEVDSWEKRHDYRW

SEQ ID NO: 9313 - DNA, 687 bp, Escherichia coli
gtgattctgctggcatggcgactttttaagcatctggtaaattgggggcgctactatagcataacgaatatgcgatcaggcaatatgacagccatgacaccctgttctcggcgtttaagcgagaactatggtaaagtaagggcattcttaaccccactgtcgaggtgcccaatggaaaagaccacaacgcaggagttattagcgcaggctgaaaaaatctgcgcacagcgtaatgtgcgcctgaccccacagcgtctcgaagtgttgcgcctgatgagtctgcaggatggcgctatcagcgcttatgatctgcttgatttgctgcgcgaagctgaaccgcaagccaagccgccaacggtttatcgcgcgctggagtttctgcttgaacaaggttttgtgcataaggtggaatccaccaacagttatgtgctctgtcatctgttcgatcagcccacccatacttcagccatgtttatttgcgatcgctgcggcgcggtgaaagaagaatgtgctgaaggcgtggaagacatcatgcatacgctggcggcaaaaatgggttttgccctgcggcataatgttattgaagcacatggattatgttcagcatgtgtagaagtagaagcgtgtcgtcatcccgaacagtgccatcatgaccactctattcaggtgaaaaagaaacctcgctaa

SEQ ID NO: 9314 - protein, 228 aa, Escherichia coli
MILLAWRLFKHLVNWGRYYSITNMRSGNMTAMTPCSRRLSENYGKVRAFLTPLSRCPMEKTTTQELLAQAEKICAQRNVRLTPQRLEVLRLMSLQDGAISAYDLLDLLREAEPQAKPPTVYRALEFLLEQGFVHKVESTNSYVLCHLFDQPTHTSAMFICDRCGAVKEECAEGVEDIMHTLAAKMGFALRHNVIEAHGLCSACVEVEACRHPEQCHHDHSIQVKKKPR

SEQ ID NO: 9315 - DNA, 996 bp, Escherichia coli
atgccagcagaatcacacactgtttatcccgcttaccgtttctcgattgccccgatgcttgactggacggacagacattgccgttatttcttgcgtctgctttcccgcaatacgttgctgtataccgaaatggtgaccacaggggcgattattcacggtaaaggtgattacctggcgtacagtgaagaagaacatccggtagcgttgcaactcgggggtagcgatccggcggcgctggcacagtgtgcgaagctggcagaagcgcgtggatacgatgagatcaacctgaatgtcggctgcccgtctgaccgggtgcagaacggcatgtttggtgcgtgtctgatgggtaatgcgcagctggttgccgactgcgtgaaagcgatgcgcgatgtggtgtcgattccggtgacggtgaaaacgcgtattggcatcgatgatcaggacagctatgaatttctctgcgatttcatcaacaccgtttccggcaaaggtgagtgtgagatgttcatcatccacgcacgtaaagcctggctttctgggttaagtccgaaagaaaaccgtgagatcccgcctctcgattatccgcgtgtgtatcaactgaagcgtgactttccgcatctgacgatgtcgattaacggtggtatcaagtcgctggaagaagctaaagcgcatttgcaacatatggatggcgtgatggtcgggcgcgaggcgtatcagaatccggggattctggcggcggtagaccgagagatttttggttcctcggataccgatgccgatccggtggcggtagtgcgcgccatgtatccgtacattgagcgtgaactcagccagggtacgtatctcggccatattacccggcatatgctgggcttgttccagggtattcctggcgcgcggcagtggcggcgttatttaagtgaaaatgcccataaagcgggtgcagacattaatgtgctggaacacgcgctcaaactggtggcggataagcgttaa

SEQ ID NO: 9316 - protein, 331 aa, Escherichia coli
MPAESHTVYPAYRFSIAPMLDWTDRHCRYFLRLLSRNTLLYTEMVTTGAIIHGKGDYLAYSEEEHPVALQLGGSDPAALAQCAKLAEARGYDEINLNVGCPSDRVQNGMFGACLMGNAQLVADCVKAMRDVVSIPVTVKTRIGIDDQDSYEFLCDFINTVSGKGECEMFIIHARKAWLSGLSPKENREIPPLDYPRVYQLKRDFPHLTMSINGGIKSLEEAKAHLQHMDGVMVGREAYQNPGILAAVDREIFGSSDTDADPVAVVRAMYPYIERELSQGTYLGHITRHMLGLFQGIPGARQWRRYLSENAHKAGADINVLEHALKLVADKR

SEQ ID NO: 9317 - DNA, 420 bp, Escherichia coli
atgtgctggaacacgcgctcaaactggtggcggataagcgttaacttttcaccaaaaagtagtcaaattcaccacgccctgcgccccgtcgcggggcgttttgctgttaaatcaatagattatttttggcatgattcttgtaatgccagcaagagatttcatatttgggagagcatcatgctggaactactttttgtaattggcttttttgtcatgctgatggtcaccggtgtttcgttgctgggtattatcgccgcgctgattgtggcgacggcctttatgttcctcggcggtatgctggcattgatgattaagttgctgccgtggctgctgttggcggttgcggtggtgtgggtgatcagggcgataaaagcaccaaaagtgccgaaatatcagcgttatgaccgctggcgttactaa

SEQ ID NO: 9318 - protein, 139 aa, Escherichia coli
MCWNTRSNWWRISVNFSPKSSQIHHALRPVAGRFAVKSIDYFWHDSCNASKRFHIWESIMLELLFVIGFFVMLMVTGVSLLGIIAALIVATAFMFLGGMLALMIKLLPWLLLAVAVVWVIRAIKAPKVPKYQRYDRWRY

SEQ ID NO: 9319 - DNA, 984 bp, Escherichia coli
atggcaatacgaattgaatttcacaagcacggtggcccggaagtacttcaagccgtagagttcactcctgccgatccggcggagaatgaaatccaggtcgaaaataaagccatcggcatcaattttatcgacacgtatatccgcagcggcctttacccgccgccatcgctacccagcggattaggtaccgaagcggcaggcatcgtgagtaaagtcggcagtggtgtaaagcatattaaggcaggcgatcgcgtagtctatgcacaatcggcattaggcgcttacagctctgtgcataacattaatgcagataaagcggcgattctgcctgcggcaatttcttttgagcaagctgcggcatccttcctgaaaggcttaacggtttattatctgctgcgcaaaacctatgaaattaaacccgatgaacagttcctgttccacgcagcggctggcggcgttggcttgattgcctgccagtgggcaaaagccctgggcgcgaaacttatcggcactgtaggaaccgcgcaaaaagcgcagagtgcgctaaaagcgggcgcgtggcaggttattaactatcgtgaagagaatctggtcgagcgattgaaagagatcaccggtggtaagaaagtgcgcgtggtgtacgattcagtgggcagagacacctgggaacggtcgctggattgcctgcaacgccgcggcttaatggtgagttttggcaactcatcaggtgcggttaccggtgtgaacttaggcattctcaatcagaaaggctcgttgtatgtgacacgcccttccctgcaaggctatatcaccacgcgggaggaattaaccgaggccagtaatgaactgttctctttgattgccagcggtgtgattaaggtcgatgtcgccgagcagcagaaatatccgctgaaggatgcgcggcgtgcgcatgagattctggaaagccgggcgacgcagggttccagcctattgattccataa

SEQ ID NO: 9320 - protein, 327 aa, Escherichia coli
MAIRIEFHKHGGPEVLQAVEFTPADPAENEIQVENKAIGINFIDTYIRSGLYPPPSLPSGLGTEAAGIVSKVGSGVKHIKAGDRVVYAQSALGAYSSVHNINADKAAILPAAISFEQAAASFLKGLTVYYLLRKTYEIKPDEQFLFHAAAGGVGLIACQWAKALGAKLIGTVGTAQKAQSALKAGAWQVINYREENLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDARRAHEILESRATQGSSLLIP

SEQ ID NO: 9321 - DNA, 2166 bp, Escherichia coli
ttggtacgattattgcgactttctttgctccagaaacacgcgatcgtgatcttgatgatcttgccgacgctgaaacgatcagcgtttcccaacataaccagactacgggcacctcccatgacgcataatgtctctgaatctattatcgattccctgactgacgtgaaaatgccccattacgcaccgctggctcaagtcagcggtagtatcgaccttaacggtaccattttacctgagtaccgctgcaacacgctggttctgggcagtggcgcggcaggatggcgagctgccgtcgagctgaaacggcaaaatgtcgatgtaatggtcgcctccagcaaagccttctggggaacttccgcctgttctggttctgataaacaaacgcttcacaccgcgaatacccgtgcaaatggtgaccattttctgacattaagtaacaccctggcggcaggtggtgcgatggatcatgacaccgcatatgttgaggcggtcggatcggtgaacacctgtgaagtactgaaatatctgggtctggatctgcctgaagatctctttggcgcaacgttgcgttaccaaaccgatcacgatgaatttggccgtgccactagctgcggtcctcgaacatcgcgcctgatggtgaaggtgctggcccaggaggcaatgcgccttaatattcctctttgcgatcacacaacggcgattcgtatcctgaccagtggtgaaggagaaaatcgacgagtcgagggggtgatcgccatcgataaagcctgtcgggataatccctggagaatggtagtgattcgctgtcagcatctggttttagccacgggcgggcctggtgaactttatcgtgacagtgtttatccggtgaactgttttagtgcgttgggcatggcgctggaagcagggataactctggttaatcttacggaaagtcagtttggtatcggtacaccgcgcaaccagtttccgtggaatctttccggtacttacatgcaggcgataccgcgcatctattcgcaggaccactccgggcgtcagtataattttctggcaacttattaccccacgactcgtatgctggcctccgcgatatttcgcaaaggttaccagtggccgtttcacgcggaacgaatgctggaatatggctccagcttgctggatgtcgcagtttatgaagagactcaaaaagggcgcgatgtttttctcgattttctacgggaaccagaacccgcagcggacggaacactatttaacctgcgggagctggatgatgatgtcatcgactatctgcaacaaaatcacgccctgctggcacaaccgctggcgagattaacacagatgaatcctctggctattcgtttgtatcagatgcacggtcatgatctcacagcctcaccgctcaagtttacgctaaataatcaacatcttaatggcggaattgaagttgatatttgggcacgtacatcgctaactggttgttatgctgccggagaaaatgccggaacacatggtgtcacgcgcccaggtggagcagcgctcaatgccgggcaagttttcgcccgccgctgtgcattacatattgctcatcagaaaagccaggaccggcctctcgagaggcaacaaattctcagtacgattaatgaggcgcaacagcacctgaatcaggggctgctacgtgacgacgtgcgagaaacgatacaaaataccatgagccaccatgccgcaattttgtgtcatacacaggggatcaacactgccgcgcaaaccctggcaacactttgtgaagatattcgccgggaaggtattcaatgcgatgaaaacagcctggcacaatctttccagtggcgacaaagtgcgcaactggcgctggctgtactgcgttctttacaatgttatgtcgaaaacggtggtgggagtcgtggtgccagggctatctatgatggcgaagccggtattgcaccgcaaacaccaggtgggccactcctggcctggcgttttcggccagaaaatcaggatgccaggcaatatatgatttgtgtttgtcgggaagctaatgattaccaaaccaggactcgcccgtgccgtgaacggggcgtattaacgctaaccaactttgagcgccagtggcaaaactggattgcggcgacgccgtttcaatactga

SEQ ID NO: 9322 - protein, 721 aa, Escherichia coli
MVRLLRLSLLQKHAIVILMILPTLKRSAFPNITRLRAPPMTHNVSESIIDSLTDVKMPHYAPLAQVSGSIDLNGTILPEYRCNTLVLGSGAAGWRAAVELKRQNVDVMVASSKAFWGTSACSGSDKQTLHTANTRANGDHFLTLSNTLAAGGAMDHDTAYVEAVGSVNTCEVLKYLGLDLPEDLFGATLRYQTDHDEFGRATSCGPRTSRLMVKVLAQEAMRLNIPLCDHTTAIRILTSGEGENRRVEGVIAIDKACRDNPWRMVVIRCQHLVLATGGPGELYRDSVYPVNCFSALGMALEAGITLVNLTESQFGIGTPRNQFPWNLSGTYMQAIPRIYSQDHSGRQYNFLATYYPTTRMLASAIFRKGYQWPFHAERMLEYGSSLLDVAVYEETQKGRDVFLDFLREPEPAADGTLFNLRELDDDVIDYLQQNHALLAQPLARLTQMNPLAIRLYQMHGHDLTASPLKFTLNNQHLNGGIEVDIWARTSLTGCYAAGENAGTHGVTRPGGAALNAGQVFARRCALHIAHQKSQDRPLERQQILSTINEAQQHLNQGLLRDDVRETIQNTMSHHAAILCHTQGINTAAQTLATLCEDIRREGIQCDENSLAQSFQWRQSAQLALAVLRSLQCYVENGGGSRGARAIYDGEAGIAPQTPGGPLLAWRFRPENQDARQYMICVCREANDYQTRTRPCRERGVLTLTNFERQWQNWIAATPFQY

SEQ ID NO: 9323 - DNA, 1401 bp, Escherichia coli
atgcaaccttcacaaccagcagagaaagcgaatgtttcatcggcagatctgcgtcgcgcggcgtggacctgctctctcggcagcgcactggaatactacgatttcgcactttacagcctggcatccgccattatttttggtccactcttttttcctaatcaggaaccgggaatggcgctgatcgccagttttggcacctactttctcggatttgccgtcagacctgtaggcggaattatcttcggctcattaggtgatcgtttgggccgtaagttcgtcctgttagcaacggtgttgttaatgggaatcgccagcacgttgatcggggtattacccacttacgaaacagcgggaatctgggcgccaattatgcttattgcattacgcctgctgcaagggcttggtgctggggctgaacaggcgggagccgccgtactgatgaccgaatatgctcctgacggcaaacggggttattacgccgcgctgccgttcctcggaatccagattggtacgtttatggcatctgccgtttacttcatcctgctgcataatgtgacaaatcttgccgaaacctggtggtggcgcttgcccttcctctccagcgtggtgattatcgcggtggctatttatattcgactgcatcttaaagaatcgccatcattcgcaaaactcgaagctcgtcaacaagttacagaatcacccttacgaaatttgctgaaaacatcacgccgtaatgtcttcgtcgggattggcttacgtctggcagaaaacggcggctcgtcgatttatcaggctttagcgatcagttatatcgttggtgtggttgggctggacaaatcagttggtacgctatgcctgatgtctgcggtagtagtcggtgcaattatggtgcctattgccggttggctgaccgatcgcttcggcagggttcttgtctatcgtagtctggcgatttttcagttgttgattacctttccggtgtggtggtctttcagccacggtaatgttcctgtcactattgtctctctttctctggccttagggattggagcctggggtatgtttggtgcacaaggtgcttttctgcctgaactctttggtgctcgccatcgttatattggcgtcgcactggcaagggaagtttctgccgttattgccggagggatcgcgccactggttggttctgcaatcatttcctgggtgatccacactaacgatcccagtggtattgctgcctggatgccaatcgctatttaccttagtctgctgaccgttggtacgattattgcgactttctttgctccagaaacacgcgatcgtgatcttgatgatcttgccgacgctgaaacgatcagcgtttcccaacataaccagactacgggcacctcccatgacgcataa

SEQ ID NO: 9324 - protein, 466 aa, Escherichia coli
MQPSQPAEKANVSSADLRRAAWTCSLGSALEYYDFALYSLASAIIFGPLFFPNQEPGMALIASFGTYFLGFAVRPVGGIIFGSLGDRLGRKFVLLATVLLMGIASTLIGVLPTYETAGIWAPIMLIALRLLQGLGAGAEQAGAAVLMTEYAPDGKRGYYAALPFLGIQIGTFMASAVYFILLHNVTNLAETWWWRLPFLSSVVIIAVAIYIRLHLKESPSFAKLEARQQVTESPLRNLLKTSRRNVFVGIGLRLAENGGSSIYQALAISYIVGVVGLDKSVGTLCLMSAVVVGAIMVPIAGWLTDRFGRVLVYRSLAIFQLLITFPVWWSFSHGNVPVTIVSLSLALGIGAWGMFGAQGAFLPELFGARHRYIGVALAREVSAVIAGGIAPLVGSAIISWVIHTNDPSGIAAWMPIAIYLSLLTVGTIIATFFAPETRDRDLDDLADAETISVSQHNQTTGTSHDA

SEQ ID NO: 9325 - DNA, 780 bp, Escherichia coli
atgaataacggcaccattgacctccagcgcaacggtttcattgccactttggtgattaatcgcccggcaaaactcaacgcattaaccccagagatgctcgaacaactgctggcgcattgccacacgttggaaactgattcggagatccgcgtagtactgctgaccagtgccagtgaaaaagcgttttgtgtcggcgcggatattcatcgctggacctctctttctgcactcgatatgtggcgcaactggatccgccgcggtcatcaggcatttgatgctctggcacaactgccacagcccgtaatcgccctgttgcacggcctggcttatggcggtggtctggaactggctgctaccaccgatatccgtatttgtagcgccgaagcacaaatggcactaccagaaaccgggctggcgacagtgcctggctggtcaggaacgcagcggctgacggcactgcttgggcgctcactggtgaaagaactggtatttaccggtgaaccactggatgcacagcgggcactgtcctgcgggctggtgaatcgcgttgtcgccagggaggcgttacacgacgccggactgcaactggcacaacgtatcgcccagcgtgctcccgttgcagtgcagatcgccaagcaggttattgatgccggagaaggtattgctgtggcctcgacgcttgaagcactggctggcgctttttccgccacgactgaagatgctcatgaaggcagtcaggcatttactgagaagcgtcaaccgcactttagtgctcgataa

SEQ ID NO: 9326 - protein, 259 aa, Escherichia coli
MNNGTIDLQRNGFIATLVINRPAKLNALTPEMLEQLLAHCHTLETDSEIRVVLLTSASEKAFCVGADIHRWTSLSALDMWRNWIRRGHQAFDALAQLPQPVIALLHGLAYGGGLELAATTDIRICSAEAQMALPETGLATVPGWSGTQRLTALLGRSLVKELVFTGEPLDAQRALSCGLVNRVVAREALHDAGLQLAQRIAQRAPVAVQIAKQVIDAGEGIAVASTLEALAGAFSATTEDAHEGSQAFTEKRQPHFSAR

SEQ ID NO: 9327 - DNA, 1572 bp, Escherichia coli
atgtgctctgtacgcacgatcactgcaccggaagctgcagatttgattgttgatggcgcagttgtcaccgtctcctcctccagtggaatggggtgtccggatgcggtgctggcagcaataggtgaacgctttcaacgtgccggacatccgcaaaacatcacctccatccaccctatcgccgctggtgatatgtatggcgtaaaaggcatcgatcatctggcgcaaccgggcttactggcaaaagtgatcgctggctcctacccctccggtccatcatcaatggcgcctccgttaatctggcaaatgatcaatgacaacgcgatccccgcctggaatctgccttccgggatcttatttgatatgcaccgggaagcggcggctcatcgtcctggcgtgctgacacaaacaggcatggatacctatgtggatcccctgttgcagggcggtgcaatgaatgaaaaagcggcgcaacaatctctggttgaacgtgttcgatttgctaacgacgactggctgtttttccccagtatcgtgccgcaggtggcgatcattcgcgctaccactgccgatgaacgcggcaacctgacttatgaacatgaaggggcttatctggggccactggaacaggctactgccgttcgcaataatggtggcatcataattgcgcaagtaaaacgacaggttgccgccggaagtctgaaaccaaaagaggtgcgtattccgggtgtactggtggattacatcgtgattgcgccggaacaaacacaaacgacacaaacgcaatatgaacctgccatttccggcgaaatcagtcgtccgctatcagcctttcgttatatggaacatggcccggcgcgagttattgcccagcgagtcgcgcaagaactacaaagtggagatgcggtaaatattggctttggtatttctgccaacgtaccacgcattttactggaacaaggtcgccacggtgacgtcacctggctgctggaacagggcgcgattggcggagttccactgctggaatttcagttcggttgtgcctctaatgcagaagcatttttgccctctccccagcagttcacctatttccagggcggtggctttgatctcactctgatgtcgtttttacaaatcggcgcagatggctcagtgaacgtctcacatctccccgctcgtccacatgtcactgccggatgcggtggatttattgatatcacctcacatgcgaagcgcattattttctctggctttttcaatgccggtgcccaactgcaactggaagagggtcagctgcgtatcattaaagaaggcaaagccaaaaaactggtacaggacgtcgcccacgtgacgttctccggcaaacgcgcaataagactcgggcaacaagtgcagtacatcactgaacgctgcgtgctggaattaaccccagacggactactggtcacggaaattgccccaggtattgatcctgaacgcgacattctcgcccaaagcaatgccccactccgtctggcagacgatctcaaactaatgaatccccactattttcaacaaggacgtcaccatgaataa

SEQ ID NO: 9328 - protein, 523 aa, Escherichia coli
MCSVRTITAPEAADLIVDGAVVTVSSSSGMGCPDAVLAAIGERFQRAGHPQNITSIHPIAAGDMYGVKGIDHLAQPGLLAKVIAGSYPSGPSSMAPPLIWQMINDNAIPAWNLPSGILFDMHREAAAHRPGVLTQTGMDTYVDPLLQGGAMNEKAAQQSLVERVRFANDDWLFFPSIVPQVAIIRATTADERGNLTYEHEGAYLGPLEQATAVRNNGGIIIAQVKRQVAAGSLKPKEVRIPGVLVDYIVIAPEQTQTTQTQYEPAISGEISRPLSAFRYMEHGPARVIAQRVAQELQSGDAVNIGFGISANVPRILLEQGRHGDVTWLLEQGAIGGVPLLEFQFGCASNAEAFLPSPQQFTYFQGGGFDLTLMSFLQIGADGSVNVSHLPARPHVTAGCGGFIDITSHAKRIIFSGFFNAGAQLQLEEGQLRIIKEGKAKKLVQDVAHVTFSGKRAIRLGQQVQYITERCVLELTPDGLLVTEIAPGIDPERDILAQSNAPLRLADDLKLMNPHYFQQGRHHE

SEQ ID NO: 9329 - DNA, 1035 bp, Escherichia coli
atggcgaagtcggatacaggaagaaagcgggtaacattaaccgatgttgcgcgtgcggctggcgtttcgaaatcgaccgtatcgctggttctcaacgacagttcacttatcaaaaaagagactcaacaaaaagtccagcaagccattgaacaattaggctatgtctataaccgttttgctgccaatctgcgttcgcaaaaatcgctaactatcggcgtagtcattgacgatttgataaatcctttcttcgctgaatttactatgggtcttgagatgacgctggcggagcacggttttatcaccgtgatgtccaatacctcccagcgtagtgaccggcaaaaacaggtgcttgataccttgctggaacaccacgtcgcgggcattgtcctctgtccagtgaacagtacctcagaagccgatttacagcgttatgccaacagttccacacccttattaatcacgatgcgccctctggattggcaacaattgcccgtcgattacgttggcgtggacagccacgcaggtgtacgggaagcgacggaatatctcattcaacaagggcacagagatatcgtgtttattggtggtcttacgcaccatatgcgttatcagggataccttgaggcgatgaatcaccatggtttacagccgtggagtactgatgctttttcgctgcgtgctgaaccgactcaggccaacggctaccagttgatgcaacagctgttggatatgccttcgccacccacagcggtgatttgttataacgatttaatggcttttggcgcggagtcggcactaggcgaaagaggattatttgccggggaagatatttcgttgattggtaatgatggcgtggcggcttgtgcttacagtaacccgccgttaaccacaattgcggtagaaccattggctctggggaaacaggcggcgcagcaaattttacggcgtattgcgcaaccagacgcaccgctcagccattacatctatcgcccgaccctgcaaattcgcgcttccaccggaaagcgggggcgttaa

SEQ ID NO: 9330 - protein, 344 aa, Escherichia coli
MAKSDTGRKRVTLTDVARAAGVSKSTVSLVLNDSSLIKKETQQKVQQAIEQLGYVYNRFAANLRSQKSLTIGVVIDDLINPFFAEFTMGLEMTLAEHGFITVMSNTSQRSDRQKQVLDTLLEHHVAGIVLCPVNSTSEADLQRYANSSTPLLITMRPLDWQQLPVDYVGVDSHAGVREATEYLIQQGHRDIVFIGGLTHHMRYQGYLEAMNHHGLQPWSTDAFSLRAEPTQANGYQLMQQLLDMPSPPTAVICYNDLMAFGAESALGERGLFAGEDISLIGNDGVAACAYSNPPLTTIAVEPLALGKQAAQQILRRIAQPDAPLSHYIYRPTLQIRASTGKRGR

SEQ ID NO: 9331 - DNA, 1452 bp, Escherichia coli
ttgtcccccattcaacagcaggtaacaccattcgttatggcaggcaatagacctttcaacaaacaacagactgataaccgcgaacgcgatccacaagttgccgggctgaaagtgcctccgcactcgatcgaagcggagcagtcggtgttgggcggtttaatgctggataacgaacgctgggatgatgtagctgagcgtgtggtggcagatgatttttacacccgcccacaccgtcatatctttactgaaatggcgcgtttgcaggaaagcggtagtcctatcgatctgattacccttgcggaatcgctggaacgccaggggcaactcgatagcgtcggtggttttgcttatctggcagagctgtcaaaaaatacgccaagtgcggcgaacatcagtgcatatgcggatatcgtgcgcgaacgtgccgttgttcgtgagatgatctccgttgctaacgagattgccgaagctggttttgatccacaagggcgtaccagtgaagatctgctcgaccttgctgaatcccgcgtctttaaaattgccgaaagtcgtgcaaacaaagacgaagggccgaagaacatcgccgatgtgctcgacgcaaccgtggcgcgtattgagcagttgtttcagcagccacacgatggcgttaccggggtaaataccggttatgacgatctcaacaaaaaaaccgctggcttgcagccgtcggatttgatcatcgttgccgcgcgtccgtcgatgggtaaaacgacatttgcgatgaacctcgtcgaaaacgcggcgatgttgcaggataaaccggtgcttatcttttcgctggagatgccatcagaacagattatgatgcgttctctggcgtcgctgtcgcgcgttgaccagactaaaatccgtaccgggcagctcgatgatgaagactgggcacgcatttccggcaccatgggtattttgctcgaaaaacgcaatatctatatcgatgattcctccggcttgacgccaacggaagtgcgttcccgcgcacgccgtattgcccgtgaacacggcggcatcgggcttatcatgatcgactacctgcaactgatgcgcgtaccggcgctttccgataaccgtacgctggaaattgcagaaatctcccgctcgctgaaagcactggcgaaagaactgaacgtgccggtggtggcgctgtcccagttgaaccgttctctggaacaacgtgccgacaaacgcccggtcaactccgacctgcgtgaatctggctctatcgagcaggatgcggacttgatcatgtttatctatcgtgatgaggtgtatcacgaaaacagtgatttaaaaggcatcgcggaaattattatcggtaaacaacgtaacggcccaatcgggacggtacgcctgacctttaacggtcaatggtcgcgcttcgacaactatgcggggccgcagtacgacgacgaataa

SEQ ID NO: 9332 - protein, 483 aa, Escherichia coli
MSPIQQQVTPFVMAGNRPFNKQQTDNRERDPQVAGLKVPPHSIEAEQSVLGGLMLDNERWDDVAERVVADDFYTRPHRHIFTEMARLQESGSPIDLITLAESLERQGQLDSVGGFAYLAELSKNTPSAANISAYADIVRERAVVREMISVANEIAEAGFDPQGRTSEDLLDLAESRVFKIAESRANKDEGPKNIADVLDATVARIEQLFQQPHDGVTGVNTGYDDLNKKTAGLQPSDLIIVAARPSMGKTTFAMNLVENAAMLQDKPVLIFSLEMPSEQIMMRSLASLSRVDQTKIRTGQLDDEDWARISGTMGILLEKRNIYIDDSSGLTPTEVRSRARRIAREHGGIGLIMIDYLQLMRVPALSDNRTLEIAEISRSLKALAKELNVPVVALSQLNRSLEQRADKRPVNSDLRESGSIEQDADLIMFIYRDEVYHENSDLKGIAEIIIGKQRNGPIGTVRLTFNGQWSRFDNYAGPQYDDE

SEQ ID NO: 9333 - DNA, 1080 bp, Escherichia coli
atgcaagcggcaactgttgtgattaaccgccgcgctctgcgacacaacctgcaacgtcttcgtgaactggcgcctgccagtaaaatggttgcggtggtgaaagcgaacgcttatggtcacggtcttcttgagaccgcgcgaacgctccccgatgctgacgcctttggcgtagcccgtctcgaagaagctctgcgactgcgtgcggggggaatcaccaaacctgtacttttactcgaaggcttttttgatgccagagatctaccgacgatttctgcgcaacattttcataccgccgtgcataacgaagaacagctggctgcgctggaagaggctagcccggacgagccggttaccgtctggatgaaactcgataccggtatgcaccgtctgggcgtaaggccggaacaggctgaggcgttttatcatcgtctgacccagtgcaaaaacgttcgtcagccggtgaatatcgtcagccattttgcgcgcgcggatgaaccaaaatgcggcgcaaccgagaagcaactcgctatctttaataccttttgcgaaggcaaacctggtcaacgttccattgccgcgtcgggtggcattttactctggccacagtcgcattttgactgggtgcgcccgggcatcattctttacggcgtatctccgctggaagatcgctccaccggtgccgattttggctgtcagccagtgatgtcgctaacctccagcctgattgccgtgcgtgagcataaagccggagagcctgtcggttatggtggaacctgggtaagcgaacgtgatactcgtcttggcgtagtcgcgatgggctatggcgatggttatccgcgcgccgcgccgtccggtacgccagtgctggtgaacggtcgcgaagtgccgattgtcgggcgcgtggcgatggatatgatctgcgtagacttaggtccacaggcgcaggataaagccggggacccggtcattttatggggcgaaggtttgcccgtagaacgtatcgctgaaatgacgaaagtaagtgcttacgaacttatcacgcgcctgacctcaagagtcgcgatgaaatacgtggattaa

SEQ ID NO: 9334 - protein, 359 aa, Escherichia coli
MQAATVVINRRALRHNLQRLRELAPASKMVAVVKANAYGHGLLETARTLPDADAFGVARLEEALRLRAGGITKPVLLLEGFFDARDLPTISAQHFHTAVHNEEQLAALEEASPDEPVTVWMKLDTGMHRLGVRPEQAEAFYHRLTQCKNVRQPVNIVSHFARADEPKCGATEKQLAIFNTFCEGKPGQRSIAASGGILLWPQSHFDWVRPGIILYGVSPLEDRSTGADFGCQPVMSLTSSLIAVREHKAGEPVGYGGTWVSERDTRLGVVAMGYGDGYPRAAPSGTPVLVNGREVPIVGRVAMDMICVDLGPQAQDKAGDPVILWGEGLPVERIAEMTKVSAYELITRLTSRVAMKYVD

SEQ ID NO: 9335 - DNA, 558 bp, Escherichia coli
atgtcttattcagaaatcgccgcgtgtctggcatacgcggtttccgtctggctggctgccagaaacaatgtgcatacatggtggatcggcataattggcagcatattgtacggctgggttttttggtctgtgcaactctatgccgacgttacgctccagttattcttcatcgcgaccagcatcactggctggatccactggctgaaaggtcagggtggcgacatcttgccggtgcgccgaacgcaagccagtcactttttccttttgttgctctgtgctgtcgtcgtggcaggcggttacggctttttactccacacctttaccaatgcctgggcaccctggctggattcgttgattttgacctttagcgttctggcacaattcatgttgatgggaagacgtatcgaaaactggttcgtctggttagcggtgaataccctggcagtgccactgtatatgacgcgcggtttaaacctgaccgctggcttatatttcctgttctggattaacgcctggcatggtttgtatcaatggcgcaaagagttgcaaacatcatga

SEQ ID NO: 9336 - protein, 185 aa, Escherichia coli
MSYSEIAACLAYAVSVWLAARNNVHTWWIGIIGSILYGWVFWSVQLYADVTLQLFFIATSITGWIHWLKGQGGDILPVRRTQASHFFLLLLCAVVVAGGYGFLLHTFTNAWAPWLDSLILTFSVLAQFMLMGRRIENWFVWLAVNTLAVPLYMTRGLNLTAGLYFLFWINAWHGLYQWRKELQTS

SEQ ID NO: 9337 - DNA, 1023 bp, Escherichia coli
atggcgcaaagagttgcaaacatcatgaagccttttgcaacgggcctggtggttggtaaattcgcgcctttgcattgtggtcatgaaaagttgatcaataccgcactggcgcaatgtgaagaactgttcatcatcagttattccgtgccggaaatgcctgactgtgaacctgaaaagcgcctgacgtggctgcaagtgcgcttcccgcaagcgacgattttggtactgacgccagagcttgttgcgcgttataacttacctgccataccgcataacgatgccgacatccaccgtcattatgtggcgacgctgtgcctgcagatattacgctgtcgtccacatgctgtatttactgcagaagactatggcgatggctttgctaacgtgctggcgcggcgttttgcccaacccgttgaacacgttcgaatggcgcgcccagttggcgatgaagcgccttcgggaacgcttattcgttccgatgttcaccgctatcgctacatgttggcgaatgatgtttattacagtttcgttcgccgtatctgtctgcttggtggcgaatctaccggtaaaagcacgctttcaaaagcgctggcggatgggcttgatacggtgtatgtcgctgaatttggccgcgactattgggaagaaaaaaacggaatcttaaccgcggatgatttgttgcatatcgcctgcgaacaggtacgccgggaacaacaagcagaagctaatcactatcttatatgtgacacgtcgccactcacgaccttgttctatgcccttgatcaatatggtcatgctccgcaagaacttcatcaactggcggagcgggaatactctctggtggtgctttgcggcgcagaatttcccttcgtgcaggatggcacccggcaaggagaggtatttcgcgcacggcaacaggtgtggtatgaacaggaattatcgcgcaggaatattccttatctttctgtttcgggttcgctgcaagagcgactggggcaaattctacatcgccttcccgactga

SEQ ID NO: 9338 - protein, 340 aa, Escherichia coli
MAQRVANIMKPFATGLVVGKFAPLHCGHEKLINTALAQCEELFIISYSVPEMPDCEPEKRLTWLQVRFPQATILVLTPELVARYNLPAIPHNDADIHRHYVATLCLQILRCRPHAVFTAEDYGDGFANVLARRFAQPVEHVRMARPVGDEAPSGTLIRSDVHRYRYMLANDVYYSFVRRICLLGGESTGKSTLSKALADGLDTVYVAEFGRDYWEEKNGILTADDLLHIACEQVRREQQAEANHYLICDTSPLTTLFYALDQYGHAPQELHQLAEREYSLVVLCGAEFPFVQDGTRQGEVFRARQQVWYEQELSRRNIPYLSVSGSLQERLGQILHRLPD

SEQ ID NO: 9339 - DNA, 1194 bp, Escherichia coli
gtgtttcaaaaagttgacgcctacgctggcgacccgattcttacgcttatggagcgttttaaagaagaccctcgcagcgacaaagtgaatttaagtatcggtctgtactacaacgaagacggaattattccacaactgaaagccgtagcggatgcggaagcgcgcctgaatgcgcagcctcatggtgcttcgctttatttaccgatggaagggcttaacagctatcgccatgccattgcgccgctgctgtttggtgcggaccatccggtactgcaacaacagcgcgtagcaaccattcaaacccttggcggctcaggggcattgaaagtgggtgcagatttcctgaaacgctacttcccggaatcaggcgtctgggtcagcgatcctacctgggaaaaccacgtagcaatattcgccggggctggattcgaagtaagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgaccagtgggattccgtgattgaaattctcaaagcccgcgagcttattccattcctcgatattgcctatcaaggatttggtgccggtatggaagaggatgcctacgccattcgcgccattgccagcgctggattacccgctctggtgagcaattcgttctcgaaaattttctccctttacggcgagcgcgtcggcggactttctgttctgtgtgaagatgccgaagccgcaggccgcgtactggggcaattgaaagcaaccgttcgccgcaactactccagcccgccgaattttggtgcgcaggtggtggctgcggtgctgaatgacgaggcattgaaagccagctggctggcggaagtagaagagatgcgtactcgcattctggcaatgcgtcaggaactggtgaaggtattgagcacagagatgccagagcgcaatttcgattatctgcttaatcagcgcggcatgttcagttataccggtttaagaaccgctcaggttgaccgactacgtgaagaatttggtgtctatctcatcgccagcggtcgcatgtgtgtcgccgggcttaacgcgcaaaatgtgcatcgcgtggcaaaggcgtttgctgcggtgatgtga

SEQ ID NO: 9340 - protein, 397 aa, Escherichia coli
MFQKVDAYAGDPILTLMERFKEDPRSDKVNLSIGLYYNEDGIIPQLKAVADAEARLNAQPHGASLYLPMEGLNSYRHAIAPLLFGADHPVLQQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDSVIEILKARELIPFLDIAYQGFGAGMEEDAYAIRAIASAGLPALVSNSFSKIFSLYGERVGGLSVLCEDAEAAGRVLGQLKATVRRNYSSPPNFGAQVVAAVLNDEALKASWLAEVEEMRTRILAMRQELVKVLSTEMPERNFDYLLNQRGMFSYTGLRTAQVDRLREEFGVYLIASGRMCVAGLNAQNVHRVAKAFAAVM

SEQ ID NO: 9341 - DNA, 2745 bp, Escherichia coli
atggagaacatgacctcgcccggcacgctgcttagtggagataacgcgacctggcttgaagagtactaccagacctggttgcgtacgccggaacaactcccggaagactggcggcgtttttttctttcacctgaactgactgtccaaagcgtatccggtgataacaacgtcagcggtgcgacgttaaaaaaacaggctgcggtaatacaactgatcaatgcctggcgcacgcaggggcatctgcgcgcaaagcttgatccacttggtttgaatcccccagctgacgttccctccctccagcctggtttttggggattaagcgaagaagacttgttgcaggagtttagcgtcacctttggcgcacacaccacgcaaatgccacttaagcaactgcttaacctgctggagcaagcctgggccggtagccaggcttatgaacttgctcatctggaaaatcgtgaagaaatcaactggttgttatcacggattgagagcagcaatgcgccacaagctgatgcccaaacctgcattgcccgttttgaaaaactgatggcggcagagacgttagagcgttatctgcatacccgttatgttgggcagaaacggttttctctggaagggggcgaaagtgcaatcccggcgctcgatacgctgacaaaacgcctgcgtgcgcaaggtgtggaggaaatggtcattggcatggcgcaccggggaagacttaatgttctggttaatctgttgaataaagacccggcacagctttttgctgagtttgaaggcaagcagacgatcggcagtggttcaggcgatgtgaaataccacatggggtattccagcaatctggaaacacctgccggttcgctgcatgtggcgctggcgtataacccctcacatctggagatcgtgaatccggtggtgctgggccaggtgcgagccaggcaggaacgccgtggtgaggatggtcaggcaaaagtggtgggcgtacttattcatggggattccgcgttgggcggcctcggcgtcaaccaaaccacgtttaacttatcgcagactcagggctacggcactggcggtacgctacatctggtgattaacaatcagattggcttcaccacttcccgcttgcaggatatgcgttcttcacggtactgcaccgatattgccaaaatggtagcggccccaattatccacgttaatggcgatgacgttgacgctgtttgccaggtaatggaactggcgtgcgaatggcgagacaccttccggcgcgacatcatcatcgatatttgctgcttccgtaagcacggacacaacgaaagcgatgagccacgtcttacccagccacaaatgtatcaggcagtggatgctcaccctggtacgctcgcccgttatggtgaatctcttgcccgccgcggcctgttaactcaggcgcaacaagatgagatgacggcacgctatcgcgactggctggatagctgccagaaacgtgaaccgcagcctctcaaacctgcaattcactcttttagcgctaactggtatgggttgaccaaccctcactggagcgccccggtatctacggcattgcctcggcaaaagctggcagcgtatggtgaaatcatttctacactgccacccgatgtggtcgcacatcctaccattaaacggcaactggcgttacgccaggatatggccgcaggtactcagccaatagactggggaatggctgaaatgctggcctatgcatcgcttgtggatgcgggtgttggtgtgcgtctttctggtgaagactcagggcgtggcacgttcagtcatcgccatgcagtggtacatcatcaaactgaagcccgtcgttatctgccgttacagcatatccgcgctggtcaggcatctttcgatgtttatgattcggtgcttaatgaagaagcgctcttagcctttgaatatggctattcaacgtctgcgcctcagcaactggttatttgggaagcgcagtttggtgactttgccaacggcgctcaggttgctattgaccagtttatctcgtctggcgaaaccaagtgggatcgctatagcggtttaaccattcttctgccgcatggctatgacggacaagggccggagcactcttctgcgcgtcctgagcgctggctgcaactgtgcgcagaaaacaacatgcaggtggtgatgcccagtgagtcagcacaaatgttccatttgctgcgcggtcaggcattacgcccaatgcgcaaaccgttagtgataatgatgagtaagcgtttacttcggtttaaaggcgctatgagcgagctttctgaattcactgatggcgcttataaaccggtagtcaccgatccgcaattgcatcagtcccagaaagttaagcgcgttattttgtgtagcggccaggtctattacgacgtactggaagcccgtaagcagcgtgagtgtgaagatgaggtagcgattgttcgcctggagcaactctacccgttcccggtcgcagaactgaatgatgttctggcgagttggccgaactgctgcgaatggatttggttgcaggaagagccagaaaaccagggcgcgtggcggcagattcgtcatgagctggcggcactgaaaattaacactccttactggcagtatgcaggccgcccggcagtggcagctccggcgacagggtatgggcgtgtacataaacaacaaatcgacgaatttcttgctgctgcgtttgcagatattcagccatga

SEQ ID NO: 9342 - protein, 914 aa, Escherichia coli
MENMTSPGTLLSGDNATWLEEYYQTWLRTPEQLPEDWRRFFLSPELTVQSVSGDNNVSGATLKKQAAVIQLINAWRTQGHLRAKLDPLGLNPPADVPSLQPGFWGLSEEDLLQEFSVTFGAHTTQMPLKQLLNLLEQAWAGSQAYELAHLENREEINWLLSRIESSNAPQADAQTCIARFEKLMAAETLERYLHTRYVGQKRFSLEGGESAIPALDTLTKRLRAQGVEEMVIGMAHRGRLNVLVNLLNKDPAQLFAEFEGKQTIGSGSGDVKYHMGYSSNLETPAGSLHVALAYNPSHLEIVNPVVLGQVRARQERRGEDGQAKVVGVLIHGDSALGGLGVNQTTFNLSQTQGYGTGGTLHLVINNQIGFTTSRLQDMRSSRYCTDIAKMVAAPIIHVNGDDVDAVCQVMELACEWRDTFRRDIIIDICCFRKHGHNESDEPRLTQPQMYQAVDAHPGTLARYGESLARRGLLTQAQQDEMTARYRDWLDSCQKREPQPLKPAIHSFSANWYGLTNPHWSAPVSTALPRQKLAAYGEIISTLPPDVVAHPTIKRQLALRQDMAAGTQPIDWGMAEMLAYASLVDAGVGVRLSGEDSGRGTFSHRHAVVHHQTEARRYLPLQHIRAGQASFDVYDSVLNEEALLAFEYGYSTSAPQQLVIWEAQFGDFANGAQVAIDQFISSGETKWDRYSGLTILLPHGYDGQGPEHSSARPERWLQLCAENNMQVVMPSESAQMFHLLRGQALRPMRKPLVIMMSKRLLRFKGAMSELSEFTDGAYKPVVTDPQLHQSQKVKRVILCSGQVYYDVLEARKQRECEDEVAIVRLEQLYPFPVAELNDVLASWPNCCEWIWLQEEPENQGAWRQIRHELAALKINTPYWQYAGRPAVAAPATGYGRVHKQQIDEFLAAAFADIQP

SEQ ID NO: 9343 - DNA, 1155 bp, Escherichia coli
atgatcgaaattactgtccctgtattaccggaatctgtcacggaaggcacgctgacaacctggtgtaaacaagaaggcgagcacgtaaaacgcgatgatgtgattgccgagctggaaaccgataaagtcattctggaaataccggccccgcacgatggcgtgttaagcaatattatcgtcagcgaaggtagcacggtcacgtccgcgcaactgttggcgcatcttaagccgcaagctgtcatagaagaaaccgtcacaccagtcaccgaaaccctggcgatgccttccgcacggctggaggcacagcgtagtggtgtcgaacttgctgacgttgcggggagcgggagaaatggacgtatcctgaaagaggatgtacagcgcgttactcctgcaccagtcattcagcctgaacgggtggcggagatcgcgccagctaaacccttgacaccgggtgctcgtcaggaacgtcgtgagccgatgtcgcgcttacgtcagcgaattgctgagcgtctgctggcttcccaacaaaataacgccattcttaccacattcaacgaagtaaacatgcagagcgtgatggatttacgcacccgctggaaagatcgttttgccgagaagcacggcgtgaagctgggctttatgtccttctttgttaaggccgttacccgggcgctggagcgcttccctgtagtgaatgccagcgttgatggcaacgagattatctggcgtgattattgcgatatcggcattgcagtgagcagcaaccgcggcctggtagtgcctgtgttacgcaatgcgcaatcactctctttggtggaaattgaacggcaaattgccgaatacgccacacaggcacgcaatggcaaattgccgctggaggcgttacagggcggcacgttctctatcaccaacggcggtacttttggttcgatgatgtcaacgccaatcattaacccgccgcagtcggccattcttgggatgcatgccatcacgccgcgcccggtcgcagaaaacggccaggttgttattcgtcccatgatgtaccttgctctcagctatgaccatcgcattatcgatggtcaggaagccgtgcagacattggtggcaatacgtgagctactggaatcaccggaacaactgttgctggatctttaa

SEQ ID NO: 9344 - protein, 384 aa, Escherichia coli
MIEITVPVLPESVTEGTLTTWCKQEGEHVKRDDVIAELETDKVILEIPAPHDGVLSNIIVSEGSTVTSAQLLAHLKPQAVIEETVTPVTETLAMPSARLEAQRSGVELADVAGSGRNGRILKEDVQRVTPAPVIQPERVAEIAPAKPLTPGARQERREPMSRLRQRIAERLLASQQNNAILTTFNEVNMQSVMDLRTRWKDRFAEKHGVKLGFMSFFVKAVTRALERFPVVNASVDGNEIIWRDYCDIGIAVSSNRGLVVPVLRNAQSLSLVEIERQIAEYATQARNGKLPLEALQGGTFSITNGGTFGSMMSTPIINPPQSAILGMHAITPRPVAENGQVVIRPMMYLALSYDHRIIDGQEAVQTLVAIRELLESPEQLLLDL

SEQ ID NO: 9345 - DNA, 1419 bp, Escherichia coli
atgagtacaatttttgatgtggcagttatggggggtgggccaggtggttacgtagcggcactgcgggctgcgcagaatgggctttccgtagtatgtattgatgatggtgttaatgcacagggcgaaccttcgccgggcggtacgtgtctcaatgtcggctgtattccgtcaaaatcgttgctgcaatcttccgagctgtacgcgcaagtacagcatgaggcaagcattcatggcgttaacgttgaaggcgtatctttcaatgctgccgcgatgattcaacgtaaagatgccatagtaagccgcctgacaatgggcatcagcttgctgtttaagaaaaataaagtgaagcacttgtgcggcctcgcaacgttagaacgtgctcaggatgagatttggcaattacgcgtaaacgatcaacacattcacgcccgtaatgtagtgattgcaacaggttctcagccgcgtcagctgcctggcgttaccattgataatcaacagatcctcgacaatcgtggcgccctggcattgagcgaagtgccgccgcgtctcggtgtgatcggcgctggcgtgattggccttgaactggggtctgtgtggaatcgggtcggttcagatgtcacgctgctggagatggcgccaacgttcttgcctgcactggaagctcgcctgtcgaacgaagtccgtaaagcaatgattgccagtgggatgaaaatgcaactggcagtagagattgaggctattgaacaacgggatgacggtgtgcatgtgcgctggcggcagggtgagaagcgagaagaaagccgcttcgataaattaattcttgccattggacgtgtaccgcgactttctggtgtcgatctcgtgcaactcggtcttgaagccgataaccgtggcggtattgccgtcgataacttatgccgtaccgggaaagccgggctgtgggcaattggtgatgtcgtgcgagggccgatgctggcgcataaagcgatggctgaaggtgtggtggttgcggatcaaattgccggactggcggtagagccgattaattttgcgctgatcccttcggtgatttacacccaaccggaagttgcgtgggtaggggaaaacgaggcctcactgaaagccgctggcagagtctttaacaaaggaaattctctgtttgccggtaacggtcgcgccttagcattaggccaggaaggtgggcgttgcacgttatacagcgataaacacactgaccgcgtacttggcggagcgattgttggcccgcaggcatcggagctgatcaatgaaattgcgctggcgatgacttttagcgcctctggcgaggatattgcctgtgcgatccatgcgcatccgaccttaagcgaagtcatccacgaagcagcaatggccttgaataataaagcattacacggataa

SEQ ID NO: 9346 - protein, 472 aa, Escherichia coli
MSTIFDVAVMGGGPGGYVAALRAAQNGLSVVCIDDGVNAQGEPSPGGTCLNVGCIPSKSLLQSSELYAQVQHEASIHGVNVEGVSFNAAAMIQRKDAIVSRLTMGISLLFKKNKVKHLCGLATLERAQDEIWQLRVNDQHIHARNVVIATGSQPRQLPGVTIDNQQILDNRGALALSEVPPRLGVIGAGVIGLELGSVWNRVGSDVTLLEMAPTFLPALEARLSNEVRKAMIASGMKMQLAVEIEAIEQRDDGVHVRWRQGEKREESRFDKLILAIGRVPRLSGVDLVQLGLEADNRGGIAVDNLCRTGKAGLWAIGDVVRGPMLAHKAMAEGVVVADQIAGLAVEPINFALIPSVIYTQPEVAWVGENEASLKAAGRVFNKGNSLFAGNGRALALGQEGGRCTLYSDKHTDRVLGGAIVGPQASELINEIALAMTFSASGEDIACAIHAHPTLSEVIHEAAMALNNKALHG

SEQ ID NO: 9347 - DNA, 1170 bp, Escherichia coli
atgaatttacatgagtatcaggccaaatcgttactggctggcatggggatgccgtgtccaaaagagatagccatccaacagatttcgcaactggcagatgcctggcaacatattgcttgcccgagtaaaggcgcggtacttaaagcgcaggtacatgctggtgggcgcggtaaagctggcggcgtaaaagtgcttaagcagctgccggaagcacaggcttttgtacagcaaatgttgggatcgcaactggtgacttatcagaccgggccagaagggcagtatgtcagcagtattttgctgtgcgaaaacatctatccggtacgccaggaactctattttggcatggtggtggatcgtgaaagccagcgggtcacgtttattgtcagcccggaaggtggtgtggaaattgaaaaagtcgcccatgagacaccggagaaaatcagcagtgtcagcattgatccactgacaggcgtgcagccttgccatatccgcgaaatgtttgctgttctgcaactggaacacgggctatttgctacctttagtcgcctggttaatcaggcgtggaaagcctttaacgaactggatttcgccctgctggaaattaaccctctggtgttgcgggaaacgggcgaatttatgtgtgcagacgcgaaagtatcgctggatgataacgcgctgtatcgtcacccggaactccaggtgctacgtgatgaaacccaggaagatccacgcgaaagccaggcagcgaagcttgatcttaattatgtctcgctggacggaaatatcggctgcatggtcaatggtgcagggctggctatggcaaccatggacatcatcaagctatacggtgaacaacccgcaaacttcctggatgttggcggtggcgcaacccaggagcgcgtcagtgaagcctttcggctgattgtttccgacagcaaagtgaaagccattctggttaatatttttggtgggattgtccgttgcgacatgatcgccagagccattattcatgctctgaatgaggcccgtatcaccctgcctgtcgtggtgcgtctctccggtaataacgctgccgaagggcagcggttactggcagaaagtggcctgacggtggaagccgtcaattctctggatgatgccgctaaacgcatcattgcgttactgaattaa

SEQ ID NO: 9348 - protein, 389 aa, Escherichia coli
MNLHEYQAKSLLAGMGMPCPKEIAIQQISQLADAWQHIACPSKGAVLKAQVHAGGRGKAGGVKVLKQLPEAQAFVQQMLGSQLVTYQTGPEGQYVSSILLCENIYPVRQELYFGMVVDRESQRVTFIVSPEGGVEIEKVAHETPEKISSVSIDPLTGVQPCHIREMFAVLQLEHGLFATFSRLVNQAWKAFNELDFALLEINPLVLRETGEFMCADAKVSLDDNALYRHPELQVLRDETQEDPRESQAAKLDLNYVSLDGNIGCMVNGAGLAMATMDIIKLYGEQPANFLDVGGGATQERVSEAFRLIVSDSKVKAILVNIFGGIVRCDMIARAIIHALNEARITLPVVVRLSGNNAAEGQRLLAESGLTVEAVNSLDDAAKRIIALLN

SEQ ID NO: 9349 - DNA, 873 bp, Escherichia coli
atgagcgttttgatcaacaaacacacgcgggtactggtgcagggcattaccggcaaaaacggcacatttcatacagagcaggctattgcgtatggcacgcagattgtgggtggagtgacgccaggtaagggcgggcaacggcatctggatcgcccggtttttgattcaatgaaagaagcgatgcgacaaactgaggctgatgccagcgtgatttatgtgcctgcaccgtttgtgctggattctgttgttgaggctattgaagctggcgtcaaattggttgtggtgatcactgaaggtgtaccgacactggatatggtgaaagttcgtcggctgcttgactgccacccggatgtgcggctgattgggccaaactgcccaggagttatcacgccgggcgagtgcaaaatcgggattatgcctggtgaaatccaccgcccagggcgtattgggattgtttcccgctccggtacattaacctacgaagctgtagcgcaaaccacggcgctgggacttgggcaatccacctgtattggtattggcggcgatccggttccggggactaactttattgatgcgctgcgtttattcgaaaatgatccgcaaacagacgcggtaattatgatcggtgaaattggtggtaatgcggaagaacgggctgcggaatttattcgtcatgaaatgaataaaccggtcgtaggttatattgccggtgttactgcaccaaaaggaaaacgcatggggcacgccggagccattatttctggcggtagcggcagtgcagaggataaattccgtgcgttcgataaagcaggcatggcatggacaagaaacccggcgttgcttggcgaaacgttatggaatgttattaagtaa

SEQ ID NO: 9350 - protein, 290 aa, Escherichia coli
MSVLINKHTRVLVQGITGKNGTFHTEQAIAYGTQIVGGVTPGKGGQRHLDRPVFDSMKEAMRQTEADASVIYVPAPFVLDSVVEAIEAGVKLVVVITEGVPTLDMVKVRRLLDCHPDVRLIGPNCPGVITPGECKIGIMPGEIHRPGRIGIVSRSGTLTYEAVAQTTALGLGQSTCIGIGGDPVPGTNFIDALRLFENDPQTDAVIMIGEIGGNAEERAAEFIRHEMNKPVVGYIAGVTAPKGKRMGHAGAIISGGSGSAEDKFRAFDKAGMAWTRNPALLGETLWNVIK

SEQ ID NO: 9351 - DNA, 1500 bp, Escherichia coli
atgtcatcaatatcccatggcgcaccacaaaagcgtcgaattatccctaatcccggcctgtggttggcgatcattgccggaattattattacccttctgccactgggcgataccttgcccgtcgccggacaaaatatgatcgccattctggtgtttgccattattgtctggatcagcgaagcgatggattacaccgccagtgcaattgttatttccgcactgattatctttatggttggttttgccccggatatgaatcacccggacacgatccttggcaccgcgaaagcgctgaaaatgactctgtcgggtttttctaattctgctctggcgctggtggcagcagcaatgtttatcgcggcggcaatgaccattaccgggctggataaacgcattgcgctgtttactatgtcgaaaataggtgccagcagccgcagcattattatcggtgccattgtggtgaccatcgtcctgagcctggttgtacccagtgccactgcccgtacggcttgcgtggtgccgattatgatgggggtcattgcggcatttaaggtggataaacattcacgtttagcggcgtcaatgatgattgttatcgcccaggcgaccagtatctggaacgttggtattcaaacttcggcggcgcaaaacctgctttctatcggttttatcaataaaactttcggcgccgggcattctgtcagctggcttgactggctgttagcgggcgcgccctggagcctcaccatgtcggtgatcctctatttcctcgcacgtaaattgttgccgccagaaacggaagctgttgaaggggggagcgaggccattaaaaaagcactcgcagagttagggccaaccaccggtaaagaaaaacgcttgatcggtatttcgctattgttactgctcttttggtctactggcggaaaattacacagtattgataccacctctgtcacccttgccggactggcgattatgttgctgccaggcatcggtgtaatgagctggaaagaggtcgaaaaacgtgtgcagtggggcacgttgctgatgtttggtattggtatcagcctagggtccacgctgcttgatacgcaggcagcttcatggatggcgaactatgtggtgaaaggttttggtcttgatggcttgccatcattagccatcttcgcgattctcgccgctttcttgataattattcacctggggtttgccagtgccactgcgctaactgccgcattgctgcccatcctgattagcctgttaagcagtctgccgccagaactcggcgttaacccggtcggcatgaccattctgctcgccttcagtgtcagttttggcttcatcctgccgattaacgcgccacaaaatatggtgtgtatgggtacggataccttcacgccacgccagtttacccgtgtgggactgtacctgacggtaatcggctacctgttgttgctactgtttgccgccacctggtggaaaattttaggtctaatgtga

SEQ ID NO: 9352 - protein, 499 aa, Escherichia coli
MSSISHGAPQKRRIIPNPGLWLAIIAGIIITLLPLGDTLPVAGQNMIAILVFAIIVWISEAMDYTASAIVISALIIFMVGFAPDMNHPDTILGTAKALKMTLSGFSNSALALVAAAMFIAAAMTITGLDKRIALFTMSKIGASSRSIIIGAIVVTIVLSLVVPSATARTACVVPIMMGVIAAFKVDKHSRLAASMMIVIAQATSIWNVGIQTSAAQNLLSIGFINKTFGAGHSVSWLDWLLAGAPWSLTMSVILYFLARKLLPPETEAVEGGSEAIKKALAELGPTTGKEKRLIGISLLLLLFWSTGGKLHSIDTTSVTLAGLAIMLLPGIGVMSWKEVEKRVQWGTLLMFGIGISLGSTLLDTQAASWMANYVVKGFGLDGLPSLAIFAILAAFLIIIHLGFASATALTAALLPILISLLSSLPPELGVNPVGMTILLAFSVSFGFILPINAPQNMVCMGTDTFTPRQFTRVGLYLTVIGYLLLLLFAATWWKILGLM

SEQ ID NO: 9353 - DNA, 1359 bp, Escherichia coli
atgaataataaatccagtgaaattactatagtttatattgaggatagtgacgatgtacgttttgcctgtgaacaaacgctcacgctggctggttatcgtgttatttcctgttgcgatgcagaacacagtattccccttattcaaagtcaagccaacattattatactgaccgatgtcaggttacctggaatatcaggactagagctcctcagttacatcaacgaaatggatagcaaaattccggttattttaattaccggacacggtgacgtggaaatggcggtggatgccatgcgtaatggtgcattcgatttcattgagaaaccaagtagctcagataaattattgagtattattgccagagcggtagaaaaacggcgattggttttagaaaatcagcaattactggcgaatctgcaacaggaaaatggcccggtgctgattggtcgtagtccgcagatgcaacaactgcgtaaaatgatccttaatgtcgcagataccggtgccgatgtccttatttatggtgaaacaggttgtggtaaagaagtcgtcgccagaatgctgcatcactggagtacccgccgtcaggggcagtttgttgccttaaactgtgcaggcttaccagaaacgttgtttgaaagcgaaatatttggtcatgaggcgggcgcatttaccggtgcggttaaaaagcgtattggaaaaattgaacatgcaaatggtggtacgttatttctcgatgaaatagagggaatgccatcaggaatgcaggtaaaactgctacgtgtattgcaggaaagaaccattgaacgattaggtgccaatcaattaattccggtgaattgccgtgttattgcagcgaccaaggaagatttactgcgtcgcagcgaagaacatctgtttcgtctcgatctctattatcgtctgaatgtggttagcttgaatattccacctctacgccagcgacgagaagatatccctgaactgttttactggttcgccagtcaggcggcacaaaaatataatcgtcctctgcctgatatttctcccatgttactggcctggttgcaatcacaaagttggcctggcaatgtacgtgaacttaaacacaatgcagagcgttttgttctcggtttactgacccaccaccagccagtgccaatgactcagcaagaagagagtggccttaccgcctgcattgatgctttcgagaaaaagttaatcgaagatatgctgcgacaaacggaaggccaagtcagtttgacagcgcggctattacagctgccgcgcaagactttatatgacaaactcaacaaacatcagattcaaccgcaagtttatcgaccagaatcatccagctaa

SEQ ID NO: 9354 - protein, 452 aa, Escherichia coli
MNNKSSEITIVYIEDSDDVRFACEQTLTLAGYRVISCCDAEHSIPLIQSQANIIILTDVRLPGISGLELLSYINEMDSKIPVILITGHGDVEMAVDAMRNGAFDFIEKPSSSDKLLSIIARAVEKRRLVLENQQLLANLQQENGPVLIGRSPQMQQLRKMILNVADTGADVLIYGETGCGKEVVARMLHHWSTRRQGQFVALNCAGLPETLFESEIFGHEAGAFTGAVKKRIGKIEHANGGTLFLDEIEGMPSGMQVKLLRVLQERTIERLGANQLIPVNCRVIAATKEDLLRRSEEHLFRLDLYYRLNVVSLNIPPLRQRREDIPELFYWFASQAAQKYNRPLPDISPMLLAWLQSQSWPGNVRELKHNAERFVLGLLTHHQPVPMTQQEESGLTACIDAFEKKLIEDMLRQTEGQVSLTARLLQLPRKTLYDKLNKHQIQPQVYRPESSS

SEQ ID NO: 9355 - DNA, 1074 bp, Escherichia coli
atgtcattacaaattgctgttgaaaaagtgcgttggttagctgccgggctgctggaacttaatggctgtgatgccgatatcgctcaggatgtggcggaacatatgattgaagcggaacgttatggctttgccagccacggcgtcacgctgctaccgaaatatctggaaaatatcgctcgtggcgatgtaaccgcgaatgcccgcccggaatgcttaacaagtgaaggtaatttacaacgttttcatgcccacaatggctttggtcaacacgccggaaaagtggcggtaaatgctgccatcgaacaagcaaaacaccgcggtttttgcctgttaacgttgtgccatgcgcatcatttagggcgtatggggcattacgggcaaatggttgctgatcaaggcctggcgatgctggccatgagtaacgtcaccgggcgtccggcactggtcgccccgtggggcggtgcggaaccgcgtatgaccactaaccctttctgctttgcctggccgttcagtgatgggcgtccgccgattctggttgattttgccaccagtagcatggcgctaaataaagcacgggtaatgtcgtccaccgggaagcaggccgcgccgggacaattgatcgatgcacaggggaatccaagcaatgatcctggggtgttattcagcaatcctccaggggcgttactgccatttggtgagcataaaggatttggcctggcactgatgattgaaatgatggcggggatcttatctggtggtgacacgatcgccgaagatcatcagacggatggatctgcgcataatcatctttttgcgttgattatcgatcctgatcaattcaccgatctggcaggggagaaagggcagttctttgcggattatctgttagctacgcagcctcaacctggcggcaatccggtgatttaccccggtatgccagaagctgccaaccgggaacgcaatgcgaagatgattacgatcccggtatcattctggtcctggatagttgaacattacgcccgcaaaggtatcgatttggggttacatcctcaggaatcagcattagctggatga

SEQ ID NO: 9356 - protein, 357 aa, Escherichia coli
MSLQIAVEKVRWLAAGLLELNGCDADIAQDVAEHMIEAERYGFASHGVTLLPKYLENIARGDVTANARPECLTSEGNLQRFHAHNGFGQHAGKVAVNAAIEQAKHRGFCLLTLCHAHHLGRMGHYGQMVADQGLAMLAMSNVTGRPALVAPWGGAEPRMTTNPFCFAWPFSDGRPPILVDFATSSMALNKARVMSSTGKQAAPGQLIDAQGNPSNDPGVLFSNPPGALLPFGEHKGFGLALMIEMMAGILSGGDTIAEDHQTDGSAHNHLFALIIDPDQFTDLAGEKGQFFADYLLATQPQPGGNPVIYPGMPEAANRERNAKMITIPVSFWSWIVEHYARKGIDLGLHPQESALAG

SEQ ID NO: 9357 - DNA, 1821 bp, Escherichia coli
atgaaaatatcgtggaattatatatttaagaacaaatggcgatttcacattacaagcatttcactttttcttatcatgctcgcggtttcaatcgcttttttgcacttgcgttttaataccttgtccggtaccgataaaatgcggcttgaaatgtataagtccacattatattccaccatcgagcaattttatgttttaccctatatgctctcaacagaccatatcatccgtcaggcggtaattacgcctgacgatatgacgtccagcgaactcaatcaacgaattgcacatttcaatactcaactcaaaaccgcagcaatatttattctggatacccaaggtaaggccatcgcttctagcaactggcaggaccccggcagctatgtagggcaaaattatagctatcgcccctattataaacacgccatgtctggcttaaatggacgcttttacggtattggtagcactacaaatacaccgggattcttcctctctacaagtataaaagataaaggaaaaattgtcggtgttgtagtagtaaaaataagtcttaatgaaattgaaaaagcatgggccgaaggtcctgaaaatattatcgtgaatgatgaacatgggattatatttttaagttcaaaatcgccatggcgaatgcgaacactgcaaccgttacctgttcaggaaaaacaaaaactacaatctacccgtcaatatagtctcgacaatcttttaccggcggattattatccctgttataccgtgagcaattttactttcctgaaagataaaaaagaacaactctgtttattcccgcaatattatacgcaacaaatagccattccagaatttaactggaaaatgacaattatggtccccttagataacctgtactggtcatgggctatttcgttagtcattacactaattatttacctgctgtttttgttatttattaaatactggagaatgcgatctcatgcacaacaattattaacactggcgaatgaaacattagaaaaacaggttaaagagcgtacatctgccctggaattgatcaatcaaaaattaatacaggagataaaagagcgcagtcaggctgaacaagtattacaaattacgcgtagtgaactggcagagtccagcaaactggcggcgcttggacagatggcaaccgaaattgcccatgaacaaaatcaaccgttagccgccattcacgcacttactgataacgcgcgtactatgctaaaaaaagagatgtatccgcaggttgaacagaatctgaaacacattatttcagtgattgagcggatgacgcagctcatttccgaacttaaagcatttgcctcgcgccatcgcgtacctaaaggttctgccgatgtcatcaaagtgatgtatagcgccgtggcgttacttaatcacagcatggagaaaaataacattgagcgacgaataaaagccccatccatgccgttatttgtcaattgcgatgagctcggtcttgaacagatattcagtaatttaattagcaacgccttagattctatggaaggtagctcttacaaacgactggatatcgccattcgccaggcaaataacaaagttattattaccattaaagacagcggtggcggttttgcacctgaagttgtcgatcgcatatttgaaccattttttaccactaaacgtagaggaatggggttgggactggcaatagtcagcgaaattgtccgaaattcgaacggcgcactccacgccagtaatcatcctgaaggcggcgcagtaatgacattaacctggcctgaatggggagaagaacatgaataa

SEQ ID NO: 9358 - protein, 606 aa, Escherichia coli
MKISWNYIFKNKWRFHITSISLFLIMLAVSIAFLHLRFNTLSGTDKMRLEMYKSTLYSTIEQFYVLPYMLSTDHIIRQAVITPDDMTSSELNQRIAHFNTQLKTAAIFILDTQGKAIASSNWQDPGSYVGQNYSYRPYYKHAMSGLNGRFYGIGSTTNTPGFFLSTSIKDKGKIVGVVVVKISLNEIEKAWAEGPENIIVNDEHGIIFLSSKSPWRMRTLQPLPVQEKQKLQSTRQYSLDNLLPADYYPCYTVSNFTFLKDKKEQLCLFPQYYTQQIAIPEFNWKMTIMVPLDNLYWSWAISLVITLIIYLLFLLFIKYWRMRSHAQQLLTLANETLEKQVKERTSALELINQKLIQEIKERSQAEQVLQITRSELAESSKLAALGQMATEIAHEQNQPLAAIHALTDNARTMLKKEMYPQVEQNLKHIISVIERMTQLISELKAFASRHRVPKGSADVIKVMYSAVALLNHSMEKNNIERRIKAPSMPLFVNCDELGLEQIFSNLISNALDSMEGSSYKRLDIAIRQANNKVIITIKDSGGGFAPEVVDRIFEPFFTTKRRGMGLGLAIVSEIVRNSNGALHASNHPEGGAVMTLTWPEWGEEHE

SEQ ID NO: 9359 - DNA, 783 bp, Escherichia coli
atggtcagatggttttttcaacaaacgcacaataataagtttcaacttactgactatttagggaaaaatatgcgcaagatcacacaggcattgagtgccgtttgcttattgttcgctctaaacagttccgctgttgccctggcctcatctccttcaccgcttaatccgggtactaacgtagccaaactcgctgaacaggcgccaattcattgggtttcggttgcacaaattgaaaatagcctcgcaggacgtccgccaatggcggtggggtttgatatcgatgatacggtacttttttccagtccgggtttctggcgcggcaaaaaaaccttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagcccgaccaaaacagaaacggtttcaaaaacgctggcggataattttcatattcctgccaccaacatgaatccggtgatctttgcgggcgataagccaggtcaaaatacaaaatcgcaatggctgcaggataaaaatatccgaattttttatggtgattccgataacgatattaccgccgcacgcgatgttggcgctcgtggtatccgcattctgcgcgcctccaactctacctacaaacccttgccacaagcgggtgcgtttggtgaagaggtgatcgtcaattcagaatactga

SEQ ID NO: 9360 - protein, 260 aa, Escherichia coli
MVRWFFQQTHNNKFQLTDYLGKNMRKITQALSAVCLLFALNSSAVALASSPSPLNPGTNVAKLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 9361 - DNA, 417 bp, Escherichia coli
atgtggtatcaaaagacgctcacgcttagcgccaaatctcgtgggtttcatctggtaacggatgaaattctgaatcagctggctgatatgccgcgcgttaacatcggtttactgcatctgttgctgcaacatacctccgcctctctgacacttaatgagaactgcgatcccaccgtacgccacgacatggagcgttttttcctccgcgccgttcccgataacggaaattatgagcatgactatgagggagcagacgatatgccttctcatatcaaatcctcaatgctgggaacatcgcttgtattgccggtgcataaagggcgtattcagaccggcacctggcaaggcatctggctgggggaacatcgcatccacggcggatcgcgtcgcatcatcgcgacactacaaggggagtga

SEQ ID NO: 9362 - protein, 138 aa, Escherichia coli
MWYQKTLTLSAKSRGFHLVTDEILNQLADMPRVNIGLLHLLLQHTSASLTLNENCDPTVRHDMERFFLRAVPDNGNYEHDYEGADDMPSHIKSSMLGTSLVLPVHKGRIQTGTWQGIWLGEHRIHGGSRRIIATLQGE

SEQ ID NO: 9363 - DNA, 357 bp, Escherichia coli
atgaccatttcggagttgctacaatattgcatggcaaaaccaggcgcagaacagagcgtgcataacgactggaaagcgacgcagatcaaagtggaagatgtgctgtttgcgatggtgaaagaagtagaaaatcgcccagctgtttcgctgaaaaccagcccggagctggcggagctgctacgtcagcagcacagcgatgtgcgtccaagccgccatctgaataaagcgcactggagcaccgtgtatctcgacggttcgctgccggattcgcaaatctattatctggtggatgcgtcttatcagcaggcggtgaatttgctgccggaagaaaaacgtaaattgctggtgcaactctga

SEQ ID NO: 9364 - protein, 118 aa, Escherichia coli
MTISELLQYCMAKPGAEQSVHNDWKATQIKVEDVLFAMVKEVENRPAVSLKTSPELAELLRQQHSDVRPSRHLNKAHWSTVYLDGSLPDSQIYYLVDASYQQAVNLLPEEKRKLLVQL

SEQ ID NO: 9365 - DNA, 2823 bp, Escherichia coli
atggataagatcgaagttcggggcgcccgcacccataatctcaaaaacatcaacctcgttatcccccgcgacaagcttattgtcgtgaccgggctttcgggttctggcaaatcctcgctcgctttcgacaccttatatgccgaagggcagcgccgttacgttgaatccctttccgcctacgcgcggcagtttctgtcactgatggagaagccggacgtcgaccatattgaagggctttctcctgccatctcaattgagcagaaatcgacgtctcataacccgcgctctacggtggggacaatcaccgaaatccacgactatttgcgtctgctgtacgctcgcgttggtgagccgcgctgcccggaccacgatgtaccgctggcggcgcaaaccgtcagtcagatggtggataacgtgttgtcccagccggaaggcaagcgtctgatgctgctcgcgccaatcattaaagagcgcaaaggcgaacacaccaaaacgctggagaacctggcaagccagggttacatccgtgctcgtattgatggcgaagtctgcgatctttccgatccgccgaaactggaactgcaaaagaaacataccattgaagtggtggttgatcgcttcaaagtgcgtgacgatcttacccaacgtcttgccgagtcgtttgaaaccgcgctggagctttccggtggtaccgcggtagtggcggatatggacgacccgaaagcggaagagctgctgttctccgccaactttgcctgcccgatttgcggttacagtatgcgcgagctggaacctcgcctgttttcatttaacaacccggcgggagcctgcccgacctgtgacggtcttggcgtacagcaatatttcgatcctgaccgcgtgatccagaatccggaattgtcgctggctggcggtgcgatccgtggctgggatcgccgcaacttctattatttccagatgctgaaatcgctggcagatcactataagttcgacgtcgaagcgccgtggggcagcctgagcgcgaacgtgcataaagtggtgttgtacggttctggcaaagaaaacattgaattcaaatacatgaacgatcgtggcgatacctccattcgtcgtcatccgttcgaaggcgtgctgcacaatatggagcgccgttataaagagacggaatccagcgcggtacgtgaagaattagccaagtttatcagcaatcgtccgtgcgccagctgcgaaggaacccgtctgcgtcgggaagcacgccacgtgtatgtcgagaatacgccgctgcccgccatctccgacatgagcatcggtcatgcgatggaattcttcaacaatctcaaactcgcaggtcagcgggcgaagattgcagaaaaaatccttaaagagatcggcgatcgtctgaaattcctcgttaacgtcggcctgaattacctgacactttcccgctcagcagagacactttccggcggtgaagcccagcgtattcgtctggcgagccagattggtgcaggcctggttggcgtgatgtacgtgctggatgagccgtctatcggcctgcaccagcgcgataacgagcgcctgttgggtacgcttatccatctgcgcgatctcggtaataccgtgattgtggtggagcacgacgaagacgcgattcgcgccgctgatcatgtgatcgatatcggtccgggtgcgggtgttcacggcggtgaagtggtcgcggaaggtccactggaagcgattatggcggtgcctgagtcgttgaccgggcagtacatgagcggtaaacgcaagattgaggtgccgaagaaacgcgtacccgccaatccagaaaaagtgctgaaactgacgggcgcacgcggcaacaacctgaaagacgtgacgctgacgctgccggtaggtctgtttacctgcatcacaggggtttcaggttccggtaaatcgacgctgattaacgacacactgttcccgattgcccaacgccagttgaatggtgcgaccatcgccgaaccggcaccgtatcgcgatattcagggactggagcatttcgataaagtgatcgatatcgaccaaagcccaattggtcgtactccgcgttctaacccggcgacctataccggcgtgtttacacctgtgcgcgaactgtttgcgggcgtaccggaatcccgtgcgcgcggctatacgccaggacgtttcagctttaacgtccgtggcggacgctgcgaggcctgtcagggcgacggcgtgatcaaagtggagatgcacttcctgccggacatttacgtaccgtgcgaccagtgcaaaggcaaacgctataaccgtgaaacgctggagattaagtacaaaggcaaaaccatccacgaagtgctggatatgaccatcgaagaggcgcgtgagttctttgatgcggtgccagctctggcgcgtaagctgcaaacgttgatggacgttggcctgacgtacattcgcctcgggcagtccgcaaccacactttctggtggtgaagcccagcgcgtgaagctggcgcgtgagctgtcaaaacgcggcaccgggcagacgctgtatattctcgacgagccgaccaccggtctgcacttcgccgatattcagcaactgctcgacgtactgcataaactgcgcgatcagggcaataccattgtggtaattgagcacaatctcgacgtgatcaaaaccgctgactggattgtcgacctgggaccggaaggcggcagtgggggcggcgaaatcctcgtctccggtacgccagaaaccgtcgcagagtgcgaagcttcgcatacggcgcgcttcctcaagccgatgctgtaa

SEQ ID NO: 9366 - protein, 940 aa, Escherichia coli
MDKIEVRGARTHNLKNINLVIPRDKLIVVTGLSGSGKSSLAFDTLYAEGQRRYVESLSAYARQFLSLMEKPDVDHIEGLSPAISIEQKSTSHNPRSTVGTITEIHDYLRLLYARVGEPRCPDHDVPLAAQTVSQMVDNVLSQPEGKRLMLLAPIIKERKGEHTKTLENLASQGYIRARIDGEVCDLSDPPKLELQKKHTIEVVVDRFKVRDDLTQRLAESFETALELSGGTAVVADMDDPKAEELLFSANFACPICGYSMRELEPRLFSFNNPAGACPTCDGLGVQQYFDPDRVIQNPELSLAGGAIRGWDRRNFYYFQMLKSLADHYKFDVEAPWGSLSANVHKVVLYGSGKENIEFKYMNDRGDTSIRRHPFEGVLHNMERRYKETESSAVREELAKFISNRPCASCEGTRLRREARHVYVENTPLPAISDMSIGHAMEFFNNLKLAGQRAKIAEKILKEIGDRLKFLVNVGLNYLTLSRSAETLSGGEAQRIRLASQIGAGLVGVMYVLDEPSIGLHQRDNERLLGTLIHLRDLGNTVIVVEHDEDAIRAADHVIDIGPGAGVHGGEVVAEGPLEAIMAVPESLTGQYMSGKRKIEVPKKRVPANPEKVLKLTGARGNNLKDVTLTLPVGLFTCITGVSGSGKSTLINDTLFPIAQRQLNGATIAEPAPYRDIQGLEHFDKVIDIDQSPIGRTPRSNPATYTGVFTPVRELFAGVPESRARGYTPGRFSFNVRGGRCEACQGDGVIKVEMHFLPDIYVPCDQCKGKRYNRETLEIKYKGKTIHEVLDMTIEEAREFFDAVPALARKLQTLMDVGLTYIRLGQSATTLSGGEAQRVKLARELSKRGTGQTLYILDEPTTGLHFADIQQLLDVLHKLRDQGNTIVVIEHNLDVIKTADWIVDLGPEGGSGGGEILVSGTPETVAECEASHTARFLKPML

SEQ ID NO: 9367 - DNA, 537 bp, Escherichia coli
atggccagcagaggcgtaaacaaggttattctcgttggtaatctgggtcaggacccggaagtacgctacatgccaaatggtggcgctgttgccaacattacgctggctacttccgaatcctggcgtgataaagcgaccggcgagatgaaagagcagactgaatggcaccgcgttgtgctgttcggcaaactggcagaagtggccagcgaatatctgcgtaaaggttctcaggtttatatcgaaggccagctgcgtacccgcaaatggaccgatcaatccggtcaggatcgctataccacagaagtcgtggtgaacgttggcggcaccatgcagatgctgggtggtcgtcagggtggtggcgctcctgcaggtggcaatatcggtggtggtcagccgcagggcggttggggtcagcctcagcagccgcagggtggcaatcagttcagcggcggcgcgcagtctcgcccgcagcagtccgctccggcagcgccgtctaacgagccgccgatggactttgatgacgatattccgttctga

SEQ ID NO: 9368 - protein, 178 aa, Escherichia coli
MASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRQGGGAPAGGNIGGGQPQGGWGQPQQPQGGNQFSGGAQSRPQQSAPAAPSNEPPMDFDDDIPF

SEQ ID NO: 9369 - DNA, 381 bp, Escherichia coli
ttgtgttctgcaagccccgcgatagccagagtgtatcacgcctcccgtgaacaacgccgcgctgtccagggcatcagctcttttccgaggaattgtttgatggctaccctcaccactggcgtggttcttcttcgctggcaacttcttagtgccgtaatgatgtttctggctagcacgctcaacatccgttttcgtcgggctgattatgtcgggcttgcagtgatcagcagcggtctgggcgtagtttccgcctgctggttcgcaatggggttgcttggcatcacaatggcggatatcaccgccatctggcacaacatcgagtcggtgatgatagaagagatgaatcagacaccgccacaatggccaatgattttgacttga

SEQ ID NO: 9370 - protein, 126 aa, Escherichia coli
MCSASPAIARVYHASREQRRAVQGISSFPRNCLMATLTTGVVLLRWQLLSAVMMFLASTLNIRFRRADYVGLAVISSGLGVVSACWFAMGLLGITMADITAIWHNIESVMIEEMNQTPPQWPMILT

SEQ ID NO: 9371 - DNA, 1587 bp, Escherichia coli
atgagtcatcgtgcacgacaccaattactggcgtttccgggcattatctttttagttctctttcccatcattctgtcgctatggattgccttcttttgggcaaaatcagaagtgaataatcagctccgaacctttgctcagctggcgttggataaatctgagctggtcattcgtcaggcagatttagtgagcgatgcagctgaacgctatcaggggcaagtttgcactccagcccatcaaaagcgaatgttgaatattattcgtggctatctttatattaatgaattgatttatgctcgtgataaccattttttatgctcatcgctgatagcgtctgtaaatggctatacgattgcaccggccgattataagcgcgaacctaacgtttctatctattattaccgtgatacgccttttttctctggctataaaatgacctacatgcagcggggaaattatgtggcggttatcaaccctctcttctggagtgaagtgatgtctgatgatccgacattgcaatggggagtgtatgatacggtgacgaaaacctttttctcgttaagcaacgaggcctcggcagcaacgttttctccgctgattcatttgaatgatttaaccgtacaacgaaatggctatttatatgcgacagtttattcgacaaaacgcccaattgcagccattgttgcgacttcatatcaacgtcttataactcatttttataatcatcttatttttgcgttgcccgccggtattttggggagtcttgttctgctattactctggctacgtattcgacaaaactatttgtctcccaaacgcaaattgcaacgcgccctcgaaaaacatcaactttgcctttattaccagccaataatcgatatcaaaacagaaaaatgtatcggcgctgaagcgttgttacgttggcctggtgagcaggggcaagtaatgaatccggcagagtttattccgctggcagaaaaggaggggatgatcgaacaggtaactgattatgttattgataatgtcttccgtgatttgggcgcgtatctggcaacacataccgatcgctatgtttctattaacctgtcagcctccgattttcatacctcacggttgatagcgcgaaccaatcagaaaacagagcaacatgcggtgcgtccgcagcaaattaaatttgaagtgactgaacatgcatttcttgatgtcgacaaaatgacgccgattattctggctttccgcaaggccggttacgaagtggcaattgatgattttggtattggctactctaacttgcataaccttaaatcattgaatgtcgatattttgaaaatcgataaatcgtttgttgagacgctgaccacccacaaaaccagtcatttgattgcggaacacatcatcgagctggcgcacagcctggggttaaaaacgatcgctgaaggtgtcgaaactgaggcgcaggttaactggctgcgcaaacgcggcgtgcgctattgccagggatggttcttcgcgaaggcgatgccgccgcaggtgtttatgcaatggatggagcaattacccgcgcgggagttaacgcgcgggcaataa

SEQ ID NO: 9372 - protein, 528 aa, Escherichia coli
MSHRARHQLLAFPGIIFLVLFPIILSLWIAFFWAKSEVNNQLRTFAQLALDKSELVIRQADLVSDAAERYQGQVCTPAHQKRMLNIIRGYLYINELIYARDNHFLCSSLIASVNGYTIAPADYKREPNVSIYYYRDTPFFSGYKMTYMQRGNYVAVINPLFWSEVMSDDPTLQWGVYDTVTKTFFSLSNEASAATFSPLIHLNDLTVQRNGYLYATVYSTKRPIAAIVATSYQRLITHFYNHLIFALPAGILGSLVLLLLWLRIRQNYLSPKRKLQRALEKHQLCLYYQPIIDIKTEKCIGAEALLRWPGEQGQVMNPAEFIPLAEKEGMIEQVTDYVIDNVFRDLGAYLATHTDRYVSINLSASDFHTSRLIARTNQKTEQHAVRPQQIKFEVTEHAFLDVDKMTPIILAFRKAGYEVAIDDFGIGYSNLHNLKSLNVDILKIDKSFVETLTTHKTSHLIAEHIIELAHSLGLKTIAEGVETEAQVNWLRKRGVRYCQGWFFAKAMPPQVFMQWMEQLPARELTRGQ

SEQ ID NO: 9373 - DNA, 324 bp, Escherichia coli
atgtcccatcagaaaattattcaggatcttatcgcatggattgacgagcatattgaccagccgcttaacattgatgtcgtcgcaaaaaaatctggctattcaaagtggtacttgcaacggatgttccgcacggtgacgcatcagacgcttggcgattacattcgccagcgccgtctgttactggccgccgttgagttgcgcaccaccgagcgtccgatttttgatatcgcaatggacctgggttatgtctctcagcagaccttctcccgcgttttccgtcggcagtttgatcgcactcccagcgattatcgccaccgcctgtag

SEQ ID NO: 9374 - protein, 107 aa, Escherichia coli
MSHQKIIQDLIAWIDEHIDQPLNIDVVAKKSGYSKWYLQRMFRTVTHQTLGDYIRQRRLLLAAVELRTTERPIFDIAMDLGYVSQQTFSRVFRRQFDRTPSDYRHRL

SEQ ID NO: 9375 - DNA, 465 bp, Escherichia coli
atggaaaagaaattaccccgcattaaagcgctgctaacccccggcgaagtggcgaaacgcagcggtgtggcggtatcggcgctgcatttctatgaaagcaaagggttgattaccagtatccgtaatagcggcaatcagcggcgatataaacgtgatgtgttgcgatatgtcgcaattatcaaaattgctcagcgtattggcattccgctcgcaaccattcgtgaagcgtttggcgtgttgccagaagggcatacgttaagtgcgaaagagtggaaacagctttcgtcccaatggcgagaagagttggatcggcgcattcataccttagtggcgctgcgtgacgaactggatggatgtattggttgtggctgcctttcgcgcagtgattgcccgttgcgtaacccgggcgaccgattaggagaagaaggtaccggcgcacgcttactggaagatgaacaaaactaa

SEQ ID NO: 9376 - protein, 154 aa, Escherichia coli
MEKKLPRIKALLTPGEVAKRSGVAVSALHFYESKGLITSIRNSGNQRRYKRDVLRYVAIIKIAQRIGIPLATIREAFGVLPEGHTLSAKEWKQLSSQWREELDRRIHTLVALRDELDGCIGCGCLSRSDCPLRNPGDRLGEEGTGARLLEDEQN

SEQ ID NO: 9377 - DNA, 1350 bp, Escherichia coli
atgtctacgccatcagcgcgtaccggcggttcactcgacgcctggtttaaaatttcacaacgtggaagcactgtccgtcaggaagtggttgccgggttaacaacgtttctggcgatggtctactcggttatcgtcgttccaggcatgctgggtaaagcgggcttcccgcctgcggcagttttcgttgcaacctgtctggttgccggactcggttctatcgtgatgggtctgtgggctaatctgccgttggcgattggttgcgccatctctctgacggcgtttaccgcattcagtctggtgctggggcaacatattagcgtacctgtcgcgctgggtgccgtgttcctgatgggtgtgctgtttacggtaatttctgccacgggtatccgtagctggattttgcgcaacttgccgcacggtgtggcgcacggcacggggattggtatcggtctgttcctgctgctgattgctgctaatggtgtcggtctggtgattaaaaacccacttgatggtctgcccgtcgcgctgggggatttcacgacctttccggtgatgatgtcgttggtggggctggcagtgattatcggcctggaaaaactgaaagtccctggtggcattctgctgaccattatcggtatctcaattgtcggtttgatcttcgatcctaacgtccatttctccggcgttttcgccatgccttcattgagcgatgaaaacggcaattcactgattggcagcctggacattatgggtgcgctgaatcctgtagtcctgccaagtgttctggcactggtgatgacggcagtatttgatgccaccggaactatccgtgccgtcgccggtcaggcgaacctgctggataaagatgggcagatcatcgacggcgggaaagcactgaccaccgactccatgagcagcgttttttctggcctcgtgggtgcagctccggcagcggtatacatcgagtctgcggcgggtacggcggcgggcggtaaaaccggtttgacggctatcaccgttggcgtgctgttcctgctgattctgttcctctctccgctctcttacctcgttccggggtacgcaacggctccggcgctgatgtacgttggcctgctgatgctgagcaacgtggcgaaaatcgactttgctgattttgttgatgcgatggcgggtctggttacggcggtattcatcgtgctgacctgtaacatcgtaacaggcatcatgattggcttcgcgactctggtgattggtcgtctggtttccggcgaatggcgcaagttgaacatcggtacggtcgttattgccgtggcgctggtgaccttctatgcgggtggctgggctatctaa

SEQ ID NO: 9378 - protein, 449 aa, Escherichia coli
MSTPSARTGGSLDAWFKISQRGSTVRQEVVAGLTTFLAMVYSVIVVPGMLGKAGFPPAAVFVATCLVAGLGSIVMGLWANLPLAIGCAISLTAFTAFSLVLGQHISVPVALGAVFLMGVLFTVISATGIRSWILRNLPHGVAHGTGIGIGLFLLLIAANGVGLVIKNPLDGLPVALGDFTTFPVMMSLVGLAVIIGLEKLKVPGGILLTIIGISIVGLIFDPNVHFSGVFAMPSLSDENGNSLIGSLDIMGALNPVVLPSVLALVMTAVFDATGTIRAVAGQANLLDKDGQIIDGGKALTTDSMSSVFSGLVGAAPAAVYIESAAGTAAGGKTGLTAITVGVLFLLILFLSPLSYLVPGYATAPALMYVGLLMLSNVAKIDFADFVDAMAGLVTAVFIVLTCNIVTGIMIGFATLVIGRLVSGEWRKLNIGTVVIAVALVTFYAGGWAI

SEQ ID NO: 9379 - DNA, 1650 bp, Escherichia coli
atggaaatcttcttcaccatactgataatgaccctcgtggtctcgctgtccggggtggtcactcgtgtcatgccctttcagatcccgcttccgcttatgcaaatcgccatcggtgcgctactggcgtggccgacgtttggtttgcatgtggagtttgatcctgaactctttttagtcttgtttatcccgccgttgctgttcgctgatggctggaaaacgccgacccgtgaatttctcgaacatgggcgagagattttcggcctcgcgctggcgctggtggtggtcaccgtggtcggcattggcttccttatttactgggtggtgccgggcattccgctgatccccgcctttgcgctggctgcggtgctttctccgaccgatgctgtagcgctctccgggattgttggcgaggggcgcatcccgaaaaaaatcatgggcattttgcagggcgaagcgttgatgaatgacgcctccggcctggtgtcgttgaagtttgccgtggcagtggcgatggggacaatgatcttcaccgtcggcggtgcgacggtcgaatttatgaaagtggcaataggcggtattctcgccggttttgtggtgagctggctgtatggtcgctcgctgcgattcctcagccgctggggcggtgatgaacccgcgacgcagatcgttctgctgttcttgctgccattcgcttcttatctgattgcggaacatattggcgtttccggcatcctcgctgcggttgccgccgggatgaccatcacccgctccggtgtgatgcgccgtgcgccgctggcaatgcgcctgcgcgcaaacagcacctgggcgatgctggaatttgtctttaacggcatggtgttcctgctgttaggtctgcagttgccggggattctggagacgtcgctgatggcggcagaaatcgaccctaacgtcgaaatctggatgctgtttaccgatattattctgatatatgcggcgctgatgctggtccgtttcggctggctgtggacgatgaaaaagttcagcaaccgcttcctgaagaagaagccgatggagtttggttcgtggactacacgagaaatcctgatcgcgtctttcgccggggtgcgtggggcgatcactctggccggtgtgctctctatcccgcttctcttgccggatggtaacgtcttccctgcgcgctatgagttggtgttcctagcggctggcgtcattctcttctcattgtttgtcggcgtggtgatgttgcctattctgctacaacacatagaagtcgcggaccattcgcaacaattgaaagaggaacgtattgcacgagcggcaacggcagaagtggcgattgtggcgatccagaaaatggaggagcgtctggcggcggataccgaagagaatatcgataaccagctgctcacagaggttagttctcgcgtcattggtaacctgcgtcgtcgcgccgatggacgtaatgatgtagaaagttcaatcctggaagagaacctggagcgtcgcttccgtctggcggcattgcgttctgaacgtgctgaactgtaccacctgcgcgccacgcgggagatcagtaacgaaacgctgcaaaaattactgcacgatctcgatttgcttgaagcgttgctgattgaggaaaatcagtaa

SEQ ID NO: 9380 - protein, 549 aa, Escherichia coli
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSILEENLERRFRLAALRSERAELYHLRATREISNETLQKLLHDLDLLEALLIEENQ

SEQ ID NO: 9381 - DNA, 825 bp, Escherichia coli
  n 799, 800, 801, 802, 803: n is any nucleotide
atggatatcagaacgctgcgttattttgtcgaagtcgtgcgccagcaaagcttcacccgcgcagcggagaagttgtttgtcacccaaccaactatcagcaagatgctgaagaatctcgaagatgagctgaactgtatattgttgatccgcgatggtcgtcggctgcttctcactgatactggtcgcgtcgtatttgagcgcgggctggctttactggctgagtttcggcaactggaagctgagcttagcgatatcaatcagcttaaaaccggcgttttgcggctgggaatcccgccgatggttgggatgttgatggccgggccgattggcctttttcgccagcgttaccccggcgtagaattgaaaatttcggagtttggtggtctgacggtacaacaagcggtgatgaacggtgaactggatatggcactgacagccctgccagtagaagaaagcggcctgacaacgttatcgctgtttagtcatccactatgtgtactgacgccacattcaggtaaatggcttgaatgtgatgccgtctcaccggagacattggcggaacatcctctacttatctataacgaagattttgccttaagtaagcaattgatgaagttattcgatgaacatggcgttaagccgagaattgcagttcgcagcgggcaatgggattttctcgccgcgatggttcaggccggtgtcggaatagccatattgccggaacccatttgccagcgattagataaaaacaccttaaaatggctaccgctggaaagcgaactaagctggaaattaggannnnncattcattcattaattaattaa

SEQ ID NO: 9382 - protein, 274 aa, Escherichia coli
  Xaa 267, 268: Xaa is any amino acid
MDIRTLRYFVEVVRQQSFTRAAEKLFVTQPTISKMLKNLEDELNCILLIRDGRRLLLTDTGRVVFERGLALLAEFRQLEAELSDINQLKTGVLRLGIPPMVGMLMAGPIGLFRQRYPGVELKISEFGGLTVQQAVMNGELDMALTALPVEESGLTTLSLFSHPLCVLTPHSGKWLECDAVSPETLAEHPLLIYNEDFALSKQLMKLFDEHGVKPRIAVRSGQWDFLAAMVQAGVGIAILPEPICQRLDKNTLKWLPLESELSWKLGXXIHSLIN

SEQ ID NO: 9383 - DNA, 129 bp, Escherichia coli
ttgactatacctgcaatgattttaattcatttcagtcaggggcgagcgctctctatacttaccattctgttttattttcaggatatcctctcatgcccgtggcgcttcgccgcattacccctgccgtag

SEQ ID NO: 9384 - protein, 42 aa, Escherichia coli
MTIPAMILIHFSQGRALSILTILFYFQDILSCPWRFAALPLP

SEQ ID NO: 9385 - DNA, 405 bp, Escherichia coli
gtggcgcttcgccgcattacccctgccgtagtgcaatctatccaggtattttttcaggttgtgctgtatgcaggtttatttatttttgcgcagtatctcgtctcctggctgcatttgccgctgcctgccaacctggtggggatgatcctgatgctggcgctgattgtttgtcgcattcttcctctgcaatgggttcgagccggggcgcgttggctattggccgaaatgttgctgttttttgtccctgccgtggtggctgtggtgaactatgcacaactattactggtggatggctggcgtatttttgctgtgatcgcgctgagtacggtgatggtgctgggcacgactgcctgggtagtggaaaaagtctatcgctatgaaatgcgcaggttaaaccgtggctaa

SEQ ID NO: 9386 - protein, 134 aa, Escherichia coli
MALRRITPAVVQSIQVFFQVVLYAGLFIFAQYLVSWLHLPLPANLVGMILMLALIVCRILPLQWVRAGARWLLAEMLLFFVPAVVAVVNYAQLLLVDGWRIFAVIALSTVMVLGTTAWVVEKVYRYEMRRLNRG

SEQ ID NO: 9387 - DNA, 690 bp, Escherichia coli
gtggctaattttcagctaagtatgctctgtctggcaattacgctagttatctattttcttaacaaacgcctttatcgccgctttcgtaaattgccattgatgcctctggtgctgacgcctacgctactggttatgctgctggtttttggcaatatttcctggcaaaactatattggcgaagcgcacgggttactatggctattaggtccggccaccatcgcctttgcggtaccagtgtatgacaatcgggcgatcattaagcgtcactggatgtcgttgacggcaggcgtactgacggcaacggtggtggcagtgaccagctcagtgtggctggcgcgattgtttaccctgccagatgagatccagcgtagcctggcggtgcgttcggtcactacgccatttgctttggcagcgagccagtcgctcggcggacagcctgatctggtggcgctgtttgtggtggtcaccggtgtgtttggcatggcgattggcgacgtgttgtttttacgtctctctattcgcgaagggatggcgaaaggtgctggattcggcgcggcatctcatggtgccgggactgcgcggtcatatgaactgggtcaacaagaaggcgtagttgcaagcctggtcatgatgctttcaggtgtattgatggtattggtttcgccgctggtggccaggatgatgttctga

SEQ ID NO: 9388 - protein, 229 aa, Escherichia coli
MANFQLSMLCLAITLVIYFLNKRLYRRFRKLPLMPLVLTPTLLVMLLVFGNISWQNYIGEAHGLLWLLGPATIAFAVPVYDNRAIIKRHWMSLTAGVLTATVVAVTSSVWLARLFTLPDEIQRSLAVRSVTTPFALAASQSLGGQPDLVALFVVVTGVFGMAIGDVLFLRLSIREGMAKGAGFGAASHGAGTARSYELGQQEGVVASLVMMLSGVLMVLVSPLVARMMF

SEQ ID NO: 9389 - DNA, 1539 bp, Escherichia coli
atgttcctgattttcgtcgtgtttacgctcggcattacctactgggcgtcaaaacgcgtacgttcgcgtaatgactactacaccgcaggcggcaatatcaccggttttcagaacgggctggcgattgccggggactatatgtccgccgcctcattcttggggatctccgcgctggtgtttacctccggctatgacggcttaatttactcgctaggcttcctggtaggctggccgatcattttgttcctgatcgccgaacgtctgcgtaacctcggtcgctacacctttgccgatgtggcctcttaccgtctgaaacaagggccgattcgtattctttcagcctgtggttctctggtggtggtggcgctttaccttatcgcccagatggtgggcgcaggtaaactgatcgagctgctgtttggccttaactatcacattgcggtagtgctggtcggcgtgctgatgatgatgtacgtcctgttcggcggcatgctggcgaccacctgggtacaaattattaaagccgtgctgttgctgttcggtgccagctttatggcctttatggtgatgaaacacgtcggctttagcttcaacaatctgttcagcgaagcgatggcggtacacccgaaaggtgtcgacatcatgaagccgggcgggctggtgaaagatcctatctccgcgctctctttggggctaggactgatgtttggtacggcgggcttgccgcatattctgatgcgcttctttacggtcagcgatgcccgcgaagcacgtaagagcgtgttctacgccaccggatttatgggctacttctacatcctgacctttattatcggctttggcgcgatcatgctggtcggtgcgaatccggaatataaagacgcggcgggccatctgattggtggtaacaacatggcagcagttcacctggccaatgcggtgggcggcaacctgttcctcggctttatttcagcggttgctttcgccaccattcttgcggtggttgcgggtctgacgctggcgggcgcatcggcggtgtctcacgacctgtacgctaacgtcttcaaaaaaggtgcgaccgaacgtgaagagctgcgggtatcgaaaatcaccgtactgatcctcggtgtgattgccattatcctcggcgtgctgtttgagaatcagaacatcgcctttatggtggggctggcgtttgccatcgcggcgagctgtaacttcccgatcattctgctttccatgtactggtcgaaactgactacccgtggcgcaatgctgggcggctggttaggactgattactgcggtggtgctgatgatcctcggcccgactatttgggtacagatcctcggtcacgaaaaagccatcttcccgtatgaatacccggcgctgttctctatcagcgtggcattcctcggtatctggttattctcggcaacggataattcagcggaaggtgcgcgcgagcgtgaactgttccgtgcgcagtttatccgttcccagactggctttggcgttgagcagggccgcgcgcattaa

SEQ ID NO: 9390 - protein, 512 aa, Escherichia coli
MFLIFVVFTLGITYWASKRVRSRNDYYTAGGNITGFQNGLAIAGDYMSAASFLGISALVFTSGYDGLIYSLGFLVGWPIILFLIAERLRNLGRYTFADVASYRLKQGPIRILSACGSLVVVALYLIAQMVGAGKLIELLFGLNYHIAVVLVGVLMMMYVLFGGMLATTWVQIIKAVLLLFGASFMAFMVMKHVGFSFNNLFSEAMAVHPKGVDIMKPGGLVKDPISALSLGLGLMFGTAGLPHILMRFFTVSDAREARKSVFYATGFMGYFYILTFIIGFGAIMLVGANPEYKDAAGHLIGGNNMAAVHLANAVGGNLFLGFISAVAFATILAVVAGLTLAGASAVSHDLYANVFKKGATEREELRVSKITVLILGVIAIILGVLFENQNIAFMVGLAFAIAASCNFPIILLSMYWSKLTTRGAMLGGWLGLITAVVLMILGPTIWVQILGHEKAIFPYEYPALFSISVAFLGIWLFSATDNSAEGARERELFRAQFIRSQTGFGVEQGRAH

SEQ ID NO: 9391 - DNA, 315 bp, Escherichia coli
atgaatggtacgatttatcagcggatagaagacaatgcgcatttcagggagttagtcgaaaaacggcaacggtttgccaccatcctgtcgattattatgctggcagtttatatcggctttattttactgatcgccttcgcgcccggctggctgggcaccccgctgaatccgaacaccagcgtcacacgcggtattccagtcggtgtcggggtaattgtgatctcctttgttctcactggtatctacatctggcgggcgaacggcgaattcgaccgtcttaataacgaagtcctgcatgaggtacaagcatcatga

SEQ ID NO: 9392 - protein, 104 aa, Escherichia coli
MNGTIYQRIEDNAHFRELVEKRQRFATILSIIMLAVYIGFILLIAFAPGWLGTPLNPNTSVTRGIPVGVGVIVISFVLTGIYIWRANGEFDRLNNEVLHEVQAS

SEQ ID NO: 9393 - DNA, 1959 bp, Escherichia coli
atgagtcaaattcacaaacacaccattcctgccaacatcgcagaccgttgcctgataaaccctcagcagtacgaggcgatgtatcaacaatctattaacgcaccagataccttctggggcgaacagggaaaaattctcgactggatcacaccgtaccagaaggtgaaaaacacctcctttgcccccggtaatgtgtccattaaatggtacgaggacggcacgctgaatctggcggcaaactgccttgaccgccatctgcaagaaaacggcgatcgtaccgccatcatctgggaaggcgacgacgccagccagagcaaacatattagctataaagagctgcaccgcgacgtctgccgcttcgccaataccctgctcgaactgggcattaaaaaaggtgacgtagttgcgatttatatgccgatggtaccggaagccgcggtcgcgatgctggcctgcgcccgcattggcgcggtacattcggtgattttcggcggcttctcgccggaagccgttgccggacgcattatcgactccagttcacgactggtgatcacttccgacgaaggtgtgcgtgccgggcgtagtattccgctgaagaaaaacgttgatgacgcgctgaaaaacccgaacgtcaccagcgtagagcatgtggtggtactgaagcgtactggcggaaaaattgactggcaggaagggcgcgacctgtggtggcacgacctggttgagcaagccagcgatcagcaccaggcggaagagatgaacgccgaagatccgctgtttattctctatacctccggttctaccggtaagccaaaaggcgtgctgcacactaccggcggttatctggtgtacgcggcgctgacctttaaatatgtctttgattatcatccgggcgacatctactggtgcaccgccgatgtgggctgggttaccggacacagttatttgctgtatggcccgctggcctgcggcgcgaccacgctgatgtttgaaggcgtaccgaactggccgacgcctgcccgtatggcgcaggtggtggacaagcatcaggtcaatattctctataccgcgcccacggcgattcgcgcgctgatggcggaaggcgataaagcgatcgaaggcaccgaccgttcgtcgctgcgcattctcggttccgtgggcgagccaattaacccggaagcgtgggagtggtactggaagaagatcggcaatgagaaatgcccggtggtcgacacctggtggcagaccgaaactggcggtttcatgatcacgccactgcctggcgctaccgagctgaaagccggttcggcaacacgtccgttcttcggcgtgcaaccagcgctggtcgataacgaaggtaacccgctggagggggccaccgaaggcagtctggtgatcaccgactcctggccgggtcaggcgcgtactctgtttggcgatcacgaacgttttgagcagacctacttctccaccttcaaaaatatgtatttcagcggcgacggcgcgcgtcgcgatgaagatggctattactggatcaccgggcgcgtggacgacgtgctgaacgtctccggtcaccgcctggggacggcagagattgagtcggcgctggtggcgcatccgaaaattgccgaagccgctgtggtcggtattccgcacaatattaaaggtcaggcgatctacgcctacgtcacgcttaatcacggggaggaaccgtcaccagaactgtacgcagaagtccgcaactgggtgcgtaaagagattggcccgctggcgacgccagacgtgctgcactggaccgactccctgcctaaaacccgctccggcaaaattatgcgccgtattctgcgcaaaattgcggcgggcgataccagcaacctgggcgatacctcgacgcttgccgatcctggcgtagtcgagaagctgcttgaagagaagcaggccatcgcgatgccatcgtaa

SEQ ID NO: 9394 - protein, 652 aa, Escherichia coli
MSQIHKHTIPANIADRCLINPQQYEAMYQQSINAPDTFWGEQGKILDWITPYQKVKNTSFAPGNVSIKWYEDGTLNLAANCLDRHLQENGDRTAIIWEGDDASQSKHISYKELHRDVCRFANTLLELGIKKGDVVAIYMPMVPEAAVAMLACARIGAVHSVIFGGFSPEAVAGRIIDSSSRLVITSDEGVRAGRSIPLKKNVDDALKNPNVTSVEHVVVLKRTGGKIDWQEGRDLWWHDLVEQASDQHQAEEMNAEDPLFILYTSGSTGKPKGVLHTTGGYLVYAALTFKYVFDYHPGDIYWCTADVGWVTGHSYLLYGPLACGATTLMFEGVPNWPTPARMAQVVDKHQVNILYTAPTAIRALMAEGDKAIEGTDRSSLRILGSVGEPINPEAWEWYWKKIGNEKCPVVDTWWQTETGGFMITPLPGATELKAGSATRPFFGVQPALVDNEGNPLEGATEGSLVITDSWPGQARTLFGDHERFEQTYFSTFKNMYFSGDGARRDEDGYYWITGRVDDVLNVSGHRLGTAEIESALVAHPKIAEAAVVGIPHNIKGQAIYAYVTLNHGEEPSPELYAEVRNWVRKEIGPLATPDVLHWTDSLPKTRSGKIMRRILRKIAAGDTSNLGDTSTLADPGVVEKLLEEKQAIAMPS

SEQ ID NO: 9395 - DNA, 1437 bp, Escherichia coli
atgacaaggataaaaataaacgcacgccgtatcttcagcttattgattccttttttctttttcacttctgttcacgctgaacaaacggctgctcccgcaacacctgtaactgtggaagcgaagaatgaaacctttgccccgcagcatcccgatcaatatctctcctggaaagctacctcggaacagtcagagcgtgttgacgccctggcggaagatccacggctggtgatcctgtgggcagggtatcccttctcgcgcgattacaacaagccgcgtggacatgcctttgctgtgaccgatgtgcgtgaaaccctgcgtaccggtgcgccgaaaaacgctgaagatggtccgctaccgatggcgtgctggagttgtaaaagcccggatgtggcgcgtctgatccagaaagacggcgaagatggctacttccacggaaaatgggcgcgcggcggcccggaaatcgtcaacaacttaggttgtgccgattgccataacaccgcctcaccagagttcgccaaaggcaaaccggagttaaccctttcccgtccgtatgcggctcgcgcgatggaagccattggtaaacctttcgagaaagccggacgtttcgaccagcaatcgatggtttgcggtcagtgccatgtggagtattacttcgacggcaaaaacaaagcggttaaattcccgtgggatgacggcatgaaagtcgaaaatatggagcagtattacgacaaaattgccttctctgactggactaactccctgtcgaaaacgccaatgctgaaagcgcagcacccggaatatgaaacctggacagcgggcattcacggcaaaaacaacgtgacctgtatcgattgccatatgccaaaagtgcagaacgccgaaggcaaactctacaccgaccataaaattggtaatccgtttgataacttcgcccagacttgtgcgaactgccatacccaggacaaagctgccttgcaaaaagtggtcgcggaacgtaagcagtcgattaacgacctgaaaatcaaggttgaagatcaactggttcacgctcacttcgaagcgaaagcggcactggatgcaggcgcaacggaagccgaaatgaagccgattcaggacgatatccgtcatgcccagtggcgttgggatttggcgatcgcttcccacggcattcatatgcacgcaccggaagaaggtctgaggatgctcggtacggcgatggataaagcggcggatgcacgcaccaaactggcgcgcctgctggcgaccaaaggcataacccatgaaatccagatcccggatatctcgaccaaagagaaagcccagcaggccattggcctgaacatggagcaaatcaaggccgagaagcaggacttcatcaaaacggtgatcccgcagtgggaagagcaggcacgtaaaaacggtctgttaagccaataa

SEQ ID NO: 9396 - protein, 478 aa, Escherichia coli
MTRIKINARRIFSLLIPFFFFTSVHAEQTAAPATPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 9397 - DNA, 567 bp, Escherichia coli
atgagcgtattacgttcgttattaactgccggggtgctggcgtcgggcctgttgtggagcctgaacggaattaccgctacccctgcggcgcaggcatctggtgatcgctacgaagttacccagcagcgtaacccggatgccgcctgtctggactgtcataagccagataccgaaggtatgcatggcaaacatgcttccgttatcaacccgaataacaaactgccggtcacctgcaccaactgccacggtcagccatcaccgcaacaccgcgaaggggtgaaagatgtgatgcgctttaacgagccgatgtacaaggttggagagcagaacagcgtctgtatgtcctgccatctgccggaacagttgcaaaaagcgttctggccgcacgatgtccacgtaaccaaagtggcgtgcgccagctgccattccctgcatccacagcaagatacgatgcagacgttaagtgacaaaggacggattaagatttgcgtcgattgccacagcgatcaacgcaccaatccgaactttaacccggcgtctgttccgttgcttaaggagcagccatga

SEQ ID NO: 9398 - protein, 188 aa, Escherichia coli
MSVLRSLLTAGVLASGLLWSLNGITATPAAQASGDRYEVTQQRNPDAACLDCHKPDTEGMHGKHASVINPNNKLPVTCTNCHGQPSPQHREGVKDVMRFNEPMYKVGEQNSVCMSCHLPEQLQKAFWPHDVHVTKVACASCHSLHPQQDTMQTLSDKGRIKICVDCHSDQRTNPNFNPASVPLLKEQP

SEQ ID NO: 9399 - DNA, 672 bp, Escherichia coli
atgacctggtcacgtcgccagtttctcaccggcgtcggtgtgctggccgccgtcagcggcaccgcaggacgcgtggtggcgaaaacgttgaatatcaatggtgtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgatgtctgcccgaccggtgcgtcttttcgcgacgctgccagtgggattgtcgatgttaatccggatctctgcgtcggttgtcagtactgcatcgccgcctgtccgtaccgcgtgcgctttatccatccggtcacgaagacggcggacaaatgcgatttctgccgtaagacccatttgcaggccggtaagctgcccgcgtgcgttgaggcttgcccgacgaaggcgctgacgtttggcaatctggacgatcccagcagtgagatttcgcaactgctgcgccagaagcccacttaccgctacaagctggcgctgggaaccaaaccgaagctgtaccgcgtaccgtttaaatacggggaggtgagccaatga

SEQ ID NO: 9400 - protein, 223 aa, Escherichia coli
MTWSRRQFLTGVGVLAAVSGTAGRVVAKTLNINGVRYGMVHDESLCIGCTACMDACREVNKVPEGVSRLTIIRSEPQGEFPDVKYRFFRKSCQHCDHAPCVDVCPTGASFRDAASGIVDVNPDLCVGCQYCIAACPYRVRFIHPVTKTADKCDFCRKTHLQAGKLPACVEACPTKALTFGNLDDPSSEISQLLRQKPTYRYKLALGTKPKLYRVPFKYGEVSQ

SEQ ID NO: 9401 - DNA, 957 bp, Escherichia coli
atgacgcagacttccgcatttcattttgaatcgctggtgtgggactggccgattgccatctacctgtttttgattggtatttctgccggtctggtgacgctggccgtactgttacgtcgtgtctacccgcaggcgggcggtgcagacagtacgttgctgcgcaccacgctgattgtcgggcctggcgcggtgatcctcggtctgttgatcctcgtcttccacctgacaagaccgtggaccttctggaagctgatgttccactacagttttacctcggtgatgtcgatgggggtgatgctgtttcagctttacatggtggtgctggtgctgtggctggcgaaaatctttgaacatgatttgcttgccctgcaacaacgctggttgccgaagctggggatcgtgcaaaaggtcttgagcctgctgacgcccgttcatcgcggactggaaacattgatgctggtgctggcggtgttgttgggggcttataccggctttctgctgtcggcgctgaaatcgtatccgttcctcaataacccgatcctgccggtgctgttcctcttctccggcatctcgtccggtgcggcggtggcgctgatcgccatggcgatacgccaacgcagtaacccgcattccacggaagcgcactttgtacaccgtatggaaatccccgtggtatggggtgaaatcttcctgctggtggcgttttttgtcggtctggcgctgggcgatgacggtaaagtgcgtgcgctggtggcggcattgggcggcggtttctggacatggtggttctggcttggtgtcgccgggctggggctgattgtgccaatgttgctcaaaccgtgggtcaatcgcagttccggcattcctgccgtgctggctgcgtgtggggccagcctagtcggcgtgttgatgctgcgctttttcattctctacgccgggcagttgacggtggcgtaa

SEQ ID NO: 9402 - protein, 318 aa, Escherichia coli
MTQTSAFHFESLVWDWPIAIYLFLIGISAGLVTLAVLLRRVYPQAGGADSTLLRTTLIVGPGAVILGLLILVFHLTRPWTFWKLMFHYSFTSVMSMGVMLFQLYMVVLVLWLAKIFEHDLLALQQRWLPKLGIVQKVLSLLTPVHRGLETLMLVLAVLLGAYTGFLLSALKSYPFLNNPILPVLFLFSGISSGAAVALIAMAIRQRSNPHSTEAHFVHRMEIPVVWGEIFLLVAFFVGLALGDDGKVRALVAALGGGFWTWWFWLGVAGLGLIVPMLLKPWVNRSSGIPAVLAACGASLVGVLMLRFFILYAGQLTVA

SEQ ID NO: 9403 - DNA, 1554 bp, Escherichia coli
atgatgcgactcacttgcatcggcattctggcgcagttcgcgctcctgctgctcgcctttggcgtactgacgtattgttttctcatcagcgatttctcggtcatttatgtcgcccaacatagctatagcctgctgtcgtgggaactcaaactggcggcggtgtggggcggtcatgaaggttcgctgctgctttgggtgctgctgctttccgcctggagcgtgctgtttgcctggcattatcgacagcaaaccgatccgctatttccgctcacgttaacggttttatcgctgatacttgccgcactgctgctgtttgttgtcggatggtccgatccttttgtgaggatatttccgcccgcaatagaagggcgcgatctcaatccgatgctgcaacatcccggtcttatctttcatccaccgctgctttatctcggctacggcggtttgatggtggcggcgagcgtggcgctggcgagtttactgcgcggcgagtttggtggtacctgcgcccgaatttgctggcgttgggcactacctggctggagcgcattaacagcggggatcatcctcggttcctggtgggcctattgcgaactgggctggggcggctggtggttctgggatccggtggaaaacgcgtcgttattaccctggctttctgccacagcgctgctgcacagtttatccctgacacgccagcgggggattttccgccactggtcgctgttgctggcgatagtaactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcgtttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttgctctgttgatgctggtggtgattgtgctggcgacgtttgtctctggcaaacgtgctcagcttccggcgctgctggcgcatgcgggcgtgctgttatttgccgcggggatcgtggtttccagcgtcagccgtcaggagatcagcctgaatttacagccgggtcagcaggtgacgctggcaggatacaccttccgttttgagcgcctcgatctgcaagccaaaggcaattacaccagtgaaaaagcgatagtggcactgtttgaccatcagcaacgcattggtgaattaacgccggagcggcgtttttacgaagcacgtcgtcagcaaatgatggaaccgtcaattcgctggaatggcatccatgactggtatgcggtcatgggcgagaaaaccggagcggatcgttacgcttttcgtttgtatgtacaaagcggtgtgcgctggatctggggggaggattgttga

SEQ ID NO: 9404 - protein, 517 aa, Escherichia coli
MMRLTCIGILAQFALLLLAFGVLTYCFLISDFSVIYVAQHSYSLLSWELKLAAVWGGHEGSLLLWVLLLSAWSVLFAWHYRQQTDPLFPLTLTVLSLILAALLLFVVGWSDPFVRIFPPAIEGRDLNPMLQHPGLIFHPPLLYLGYGGLMVAASVALASLLRGEFGGTCARICWRWALPGWSALTAGIILGSWWAYCELGWGGWWFWDPVENASLLPWLSATALLHSLSLTRQRGIFRHWSLLLAIVTLMLSLLGTLIVRSGILVSVHAFALDNVRAVPLFSLFALISLASLALYGWRARDGGPAVRFSGLSREMLILATLLLFCAVLLIVLVGTLYPMIYGLLGWGRLSVGAPYFNRATLPFALLMLVVIVLATFVSGKRAQLPALLAHAGVLLFAAGIVVSSVSRQEISLNLQPGQQVTLAGYTFRFERLDLQAKGNYTSEKAIVALFDHQQRIGELTPERRFYEARRQQMMEPSIRWNGIHDWYAVMGEKTGADRYAFRLYVQSGVRWIWGEDC

SEQ ID NO: 9405 - DNA, 384 bp, Escherichia coli
atgaataaagggcttctcacgctactgctgttatttacctgttttgcgcgcgctcaggttgtagacacctggcaattcgccaatccgcaacaacagcaacaggcgttaaatattgccagccagttacgttgtccgcagtgccagaatcagaacttactggaatccaatgcgccggtggcagtcagtatgcgccatcaggtttacaccatggtggaagaggggaaaagtgaagtcgaaatcattgactggatgaccgaacgctacggagattttgttcgctataacccaccgttaacgggtcagacgctggtgttgtgggcgctgccagtagtgttgttactgctgatggcactgatcctctggcgagtgagggcgaagcgatga

SEQ ID NO: 9406 - protein, 127 aa, Escherichia coli
MNKGLLTLLLLFTCFARAQVVDTWQFANPQQQQQALNIASQLRCPQCQNQNLLESNAPVAVSMRHQVYTMVEEGKSEVEIIDWMTERYGDFVRYNPPLTGQTLVLWALPVVLLLLMALILWRVRAKR

SEQ ID NO: 9407 - DNA, 597 bp, Escherichia coli
atgaaacagccccaaataccggtgaaaatgctgacaacactcacgattttgatggtatttctctgtgtcggcagttatctgttaagtccaaaatggcaggctgtacgtacggagtatcagcgtcagcgcgatccgctgcatcagtttgccagccagcaaaccccggaagcgcagcttcaggcattgcaggataaaatccgtgctaatccacaaaacagcgaacagtgggcgttactgggcgagtattatctgtggcaaaacgattacagcaattcgctgctggcgtaccgtcaggcgttgcaactacgtggtgagaacgctgaactgtatgcggcgctggcgacggtgctgtattaccaggccagccaacatatgaccgtccagactcgcgcaatgatcgacagagccctcgcgctggactctaacgaaatcaccgctctgatgctgctggcttccgatgcgtttatgcaggcgaactacgcgcaagccatcgaactatggcaaaaagtgatggatctcaactcaccccggatcaaccggacacagctggtcgagtcgattaatatggcgaaattgttgcagcggagatcagattaa

SEQ ID NO: 9408 - protein, 198 aa, Escherichia coli
MKQPQIPVKMLTTLTILMVFLCVGSYLLSPKWQAVRTEYQRQRDPLHQFASQQTPEAQLQALQDKIRANPQNSEQWALLGEYYLWQNDYSNSLLAYRQALQLRGENAELYAALATVLYYQASQHMTVQTRAMIDRALALDSNEITALMLLASDAFMQANYAQAIELWQKVMDLNSPRINRTQLVESINMAKLLQRRSD

SEQ ID NO: 9409 - DNA, 132 bp, Escherichia coli
gtgttgcgttggtttgtagatttttttaacgcttatgatcagtatcatttgcgcggtatgttgcgcaaccctttaacaacagagcttttcgctgcattaatgcataataacgcgagtttatggcaggattaa

SEQ ID NO: 9410 - protein, 43 aa, Escherichia coli
MLRWFVDFFNAYDQYHLRGMLRNPLTTELFAALMHNNASLWQD

SEQ ID NO: 9411 - DNA, 1314 bp, Escherichia coli
atgaaaaatataaaattcagcctggcctggcagattctgtttgctatggtgctgggcattctcctgggaagctacctgcaccaccatagcgacagccgcgactggctggtcgtcaatttgctctctccggcgggtgatatcttcatccatctgatcaaaatgattgttgtgccgattgtgatctccacactggtggtgggtatcgcgggtgttggtgatgccaaacagctcgggcgtattggtgcgaaaaccattatctacttcgaggtgatcaccaccgtcgccatcattttggggatcactctggcgaacgtcttccagcccggtgccggggtggatatgtcgcagctggcgaccgtcgatatctcgaaatatcagagcactacggaagcggtacaaagcagttcccacggcattatgggcacgattttgtcgctggtgccgacgaacatcgtggcgtcgatggcgaaaggcgaaatgctgccgatcatcttcttctcggtgctgtttggtctggggctttcatccctgcccgcgacgcatcgtgaaccgctggtgacagttttccgctccatctctgaaaccatgtttaaagtgactcacatggtgatgcgttatgcgccggtgggtgtgtttgcgctgattgcggtgacggtggctaactttggtttctcgtctctgtggccactggcgaaactggtgctgctggtgcatttcgccattctgttcttcgcgctggtagtgctgggaattgtggcgcgcctgtgcgggttaagcgtctggatcctgattcgtattctgaaagatgagctgattctggcgtactccactgccagctctgaaagcgtgctgccgcgaattattgagaagatggaagcctacggagcaccggcgtcgatcaccagtttcgtggtgccgaccggttactcttttaaccttgatggttcgacgctgtatcaaagtattgccgctattttcatcgctcagctgtatggcattgacctgtccatctggcaggaaatcattctggtgctgacgctgatggtgacctcgaaagggattgctggcgtgccgggcgtgtcgtttgtggtgttgctggcaacgctgggcagcgtagggatcccgctggaaggtctggcgtttattgccggtgttgaccgtatcctcgacatggcgcgtactgcgctgaacgtggtgggtaatgcgctggcggtgctggtgattgccaaatgggaacacaaatttgaccgtaagaaagcgctggcttatgagcgtgaagtactgggcaaatttgataaaactgcggatcagtaa

SEQ ID NO: 9412 - protein, 437 aa, Escherichia coli
MKNIKFSLAWQILFAMVLGILLGSYLHHHSDSRDWLVVNLLSPAGDIFIHLIKMIVVPIVISTLVVGIAGVGDAKQLGRIGAKTIIYFEVITTVAIILGITLANVFQPGAGVDMSQLATVDISKYQSTTEAVQSSSHGIMGTILSLVPTNIVASMAKGEMLPIIFFSVLFGLGLSSLPATHREPLVTVFRSISETMFKVTHMVMRYAPVGVFALIAVTVANFGFSSLWPLAKLVLLVHFAILFFALVVLGIVARLCGLSVWILIRILKDELILAYSTASSESVLPRIIEKMEAYGAPASITSFVVPTGYSFNLDGSTLYQSIAAIFIAQLYGIDLSIWQEIILVLTLMVTSKGIAGVPGVSFVVLLATLGSVGIPLEGLAFIAGVDRILDMARTALNVVGNALAVLVIAKWEHKFDRKKALAYEREVLGKFDKTADQ

SEQ ID NO: 9413 - DNA, 744 bp, Escherichia coli
ttgtccacccgaacactttatactgtctctcccctaccaaacttcattatcaaaatgaaaaaaattatcactttgatgttgtttttgacattctttgcccacgcgaacgactccgagcctggcagccagtatttaaaggcagcagaggccggagaccgacgcgcacaatattttcttgccgacagctggtttagctccggcgatttgagcaaagccgaatattgggcacagaaagccgccgacagcggtgatgccgatgcctgtgcgctgttggcgcagatcaaaatcaccaatccggtcagtctggactatccacaagcaaaagtgcttgccgagaaagcagcgcaagcgggcagtaaagaaggtgaagtaacgctggcgcatattctggtaaatacgcaagcgggtaaaccggattatccaaaggcgatttcgctgttagaaaacgcctcggaagatctggagaacgactctgccgtcgatgcccaaatgctgcttggtttgatttacgccaacggcgtgggcattaaggccgacgatgacaaagcaacctggtatttcaagcgtagctccgcgatttcccgaaccggttattccgaatactgggcgggaatgatgttcttaaacggtgaagagggttttatcgagaagaataaacaaaaggcgctgcactggttgaatctgagctgtatggaaggatttgataccggttgtgaagagtttgaaaaattaactaacggttaa

SEQ ID NO: 9414 - protein, 247 aa, Escherichia coli
MSTRTLYTVSPLPNFIIKMKKIITLMLFLTFFAHANDSEPGSQYLKAAEAGDRRAQYFLADSWFSSGDLSKAEYWAQKAADSGDADACALLAQIKITNPVSLDYPQAKVLAEKAAQAGSKEGEVTLAHILVNTQAGKPDYPKAISLLENASEDLENDSAVDAQMLLGLIYANGVGIKADDDKATWYFKRSSAISRTGYSEYWAGMMFLNGEEGFIEKNKQKALHWLNLSCMEGFDTGCEEFEKLTNG

SEQ ID NO: 9415 - DNA, 705 bp, Escherichia coli
atgacgattgttgaaattaatcacttacaggtgacttttgctgagaaaaccgcagtttctgccgccagtttttcggttaatgccggagagacatttagtttaattggcgaatcaagctgcggaaaatccacgattttgcgcgtaattgctggattacagcgcgactggcacggtcaggtgtcactgtttgggcacaccatcaaaccaggaatgcgttttcaaggcgatctccgccgcaatgtgcaaatggtgtttcaggatccctatgcctcgttgcatcccaatcatactctgtggcgaacgctggctgaaccactcaaaattcgtggcgaaagagaaatagaaaaacgcgtccagactgcactggaacaggttggcttgcctttcgacgccgctcgtcgctacccacaccagctttccggtggtcaacggcaacgtgtggttattgctcgcgccctgttgttacgaccacaacttcttctgctggatgaacccacctcggcgttggatatgtcggtacaagcggaaatccttaatttgttgaatcaacttaagctggaacaccaaatgacatatctgctggtcagtcacgatgccgatgtcatcgcgcatatgtctgatcgagcggcattgatgtccgagggaaaaattcagcgattttttgatcgcgacgccatggaaaagggggaacatcggatggattaa

SEQ ID NO: 9416 - protein, 234 aa, Escherichia coli
MTIVEINHLQVTFAEKTAVSAASFSVNAGETFSLIGESSCGKSTILRVIAGLQRDWHGQVSLFGHTIKPGMRFQGDLRRNVQMVFQDPYASLHPNHTLWRTLAEPLKIRGEREIEKRVQTALEQVGLPFDAARRYPHQLSGGQRQRVVIARALLLRPQLLLLDEPTSALDMSVQAEILNLLNQLKLEHQMTYLLVSHDADVIAHMSDRAALMSEGKIQRFFDRDAMEKGEHRMD

SEQ ID NO: 9417 - DNA, 837 bp, Escherichia coli
atgactgactcacgtcttagtatcaacaatctctgcgtcgattatccggagtcccgggtcgtcaacaatgtcagttttacattaggcaatgaacgtctggcgctggtcggtgagtcgggttcaggtaagtccatgaccgcccgcgccctgatggggctggtgcgtaaaccgggtgtagtaaccgcggacacacttaacattctggggcgtgatgcactcacccttaacgcgcgtggatggcaacagttgcgcggtaacgatatcgcgatggtattgcaagatccgcgttacgcgcttaatccagtaaagacagtaaaagcgcaactggaagaggcgcttacgctccatcaacgtctgaaccgccgcgagaaagaagagaaaataaacaccgcaattcaggctgtcggcctcaatacgcgagtactgcaaagctatcctcgtgaactttctggcggcatggggcagcgagtgatgattgcaattgcgctcatcaacgatccccgggtattgattgccgatgagccaacatcagcactggatgtgcgcctgcgtaatcagattctggaactgctggttacccagtgtgaacaacgtcagatggcaatgttgctgatcagtcacgacctgccattagttgcccaattttgccatcgggtgctggtgatgtatcagggaaataaggtggatgaaatgcacgctgctgcgctacctacagcaacgcatccttacacgcgcacactgtggacttgccgcccaaatgcacaaacttacgggcagatgctgccgacgctggacaggacggcaatgacgccggagaaataccatgacgattgttga

SEQ ID NO: 9418 - protein, 278 aa, Escherichia coli
MTDSRLSINNLCVDYPESRVVNNVSFTLGNERLALVGESGSGKSMTARALMGLVRKPGVVTADTLNILGRDALTLNARGWQQLRGNDIAMVLQDPRYALNPVKTVKAQLEEALTLHQRLNRREKEEKINTAIQAVGLNTRVLQSYPRELSGGMGQRVMIAIALINDPRVLIADEPTSALDVRLRNQILELLVTQCEQRQMAMLLISHDLPLVAQFCHRVLVMYQGNKVDEMHAAALPTATHPYTRTLWTCRPNAQTYGQMLPTLDRTAMTPEKYHDDC

SEQ ID NO: 9419 - DNA, 834 bp, Escherichia coli
atgccgatgtttctctttttacgccgtttacgccattcacccgccgcgttttgcgggttgataattatcctgttattaatgctaattgcgctcttcgcgccgtggctggcacctcacgatcctaactggcaggatgcggcggcgcggttacaagcaccgagtcgtcagcactggctcggcactgacagttacggacgagacctactttcacgtttaatctacggcagccgcccggcactggggctggtggcattggtgacaatcattacactcccggtcggtctgctgattggcattttagccgggtactacggcggctggctggaacgcgtgctgatgcgttttactgacgtagtaatgtcaatgccgcgtttaattctggcttttgcttttgttgccatgctggggccggggctggttaacggcgcactggccctggcattaaccacctggcctgcttatgcgcgtcaggcacggagtgagatccaacgtctgcgacacagtgattatcttgccgccgcagaaatgatgggcatccgcggcaggcgtctgctggctggtcatattttaccattgtgcctgccatctgccattgtccgtctggcactggatttagcgggtatcattctggcggctgctggcctgggttttcttgggcttggtgctcgcccgccaatggcggaatggggagccatgatcgccgacggtatgcaggtcatttttgatcaatggtggattgccgccgctcccggcgcaattatcttaattgccagtctggcctttaatctgctgggtgatggcttgcgcgatgttctggagcctcaacatgactga

SEQ ID NO: 9420 - protein, 277 aa, Escherichia coli
MPMFLFLRRLRHSPAAFCGLIIILLLMLIALFAPWLAPHDPNWQDAAARLQAPSRQHWLGTDSYGRDLLSRLIYGSRPALGLVALVTIITLPVGLLIGILAGYYGGWLERVLMRFTDVVMSMPRLILAFAFVAMLGPGLVNGALALALTTWPAYARQARSEIQRLRHSDYLAAAEMMGIRGRRLLAGHILPLCLPSAIVRLALDLAGIILAAAGLGFLGLGARPPMAEWGAMIADGMQVIFDQWWIAAAPGAIILIASLAFNLLGDGLRDVLEPQHD

SEQ ID NO: 9421 - DNA, 1143 bp, Escherichia coli
atgcaactcgcgtccagccctgttaccgggcgcggtaccagggctggcctgtattgcaggccagccgctgatttatcactgtatggaaagatcatgtctgtcgttttttccactcgcgcgagatggcgaggcaagcgccctctgctcgcgctgttgcaagggctgtttaccgttgctctgacgctactcggcctgctgctgattacctttgcgctttcggctctctcaccggtcgatcgcgtactacaaatcgttggcgatcacgccagccagtccacctatgatcaggtacgccaccagttaggattggatcagccgttagccgtccagttctggcattacctgatgaatctggcacacggcgatctgggcatcgccagctccaccgggcaaccggtactccaggacttgctatcagtattcccggcgaccattgaactggcaacgttggcgcttattgtcggtgctgttgtcggcgtcattgcgggtgtactttgcgcccgttatgtcggttctccgctggatttcaccgtgcgaacattaactctactgggaaattccgtccctgttttttggcttggtctgctgatgctggcgctgttctacgccagactgcaatggagtgccgggccgggcaggctggatgatatttatcaattcaccatagaaccccgcagcggatttgcgctgattgatacgtggctttctggcgatcgcgaggcatttaccaatgcaatcaaccatttgatacttccggttttattactggcgtacttctcgctcgccagtattacgcgcctgactcgttccgcctgtcttggcgaaatgaataaagaatatattctgctggcgcgcgccaaaggggccagcgagatgacaattttgctacgtcatgttttacccaacattcgcggcaccttgctcaccgttatcgccctcgcctatacatcaatgctggaaggcgcggtactgacagaaaccgtcttttcatggccaggtattgggcgctacctcactacagcgctcttcgcgggtgataccacagcaatcatgggaggaacgctgctgattggcgtctgctttgtgttgataaataacttaaccgacctgctggtccggctgaccgatccgaggttacgctga

SEQ ID NO: 9422 - protein, 380 aa, Escherichia coli
MQLASSPVTGRGTRAGLYCRPAADLSLYGKIMSVVFSTRARWRGKRPLLALLQGLFTVALTLLGLLLITFALSALSPVDRVLQIVGDHASQSTYDQVRHQLGLDQPLAVQFWHYLMNLAHGDLGIASSTGQPVLQDLLSVFPATIELATLALIVGAVVGVIAGVLCARYVGSPLDFTVRTLTLLGNSVPVFWLGLLMLALFYARLQWSAGPGRLDDIYQFTIEPRSGFALIDTWLSGDREAFTNAINHLILPVLLLAYFSLASITRLTRSACLGEMNKEYILLARAKGASEMTILLRHVLPNIRGTLLTVIALAYTSMLEGAVLTETVFSWPGIGRYLTTALFAGDTTAIMGGTLLIGVCFVLINNLTDLLVRLTDPRLR

SEQ ID NO: 9423 - DNA, 1569 bp, Escherichia coli
atgattaaaaaactattacctttactggttttaagcacaatttccgccacaaccgttgccgctacaccgcctaatacgttggttgtagcccagggactggatgatattgtgagtctggacccggcagaagctaatgaactctcaagtattcagactgtaccaagtctgtatcaacgcgtagtacaaccggaccgtaatgatccgacgaaaatcactccgattctggcggaaagttggcaggctgaccccgcagccaaaacgctaaccataaaactgaaaagcgatgcgaaatttgcctctggtaatccggtacgcccggaagatgtgatttactcttatgtccgggctgtcacactgaataaatccggtgcgtttattctcaatgtgctgggatggcagccggaaaatatcgccagccagttgaagaaaatcgatgaccataccgtccaggtgcaatggagtgccgacgtcagcccggcgctggcactgaatattctctccacaccaatcgcctcaattgttgacgagaagctggttgcgccaaacgccaaaaataacgactttggtaatgaatggctgaagatgcattccgctggcagcggcgcgtttaaaatgcgtacttaccaaccgcatcaggccatcgtgatggaagccaacgccagctcaccaaccggcgccccgaaactgaaaaacgtcatcatcaaaaatgttcccgatccggcaacgcgtcgcctgctgatccaacaaggtgatgctgatatggctcgtgatctgggagccgatcaaatcgatgcattacagggtaaacctggcgtaaaagtgatgagcattgcctccgccgaacagaactacctggccttcaataccggtaacaaggataacccgctgatgagtaatcctgcgttctgggaggccgctcgctggttggtcgattacgacggcatcaccaaaaatctcttaaaaggacaatattttacccatcaaagtttcctgcccgtgggctttcctggagcactggaagaaacaccgtttacctttaatccagccaaagcaaaagagatcctcgctaaagccggaatcaaagacccgcacttcacgcttgatgtcgaaaataaaccgccatttattaccatcgcgcagtcaattcaggccagctttgctcagggcggtgtaaaagttgatttgctgccagccgcagggagtcaggtctactctcgcgttcgcgcccaccagcatcagggggccattcgtatgtggttgcctgattattttgacgcacattccaacgccagctctttcgcctataacgatggcaaatccagcaccgttgccgggttaaacggctggaaaatcccggaactgaacaaagaaacgctggcggccatcgctgaacctgatagcactaaacgtcttgatttgtataagaaaatgcaacaagaactacaacgtagttccccgtatgtctttattgatcaaggcaaaacgcaaattgtcatgcgtgataatgtgcaggggtatcaacaagggttgaatgccgatatggtctggtttgatcaggtaaccaaataa

SEQ ID NO: 9424 - protein, 522 aa, Escherichia coli
MIKKLLPLLVLSTISATTVAATPPNTLVVAQGLDDIVSLDPAEANELSSIQTVPSLYQRVVQPDRNDPTKITPILAESWQADPAAKTLTIKLKSDAKFASGNPVRPEDVIYSYVRAVTLNKSGAFILNVLGWQPENIASQLKKIDDHTVQVQWSADVSPALALNILSTPIASIVDEKLVAPNAKNNDFGNEWLKMHSAGSGAFKMRTYQPHQAIVMEANASSPTGAPKLKNVIIKNVPDPATRRLLIQQGDADMARDLGADQIDALQGKPGVKVMSIASAEQNYLAFNTGNKDNPLMSNPAFWEAARWLVDYDGITKNLLKGQYFTHQSFLPVGFPGALEETPFTFNPAKAKEILAKAGIKDPHFTLDVENKPPFITIAQSIQASFAQGGVKVDLLPAAGSQVYSRVRAHQHQGAIRMWLPDYFDAHSNASSFAYNDGKSSTVAGLNGWKIPELNKETLAAIAEPDSTKRLDLYKKMQQELQRSSPYVFIDQGKTQIVMRDNVQGYQQGLNADMVWFDQVTK

SEQ ID NO: 9425 - DNA, 1680 bp, Escherichia coli
atgagcaatgctattaacgaaattgataataccgatttagtgttcgttttcgggtataacccggcggattcccacccaatcgtggcgaatcacgtaattaacgctaaacgtaacggggcgaaaattatcgtctgcgatccgcgtaaaattgaaaccgcgcgcattgctgacatgcacattgcattgaaaaacggctcgaacatcgcgctgttgaatgcgatgggccatgtcattattgaagaaaatctgtacgacaaagcgttcgtcgcttcccgtacagaaggctttgaagagtatcgtaaaatcgttgaaggctacacgccggagtcggttgaagatatcaccggcgtcagcgccagtgagattcgtcaggcggcgcggatgtatgcccaggcggaaagcgccgccatcctgtggggcatgggggtaacccagttctatcagggcgtggaaaccgtgcgttctctgaccagcctcgcgatgctgaccggtaacctcggtaagccacatgcgggtgtaaacccggttcgtggtcagaacaacgtgcagggtgcctgcgatatgggcgcgctgccggatacgtatccaggctatcagtacgtgaaagatccggctaaccgcgagaaatttgccaaagcctggggcgtggaaagcctgcctgctcataccggttatcgtatcagcgagctgccgcaccgcgtggcgcatggtgaagtgagagcggcgtacattatgggcgaagatccgctgcaaactgacgcggaactgtcggcagtacgtaaagcctttgaagatctggaactggttatcgttcaggacatctttatgaccaaaaccgcgtcggcggcggatgtcattttaccgtcaacgtcgtggggcgagcatgaaggcgtgtttactgcggctgaccgtggcttccagcgtttcttcaaggcggttgagccgaagtgggatctgaaaacggactggcaaatcatcagtgaaattgccactcgtatgggttatccgatgcactacaacaacacccaggagatctgggacgagttgcgtcatctgtgcccggatttctacggtgcgacttacgagaaaatgggcgaactgggcttcattcagtggccttgccgcgatacttcagatgccgatcaggggacttcttatctgtttaaagagaagtttgataccccgaacggtctggcgcagttcttcacctgcgactgggtagcgccaatcgacaaactcaccgacgagtacccgatggtactgtcaacggtgcgtgaagttggtcactactcttgccgttcgatgaccggtaactgtgcggcactggcggcgctggctgatgaacctggctacgcacaaatcaataccgaagacgccaaacgtctgggtattgaagatgaggcattggtttgggtgcactcgcgtaaaggcaaaattatcacccgtgcgcaggtcagcgatcgtccgaacaaaggggcgatttacatgacctaccagtggtggattggtgcctgtaacgagctggtgaccgaaaacttaagcccgattacgaaaacgccggaatacaaatactgcgccgtgcgcgtcgagccgatcgccgatcagcgcgccgccgagcagtacgtgattgacgagtacaacaagttgaaaactcgcctgcgcgaagcggcactggcgtaa

SEQ ID NO: 9426 - protein, 559 aa, Escherichia coli
MSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAESAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRVAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 9427 - DNA, 420 bp, Escherichia coli
atgaaaaaagtcgtcacggtttgcccctattgcgcatcaggttgcaaaatcaacctggtcgtcgataacggcaaaatcgtccgggcggaggcagcgcaggggaaaaccaaccagggtaccctgtgtctgaagggttattatggctgggacttcattaacgatacccagatcctgaccccgcgcctgaaaacccccatgatccgtcgccagcgtggcggcaaactcgaacctgtttcctgggatgaggcactgaattacgttgccgagcgcctgagcgccatcaaagagaagtacggtccggatgccatccagacgaccggctcctcgcgcggtacgggtaacgaaaccaactatgtaatgcaaaaatttgcgcgcgccgttattggtaccaataacgttgactgctgcgctcgtgtctga

SEQ ID NO: 9428 - protein, 139 aa, Escherichia coli
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARV

SEQ ID NO: 9429 - DNA, 1467 bp, Escherichia coli
atgatcaatcgtcaactttcacgtctgctgttgtgcagcattctcggcagcacgacgctgatttccggctgtgccctggtacgtaaggattctgcgcctcatcaacagctcaaaccggaacaaatcaaactggccgatgatattcatcttgccagctccggctggccgcaggcgcagtggtggaaacaactcaatgacccgcagctggatgcgctgatccaacggacgctaagtggttcacacaccctcgccgaagcgaaactgcgggaagaaaaagcgcagtcccaggccgatttgttagatgccggttcacaattacaggtcgcagcgttagggatgctcaaccgccaacgcgtctcggcgaacggctttttaagcccttatgcgatggatgcgccagcactgggtatggacgggccgtactatacggaagccacagtcggtttgtttgccggactggatctcgatttgtggggtgtgcatcgctcagcggttgctgccgccattggcgcgcataatgccgcgctggcagaaaccgcagcagtagagctatcgctgaccacgggcgtagcgcagctttattacagtatgcaggccagctatcagatgctcgatctgttagaacaaactcgcgatgtgattgattacgcggtgaaagcgcaccagagtaaagtggcgcacggtctggaagcgcaagtgcctttccacggcgcgcgggcacagattctggcggtcgataaacaaattgctgccgtcaaagggcaaatcactgaaacgcgagaatctctgcgtgcattgattggcgcgggagccagcgatatgccggagatcaaaccggtggcattaccacgagtacagaccggcattccggcaacgctctcttatgagttgctcgccagacgcccggatctgcaagccatgcgctggtatgttcaggcgtcattagatcaggtggattccgcgcgggcgctgttctacccgagctttgatatcaaagcgtttttcggtctggactccatccacctggataccttattcaaaaaaaccagtcgccagttcaacttcatcccgggtctgaaattgccgctgtttgacggtggacggttgaatgccaatctcgaaggcactcgcgccgccagcaacatgatgattgaacgttacaaccagtcagtactgaacgcggtgcgtgacgttgccgtcaacggcacacgtctgcaaacgctcaacgacgagcgagagatgcaggctgaacgcgtagaagcaacgcgcttcacccagcgcgcagccgaggccgcctatcagcgcggcttaaccagccgcttacaggccaccgaagcccggttgccagtgcttgccgaagagatgtcattactgatgctggacagccgccgggtgatccaaagcattcagttgatgaaatcgctgggcggcgggtatcaggcggctcccatcgtcgagaaaaaataa

SEQ ID NO: 9430 - protein, 488 aa, Escherichia coli
MINRQLSRLLLCSILGSTTLISGCALVRKDSAPHQQLKPEQIKLADDIHLASSGWPQAQWWKQLNDPQLDALIQRTLSGSHTLAEAKLREEKAQSQADLLDAGSQLQVAALGMLNRQRVSANGFLSPYAMDAPALGMDGPYYTEATVGLFAGLDLDLWGVHRSAVAAAIGAHNAALAETAAVELSLTTGVAQLYYSMQASYQMLDLLEQTRDVIDYAVKAHQSKVAHGLEAQVPFHGARAQILAVDKQIAAVKGQITETRESLRALIGAGASDMPEIKPVALPRVQTGIPATLSYELLARRPDLQAMRWYVQASLDQVDSARALFYPSFDIKAFFGLDSIHLDTLFKKTSRQFNFIPGLKLPLFDGGRLNANLEGTRAASNMMIERYNQSVLNAVRDVAVNGTRLQTLNDEREMQAERVEATRFTQRAAEAAYQRGLTSRLQATEARLPVLAEEMSLLMLDSRRVIQSIQLMKSLGGGYQAAPIVEKK

SEQ ID NO: 9431 - DNA, 2052 bp, Escherichia coli
atgagcgcgctcaactccctgccattaccggtggtcaggctgctggcgttctttcatgaagagttaagcgagcggcgaccagggcgcgtgccacagactatgcaactctgggtaggctgcctgctggtgattctgatctcgatgacttttgagatcccttttgtggcgttatcactggcagtgctgttttacggtattcagtcgaacgcgttttacaccaaatttgtcgcgatcttgtttgtggttgccacggtgctggagatcggcagcctgtttttgatctacaaatggtcatatggcgaaccgttgatccgattgatcatcgccgggccgatcctgatgggctgcatgtttttgatgcgcacccatcggctgggactggtctttttcgccgtcgccattgtcgctatttacgggcaaaccttccccgccatgctcgactatccggaagtggtcgtgcgcttaacgctgtggtgtatcgttgttggcctctatccaaccttgctgatgacgttaatcggcgtgctgtggtttcccagtcgtgccattacgcagatgcatcaggcgcttaatgatcggcttgatgatgccattagccacctgacggacagcctcgcaccgctacccgaaacgcggattgaaagagaggcgctggcgctgcaaaaactcaatgtcttttgcctcgcggatgatgccaactggcgaacccagagcgcatggtggcaaagctgcgtggcaacggtaacctacatttactcgacgctgaatcgctacgatcccacctcttttgctgattctcaggcaattattgaatttcggcaaaaattagtctcagaaatcaacaagctgcaacataccattgccgaaggtcagtgctggcaaagcgactggcggatcagtgaaagtgaagcgatggcggcacgggaatgtaacctggagaatatctgccagacgctgttacagcttggtcagatggacccgaatacgccgccaacgcccgcagccaaaccgccatcaatggtcgccgatgcttttaccaatccagactatatgcgctacgcggtaaaaacgctgctcgcctgtttgatctgttacaccttctacagcggcgtggactgggaaggcattcacacctgtatgctgacctgcgtgatcgtcgctaatccaaatgtcggttcgtcgtaccagaagatggtgctgcgttttggtggggccttttgcggcgcgattctggcactgttattcacgctactggtcatgccctggctggacaatattgtcgaattgctgtttgtgctggcaccgattttcctgttgggcgcatggattgccaccagctctgaacgctcttcttatatcggcacacagatggtggtcaccttcgcgctcgccacgctcgaaaacgtttttggcccggtgtacgacctggtggaaattcgcgatcgcgctctgggtatcatcattggtaccgtggtgtccgcggtgatttacacctttgtctggcctgaaagcgaagcacgcacgctgccgcaaaaactggctggcgcgctgggtatgttgagtaaagtaatgcggatcccacgccagcaggaagtcacggctctgcgcacttatctgcaaattcgcataggtctgcatgcggcgtttaatgcctgtgaagagatgtgccaacgcgtggtgctggagcgtcaactggacagcgaagaacgcgcattactgattgaacgttcgcaaacggttattcgtcagggccgcgatattcttcacgcctgggatgccacctggaactcggcgcaggcgctggataacgcactacagccggacagagcaggtcagtttgccgacgccctggagaaatacgctgccggtctggcaaccgcactcagccgttctcctcaaataacgcttgaagaaacacccgcctcgcaggccatcctgcccaccttattaaaacaggagcaacacgtctgccagcttttcgcccgcttgccagactggacagctccggcattaacgcccgccacggaacaggcacaaggagccacgcaatga

SEQ ID NO: 9432 - protein, 683 aa, Escherichia coli
MSALNSLPLPVVRLLAFFHEELSERRPGRVPQTMQLWVGCLLVILISMTFEIPFVALSLAVLFYGIQSNAFYTKFVAILFVVATVLEIGSLFLIYKWSYGEPLIRLIIAGPILMGCMFLMRTHRLGLVFFAVAIVAIYGQTFPAMLDYPEVVVRLTLWCIVVGLYPTLLMTLIGVLWFPSRAITQMHQALNDRLDDAISHLTDSLAPLPETRIEREALALQKLNVFCLADDANWRTQSAWWQSCVATVTYIYSTLNRYDPTSFADSQAIIEFRQKLVSEINKLQHTIAEGQCWQSDWRISESEAMAARECNLENICQTLLQLGQMDPNTPPTPAAKPPSMVADAFTNPDYMRYAVKTLLACLICYTFYSGVDWEGIHTCMLTCVIVANPNVGSSYQKMVLRFGGAFCGAILALLFTLLVMPWLDNIVELLFVLAPIFLLGAWIATSSERSSYIGTQMVVTFALATLENVFGPVYDLVEIRDRALGIIIGTVVSAVIYTFVWPESEARTLPQKLAGALGMLSKVMRIPRQQEVTALRTYLQIRIGLHAAFNACEEMCQRVVLERQLDSEERALLIERSQTVIRQGRDILHAWDATWNSAQALDNALQPDRAGQFADALEKYAAGLATALSRSPQITLEETPASQAILPTLLKQEQHVCQLFARLPDWTAPALTPATEQAQGATQ

SEQ ID NO: 9433 - DNA, 1032 bp, Escherichia coli
atggaaagtacgccgaaaaaagctcctcgcagtaaattccctgctctgttagtggttgcgttggcgctggttgcccttgttttcgttatctggcgcgtagacagtgcgccatcaactaatgacgcttacgcgtcagcagataccattgatgtggtgccggaagtcagcggtcgcattgtagaactggcggtcaccgacaaccaggcggtgaaacagggcgatttgctgttccgcattgacccgcgcccgtacgaagccaatctggcgaaagctgaagcctccctcgcggcgctggataagcaaattatgctcacccagcgtagcgttgacgcacaacagtttggtgccgactcggttaatgccacggtagaaaaagcccgtgccgccgcgaaacaagccagcgatacgttacgccgtaccgaaccgctactgcgagaaggttttgtttctgcggaagaggttgaccgtgcaagaaccgcacagcgtgcggcagaagcggaccttaatgccgtattgttgcaggcgcagtcagccgccagctccgtcagcggcgtggatgcgctggtggcgcaacgtgcggcagtcgaagcggatattgcgttgacgaaactgcatctggaaatggcgaccgttcgcgcgccgtttgatggccgggtcatttccctcaaaacctccgtcgggcagtttgcatctgcgatgcgccctattttcactctaatcgacactcgtcactggtacgtgattgccaacttccgcgaaactgatctgaaaaatattcgctcgggtacactcgcaaccattcgcctgatgagcgacagcggcaaaaccttcgagggtaaagtggattcgattggctacggcgtgctaccggatgacggcggcctggtgctgggcggcctgccgaaagtgtcacggtctattaactgggtccgcgttgcccagcgttttccggtcaaaatcatggttgataaacctgacccggaaatgttccgcatcggcgcttcggcagtcgctaatcttgagccacaataa

SEQ ID NO: 9434 - protein, 343 aa, Escherichia coli
MESTPKKAPRSKFPALLVVALALVALVFVIWRVDSAPSTNDAYASADTIDVVPEVSGRIVELAVTDNQAVKQGDLLFRIDPRPYEANLAKAEASLAALDKQIMLTQRSVDAQQFGADSVNATVEKARAAAKQASDTLRRTEPLLREGFVSAEEVDRARTAQRAAEADLNAVLLQAQSAASSVSGVDALVAQRAAVEADIALTKLHLEMATVRAPFDGRVISLKTSVGQFASAMRPIFTLIDTRHWYVIANFRETDLKNIRSGTLATIRLMSDSGKTFEGKVDSIGYGVLPDDGGLVLGGLPKVSRSINWVRVAQRFPVKIMVDKPDPEMFRIGASAVANLEPQ

SEQ ID NO: 9435 - DNA, 324 bp, Escherichia coli
ttgatattcactacagatattgttcgcagcagacaggatgtatttaatatgccaacagttctctctcgcatggcgatgcaactcaaaaaaacagcctggataattcccgtcttcatggtttcgggatgctcattatctccggcaatcccggtgatcggcgcttattatcccggctggtttttctgcgctattgccagccttattttgacgctcatcacgaggcgaattattcagcggacaaatatcaatctggcatttgtcggaattatttataccgccctttttgctctctacgccatgctgttctggctggcatttttctaa

SEQ ID NO: 9436 - protein, 107 aa, Escherichia coli
MIFTTDIVRSRQDVFNMPTVLSRMAMQLKKTAWIIPVFMVSGCSLSPAIPVIGAYYPGWFFCAIASLILTLITRRIIQRTNINLAFVGIIYTALFALYAMLFWLAFF

SEQ ID NO: 9437 - DNA, 1986 bp, Escherichia coli
atgaataactctcggttattccgtttgagcaggattgttattgcgttcactgccgccagcggcatgatgataaataccgcttacgcaacagatgaggcgaaagccgccactcaatatacccaacaggttaatcagaattacgccaaatcattaccgtttggcgatcgccaggattttgacgatgctcagcgtggatttatcgctccgctgctggatgaaggtattctgcgtgatgcgaacggtaaaatttactaccgcgcgaatgattacaaatttgatattaatgccgctgcgccggaaaccgtaaaccccagcctgtggcgtcagtcgcagatcaacggcatttctggcctgttcaaagtcaccgataaaatgtatcaggtgcgcggccaggatatctctaacattacgttcgttgagggcgagaaaggcattattgttattgacccactggtgacgccacctgccgcaaaagccgcacttgacctttacttccagcatcgtccgcaaaaaccgattgttgccgttatctacactcacagccacgccgaccactacggcggcgtgaaaggtattatctctgaagccgatgttaaatccggcaaagttcaggtgattgctccagctggctttatggacgaagccatcagcgaaaacgtgctggcgggtaacatcatgagccgccgtgcgctctactcttacggtctgttactgccgcacaacgcgcaaggcaacgtgggcaacggcctcggcgtgacgctggcaaccggcgacccaagcattattgcaccgactaaaactatcgtgagaactggcgagaagatgattatcgacggcctggagtttgacttcctgatgaccccaggtagcgaagcgccagcggaaatgcacttctatattccggccctgaaagccctgtgtaccgccgagaatgccacgcataccctgcacaacttctacaccctgcgcggcgcgaaaacccgcgacaccagcaagtggaccgagtatctgaacgaaacgttggatatgtggggtaacgacgcggaagtgctgtttatgccgcacacctggccggtctggggcaataagcatatcaatgattatattggtaaatatcgcgatactatcaagtacattcacgaccagaccctgcacctggcgaaccaaggctacaccatgaatgaaatcggcgacatgattaagctgccgcctgcgcttgccaataactgggccagccgcggctattacggttctgtcagccacaacgcccgcgcggtgtataacttctatcttggctattacgacggtaacccggctaacctgcatccgtatggtcaggtggagatgggtaaacgttacgtgcaggcgctgggcggttctgcccgcgtcatcaacctggcgcaagaagcgaacaagcaaggtgattatcgctggtcggcagaactgctgaaacaggtgattgccgccaacccgggtgaccaggtcgcgaagaatctgcaagcgaataattttgaacagctgggctatcaggccgagtccgccacctggcgcggtttctacctgaccggcgcgaaagagctgcgcgaaggggtgcataagttcagccacggcaccaccggttccccggacaccattcgcgggatgtcggtcgaaatgctgttcgactttatgtccgttcgcctcgatagcgtgaaagccgcgggtaaaaatatcagcctgaacttcaatatgagcaacggcgataacctcaacctgacgctgaacgatagcgtgcttaactaccgtaaaacactgcaaccgcaagctgacgcctctttctacatcagccgtgaagatctgcacgccgtgctgaccggacaggcaaaaatggccgatcaggtgaaagcgaagaaagccaaaattattggcaatggcgcgaaactggaagaaattatcgcctgtctggataatttcgatttgtgggtgaatatcgtaaccccaaattaa

SEQ ID NO: 9438 - protein, 661 aa, Escherichia coli
MNNSRLFRLSRIVIAFTAASGMMINTAYATDEAKAATQYTQQVNQNYAKSLPFGDRQDFDDAQRGFIAPLLDEGILRDANGKIYYRANDYKFDINAAAPETVNPSLWRQSQINGISGLFKVTDKMYQVRGQDISNITFVEGEKGIIVIDPLVTPPAAKAALDLYFQHRPQKPIVAVIYTHSHADHYGGVKGIISEADVKSGKVQVIAPAGFMDEAISENVLAGNIMSRRALYSYGLLLPHNAQGNVGNGLGVTLATGDPSIIAPTKTIVRTGEKMIIDGLEFDFLMTPGSEAPAEMHFYIPALKALCTAENATHTLHNFYTLRGAKTRDTSKWTEYLNETLDMWGNDAEVLFMPHTWPVWGNKHINDYIGKYRDTIKYIHDQTLHLANQGYTMNEIGDMIKLPPALANNWASRGYYGSVSHNARAVYNFYLGYYDGNPANLHPYGQVEMGKRYVQALGGSARVINLAQEANKQGDYRWSAELLKQVIAANPGDQVAKNLQANNFEQLGYQAESATWRGFYLTGAKELREGVHKFSHGTTGSPDTIRGMSVEMLFDFMSVRLDSVKAAGKNISLNFNMSNGDNLNLTLNDSVLNYRKTLQPQADASFYISREDLHAVLTGQAKMADQVKAKKAKIIGNGAKLEEIIACLDNFDLWVNIVTPN

SEQ ID NO: 9439 - DNA, 894 bp, Escherichia coli
atgggggcaacgcatatccgcttttgtctgcggacagcagaaggtgaaacgctacactgcgaaaaaaagcggaccgcagaagttattgctcccgacctggtgtcgggtatcggcgaaatgattgacgagcaactcaggcgctttaacgctcgctgtcatggtctggtgatgggatttccggcgctggtcagtaaagataaacgcaccattatttctacgcctaacctgccgttaacagcggcagatttatatgatctcgccgataagctcgaaaatacgctgaattgtccggttgagttttcccgcgacgttaacctgcaactctcctgggacgtagtagaaaatcgccttacgcaacaactggttctggcagcctatctcggtacggggatggggttcgcagtgtggatgaacggtgcgccgtggacgggtgcacacggtgtggcaggcgaactgggccatatccccctgggagatatgacccaacactgcgcgtgtggtaatcctgggtgcctggaaaccaattgctctggaatggcgctaagacgctggtacgaacaacagccccgaaattacccattgagcgatcttttcgtccatgcggaaaacgcccctttcgtccagagtctgcttgaaaacgcggcacgagccattgccaccagcattaatctgttcgatcccgatgcggtgattctgggtggtggcgtgatggatatgcccgccttcccacccgagactctcattgccatgacccaaaagtacctgcgccgtccactgccgtatcaggttgtgcgctttattgccgcctcatcttctgactttaatggcgctcagggtgcagcaatattggcgcatcaacgttttttgccacagtcctgtgctaaagtcccatga

SEQ ID NO: 9440 - protein, 297 aa, Escherichia coli
MGATHIRFCLRTAEGETLHCEKKRTAEVIAPDLVSGIGEMIDEQLRRFNARCHGLVMGFPALVSKDKRTIISTPNLPLTAADLYDLADKLENTLNCPVEFSRDVNLQLSWDVVENRLTQQLVLAAYLGTGMGFAVWMNGAPWTGAHGVAGELGHIPLGDMTQHCACGNPGCLETNCSGMALRRWYEQQPRNYPLSDLFVHAENAPFVQSLLENAARAIATSINLFDPDAVILGGGVMDMPAFPPETLIAMTQKYLRRPLPYQVVRFIAASSSDFNGAQGAAILAHQRFLPQSCAKVP

SEQ ID NO: 9441 - DNA, 696 bp, Escherichia coli
atgaaaatctccccctcgttaatgtgtatggatctgctgaaatttaaagaacagatcgaatttatcgacagccatgccgattactttcacatcgatatcatggacggccactttgtgccgaatctgacgctctcaccgttcttcgtaagccaggtaaaaaaactggcgagtaaaccgctcgactgccatctgatggtaacgcgtccgcaggattacattgctcaactggcacgtgcgggagctgatttcatcactttgcatccggaaactatcaacggtcaggcattccgcctgattgatgaaatccgccgtcatggcatgaaagtggggctgattcttaatccggaaacgccggttgaggccatgaaatactatatccataaggctgataaaattacggtcatgactgtcgatcccggttttgccggacaacccttcattcctgaaatgctggataaagttgccgaactgaaggcatggcgtgaacgagaaggtctggagtacgaaattgaggtggacggttcctgcaaccaggcaacttacgaaaaactaatggcggcaggggcggatgtctttatcgtcggcacttccggcctgtttaatcatgcggaaaatatcgacgaagcatggagaattatgactgcgcagattctggctgcaaaaagcgaggtacagcctcatgcaaaaacagcataa

SEQ ID NO: 9442 - protein, 231 aa, Escherichia coli
MKISPSLMCMDLLKFKEQIEFIDSHADYFHIDIMDGHFVPNLTLSPFFVSQVKKLASKPLDCHLMVTRPQDYIAQLARAGADFITLHPETINGQAFRLIDEIRRHGMKVGLILNPETPVEAMKYYIHKADKITVMTVDPGFAGQPFIPEMLDKVAELKAWREREGLEYEIEVDGSCNQATYEKLMAAGADVFIVGTSGLFNHAENIDEAWRIMTAQILAAKSEVQPHAKTA

SEQ ID NO: 9443 - DNA, 708 bp, Escherichia coli
atggtgaccgctaaactgatgttggcaggtattgatccgtttctcgcggcgctaattggcggtgtactggttggcggcgcactgggggcgatcaacggctgcctggtcaactggacgggactacacccgttcattatcacccttggcaccaacgctattttccgtgggatcacgctggtgatctccgatgccaactcggtatacggcttctcatttgacttcgtgaacttctttgccgccagcgtaattgggatacctgtccccgttatcttctcgctaattgtcgcgctcatcctttggtttctgacaacgcgtatgcggctcgggcgcaacatctacgcactgggcggcaacaaaaactcggcgttctattccgggattgacgtgaaattccacatcctggtggtgtttatcatctccggtgtttgtgcaggtctggcaggcgtcgtctcaactgcacgactcggtgccgcagaaccgcttgccggtatgggttttgaaacctatgccattgccagcgccatcattggcggcaccagtttcttcggcggcaaggggcgcattttctctgtggtgattggcgggttgatcatcggcaccatcaacaacggtctgaatattttgcaggtacaaacctattaccaactggtggtgatgggcggattaattatcgcggctgtcgcccttgaccgtcttatcagtaagtaa

SEQ ID NO: 9444 - protein, 235 aa, Escherichia coli
MVTAKLMLAGIDPFLAALIGGVLVGGALGAINGCLVNWTGLHPFIITLGTNAIFRGITLVISDANSVYGFSFDFVNFFAASVIGIPVPVIFSLIVALILWFLTTRMRLGRNIYALGGNKNSAFYSGIDVKFHILVVFIISGVCAGLAGVVSTARLGAAEPLAGMGFETYAIASAIIGGTSFFGGKGRIFSVVIGGLIIGTINNGLNILQVQTYYQLVVMGGLIIAAVALDRLISK

SEQ ID NO: 9445 - DNA, 246 bp, Escherichia coli
atgggctttaccacacgagtaaaaagcgaagcgagcgagaagaaaccgttcaactttgcgctgttctgggataaatacggcaccttttttatcctggcgatcatcgtcgccatttttggttcgctgtcgtcagaatattttctgaccaccaataatattacccagatttttgtgcaaagctccgtgacggtactgatcggcatgggggaattcttcgctatcctggtcgccggtatcgacctttag

SEQ ID NO: 9446 - protein, 81 aa, Escherichia coli
MGFTTRVKSEASEKKPFNFALFWDKYGTFFILAIIVAIFGSLSSEYFLTTNNITQIFVQSSVTVLIGMGEFFAILVAGIDL

SEQ ID NO: 9447 - DNA, 1533 bp, Escherichia coli
atggccacgccatatatatcgatggcggggatcggcaagtcctttggtccggttcacgcattaaagtcggttaatttaacggtttatcctggtgaaatacatgcattactaggagaaaatggtgcgggtaaatctacgctaatgaaagtgttatccgggatacatgagccgaccaaaggcaccattaccattaataacattaactataacaaactggatcataaattagcggcacaactcggtatcgggattatttatcaggaactcagcgttattgatgaattaaccgtactggaaaatttatatattggtcgtcatctgacgaaaaaaatctgtggcgtcaatattatcgactggcgagaaatgcgtgtccgcgccgccatgatgttattacgcgtgggcttgaaagttgatttagatgagaaagtggcgaatttatctatcagccacaagcagatgctggaaattgccaaaacgctgatgctcgatgccaaagtcatcatcatggatgaacccacctcctcactcaccaataaagaggtggactatctgtttctgatcatgaatcagttgcgtaaggagggtacggccatcgtctatatctcgcataaattggcggaaattcgccgtatttgcgaccgctatacggtgatgaaagacggcagcagcgtttgcagcggcatggtgagcgatgtgtcaaatgacgatatcgtccgtctgatggtaggccgcgaattgcaaaaccgttttaacgcgatgaaggagaatgtcagcaaccttgcgcacgatacggtttttgaggtgcgcaacgtcaccagccgtgacagaaaaaaggtccgggatatctcatttagcgtctgccggggagaaatattaggctttgccggactggtcggttccggacgtactgaactgatgaactgcctgtttggcgttgataaacgcgctggcggagaaatccgtcttaatggcaaagatatctctccacgttctcccctggatgccgtgaaaaaagggatggcttacatcactgaaagccgccgggataacggctttttccccaacttttctatcgctcagaacatggctatcagctgcagtctgaaagacggcggctataaaggcgcgatggggttgtttcatgaagttgacgagcaacgtaccgctgaaaatcaacgcgaactgctggcgctgaaatgtcattcggtaaaccagaacatcactgaactctccggcggtaaccagcagaaagtcctgatctccaaatggctgtgctgtcgcccggaagtgatcattttcgatgaacctacccgtggcatcgatgttggcgcgaaagccgaaatttacaaagtgatgcgccaactggcggacgacggaaaagtcatcctgatggtgtcatctgaactacctgaaattatcaccgtctgcgaccgcatcgccgtgttctgcgaaggacgactgacgcaaatcctgaccaatcgcgatgacatgagcgaagaggagattatggcatgggctttaccacacgagtaa

SEQ ID NO: 9448 - protein, 510 aa, Escherichia coli
MATPYISMAGIGKSFGPVHALKSVNLTVYPGEIHALLGENGAGKSTLMKVLSGIHEPTKGTITINNINYNKLDHKLAAQLGIGIIYQELSVIDELTVLENLYIGRHLTKKICGVNIIDWREMRVRAAMMLLRVGLKVDLDEKVANLSISHKQMLEIAKTLMLDAKVIIMDEPTSSLTNKEVDYLFLIMNQLRKEGTAIVYISHKLAEIRRICDRYTVMKDGSSVCSGMVSDVSNDDIVRLMVGRELQNRFNAMKENVSNLAHDTVFEVRNVTSRDRKKVRDISFSVCRGEILGFAGLVGSGRTELMNCLFGVDKRAGGEIRLNGKDISPRSPLDAVKKGMAYITESRRDNGFFPNFSIAQNMAISCSLKDGGYKGAMGLFHEVDEQRTAENQRELLALKCHSVNQNITELSGGNQQKVLISKWLCCRPEVIIFDEPTRGIDVGAKAEIYKVMRQLADDGKVILMVSSELPEIITVCDRIAVFCEGRLTQILTNRDDMSEEEIMAWALPHE

SEQ ID NO: 9449 - DNA, 96 bp, Escherichia coli
gtggccataaataacctctctgcacgaaatatcgtattattgcctgatggctacgtttatcaggtctacgttcaggttattttgttggccggataa

SEQ ID NO: 9450 - protein, 31 aa, Escherichia coli
MAINNLSARNIVLLPDGYVYQVYVQVILLAG

SEQ ID NO: 9451 - DNA, 936 bp, Escherichia coli
atgaataaatatctgaaatatttcagcggcacactcgtgggcttaatgttgtcaaccagcgcttttgctgccgccgaatatgccgtcgtattgaaaacactctccaatccattttgggtagatatgaaaaaaggcattgaagatgaagcaaaaacgctgggcgtcagcgttgatatttttgcctctccttcagaaggcgattttcaatctcaattgcagttatttgaagatctcagtaataaaaattacaaaggtatcgccttcgcaccattatcctcagtgaacctggtcatgcctgtcgcccgcgcatggaaaaaaggcatttatctggtcaatctcgatgaaaaaatcgacatggataatctgaaaaaagcaggcggtaatgtggaaggttttgtcaccaccgataatgttgccgtcggggcgaaaggcgcgtcattcattattgacaagctgggtgccgaagggggtgaagtcgcaatcattgagggtaaagccggtaacgcctccggtgaagcgcgtcgtaatggtgccaccgaagccttcaaaaaagcaagccagatcaagcttgtcgccagccagcctgccgactgggaccgtattaaagcactggatgtcgccactaacgtgttgcaacgtaatccgaatattaaagcgatctattgcgcgaatgacacgatggcaatgggtgttgctcaggcagtcgcaaacgctggaaaaacgggcaaagtgttggtcgtcggtacagatggcattccggaagcccgcaaaatggtggaagccggacaaatgaccgcgacggttgcccagaacccggcggatatcggtgcaacgggtctgaagctgatggttgacgctgagaaatccggcaaggttatcccgctggataaagcaccggaatttaaactggtcgattcaatcctggtcactcaataa

SEQ ID NO: 9452 - protein, 311 aa, Escherichia coli
MNKYLKYFSGTLVGLMLSTSAFAAAEYAVVLKTLSNPFWVDMKKGIEDEAKTLGVSVDIFASPSEGDFQSQLQLFEDLSNKNYKGIAFAPLSSVNLVMPVARAWKKGIYLVNLDEKIDMDNLKKAGGNVEGFVTTDNVAVGAKGASFIIDKLGAEGGEVAIIEGKAGNASGEARRNGATEAFKKASQIKLVASQPADWDRIKALDVATNVLQRNPNIKAIYCANDTMAMGVAQAVANAGKTGKVLVVGTDGIPEARKMVEAGQMTATVAQNPADIGATGLKLMVDAEKSGKVIPLDKAPEFKLVDSILVTQ

SEQ ID NO: 9453 - DNA, 891 bp, Escherichia coli
atgagccagtcagagtttgattcagcgcttccgaacggtatcgggttagcgccttacctgcgaatgaagcaggaaggaatgacagaaaacgaaagccgcatcgtggagtggttactcaaacccggtaacctgagttgtgcacccgcaattaaagatgtcgcagaagctctggcggtatctgaagcgatgatcgttaaggtatcaaagctgctggggtttagcggctttcgtaacttacgcagtgcgctggaagattatttttctcagtcagaacaagtattgccttccgagttggcttttgatgaagcgccgcaggatgtggtgaataaggtatttaacatcactttacgcaccattatggaaggtcagtcgatcgtcaacgttgatgagatccaccgtgccgcccgctttttctatcaggccagacagcgggatttgtacggtgccggaggatcaaatgctatctgtgctgatgtacagcacaagtttttgcgcattggcgtacgctgccaggcctatccggacgctcacatcatgatgatgtctgcttcgttgttacaggaaggagatgtggtgctggtggtgacccattccgggcgaaccagtgatgtaaaagcggctgtagaactggcaaaaaagaacggggcaaagattatttgtataacgcatagctatcattcaccaatagcgaagctggccgattatattatttgctcaccggccccggaaacaccgttattaggtcgtaatgcctcggcaagaatattacaactgactttgctggacgcgttttttgtctctgtcgcccagctcaatattgaacaagctaatattaatatgcaaaaaaccggcgcaattgttgatttcttctcaccaggcgcgctgaaataa

SEQ ID NO: 9454 - protein, 296 aa, Escherichia coli
MSQSEFDSALPNGIGLAPYLRMKQEGMTENESRIVEWLLKPGNLSCAPAIKDVAEALAVSEAMIVKVSKLLGFSGFRNLRSALEDYFSQSEQVLPSELAFDEAPQDVVNKVFNITLRTIMEGQSIVNVDEIHRAARFFYQARQRDLYGAGGSNAICADVQHKFLRIGVRCQAYPDAHIMMMSASLLQEGDVVLVVTHSGRTSDVKAAVELAKKNGAKIICITHSYHSPIAKLADYIICSPAPETPLLGRNASARILQLTLLDAFFVSVAQLNIEQANINMQKTGAIVDFFSPGALK

SEQ ID NO: 9455 - DNA, 105 bp, Escherichia coli
atgctggcaacttcacaaaaaaataaaatttataaagtttgttttgttgtgaataatggagagtggcttaaaatttcatttcatttaatcactttaaaaacatga

SEQ ID NO: 9456 - protein, 34 aa, Escherichia coli
MLATSQKNKIYKVCFVVNNGEWLKISFHLITLKT

SEQ ID NO: 9457 - DNA, 450 bp, Escherichia coli
atgaaaaagattgcatttggctgtgatcatgtcggtttcattttaaaacatgaaatagtggcacatttagttgagcgtgacgttgaagtgattgataaaggaacctggtcgttagagcgtactgattatccgcattacgccagtcaagtcgcactggccgttgctggcggagaggctgatggcgggattttgatttgtggcactggcgtcggtatttcgatagcggcgaacaagtttgccggaattcgcgcggtcgtttgtagcgaaccttattccgcgcaactttcgcggcagcataacgacaccaacgtgctggcttttggttcacgagtggttggcctcgaactggcaaaaatgattgtcgatgcgtggctgggcgcacagtacgaaggcggtcgtcatcaacaacgcgtggaggcgattacggcaatagagcagcaaaggaattga

SEQ ID NO: 9458 - protein, 149 aa, Escherichia coli
MKKIAFGCDHVGFILKHEIVAHLVERDVEVIDKGTWSLERTDYPHYASQVALAVAGGEADGGILICGTGVGISIAANKFAGIRAVVCSEPYSAQLSRQHNDTNVLAFGSRVVGLELAKMIVDAWLGAQYEGGRHQQRVEAITAIEQQRN

SEQ ID NO: 9459 - DNA, 330 bp, Escherichia coli
atgaaacgctttccgctatttcttttattcaccctgctcacgctgtccaccgttccggcccaggccgatattatcgacgacaccattggcaatattcagcaggcgattaacgacgcttataaccctgaccgtgggcgagactatgaagattcgcgcgacgacggttggcaacgccaggtgagcgacgatcgtcgcaagcaatataacgatcgccgccgccagtttgaagatcgccgcaggcagctggacgatcgccagcgccagcttgatcaggagcgtcggcaactggaagatgaagagcggagaatggaagatgagtatgggcgttga

SEQ ID NO: 9460 - protein, 109 aa, Escherichia coli
MKRFPLFLLFTLLTLSTVPAQADIIDDTIGNIQQAINDAYNPDRGRDYEDSRDDGWQRQVSDDRRKQYNDRRRQFEDRRRQLDDRQRQLDQERRQLEDEERRMEDEYGR

SEQ ID NO: 9461 - DNA, 759 bp, Escherichia coli
atgagcctgaccctcacgctcaccggcaccggcggcgcacagggcgttccggcatggggctgcgagtgcgcggcctgcgccagagcgcgacgctcgccgcagtatcgccgccagccatgcagcggcgtcgtgaagtttaacgacgcgatcaccctgatcgacgccgggctgcacgatctcgccgatcgctggtcgcccggatcgttccagcagtttttgctgacgcactaccatatggatcacgtccaggggctgttcccgctgcgctggggcgtgggcgacacaatcccggtctacggtccaccggatgagcagggctgcgacgatctgtttaaacatccgggcctgcttgatttcagccacacggtggagccgtttgtggtgtttgatttgcaggggttgcaggtcacgccgctgccgcttaaccattcgaaactcactttcggctatctactggaaacggcacatagccgggtggcgtggctgtctgacactgcaggcctgccggaaaaaacgctgaaatttttacgcaataatcagccacaggtaatggtgattgattgcagccacccgccgcgcgaggatgcaccgcgtaatcactgtgatttaaataccgtgcttgcgctgaatcaggttatccgctcgccgcgggtgattctgacccatatcagccatcagtttgatgcgtggctgatggaaaacgcgctaccatcggggtttgaggcggggtttgatgggatggatattgaggtggcgtga

SEQ ID NO: 9462 - protein, 252 aa, Escherichia coli
MSLTLTLTGTGGAQGVPAWGCECAACARARRSPQYRRQPCSGVVKFNDAITLIDAGLHDLADRWSPGSFQQFLLTHYHMDHVQGLFPLRWGVGDTIPVYGPPDEQGCDDLFKHPGLLDFSHTVEPFVVFDLQGLQVTPLPLNHSKLTFGYLLETAHSRVAWLSDTAGLPEKTLKFLRNNQPQVMVIDCSHPPREDAPRNHCDLNTVLALNQVIRSPRVILTHISHQFDAWLMENALPSGFEAGFDGMDIEVA

SEQ ID NO: 9463 - DNA, 435 bp, Escherichia coli
atgcctgcttgtgaacttcgcccggcaacgcagtacgacaccgacgcggtttacgcgctgatttgtgagctaaaacaagcggagtttgaccaccaggcgtttcgcgtgggctttaacgccaacctgcgtgacccgaatatgcgctaccatctggcgctgttggatggcgaggttgtcggcatgatcggcctgcatttgcagtttcatctgcatcatgtcaactggatcggcgaaattcaggaactggtggtgatgccgcaggcgcgcggtctgaacgtcggcagtaaattactggcatgggcagaagaagaagcccgccaggccggggccgaaatgaccgagctttccaccaacgtgaagcgccacgacgcgcaccgattttacctgcgcgaaggctacgagcagagccacttccgcttcaccaaggcgctgtaa

SEQ ID NO: 9464 - protein, 144 aa, Escherichia coli
MPACELRPATQYDTDAVYALICELKQAEFDHQAFRVGFNANLRDPNMRYHLALLDGEVVGMIGLHLQFHLHHVNWIGEIQELVVMPQARGLNVGSKLLAWAEEEARQAGAEMTELSTNVKRHDAHRFYLREGYEQSHFRFTKAL

SEQ ID NO: 9465 - DNA, 558 bp, Escherichia coli
atgacgggaaaactgatttggttaatgggggcctctggctccggaaaagacagtctgttgacggaactccgccagcgggaacaaacccagctactggtagcgcatcgctacatcacgcgtgatgccagcgccggaagtgaaaaccatatcgccttaagcgagcaggagttttttacccgcgcggggcagaaccttctggccttgagctggcatgctaatggtttgtattacggtgtcggcattgagatcgacctctggctgcacgccggattcgacgtcgtggttaacggctcacgcgcccacctgccgcaggcgcgggcgcgttatcaatcggcgctgctgcccatctgtttacaggtttcgccggagatcctgcgccagcgcctggaaaaccgtggccgcgaaaacgccagtgaaattaatgcccggctggcgcgcgccgcccgctatactcctcaggattgccatacgctcaataatgacggcagcctgcgccagtcggtcgacacgctgctgacgctgattcatcagaaggagaaacaccatgcctgcttgtga

SEQ ID NO: 9466 - protein, 185 aa, Escherichia coli
MTGKLIWLMGASGSGKDSLLTELRQREQTQLLVAHRYITRDASAGSENHIALSEQEFFTRAGQNLLALSWHANGLYYGVGIEIDLWLHAGFDVVVNGSRAHLPQARARYQSALLPICLQVSPEILRQRLENRGRENASEINARLARAARYTPQDCHTLNNDGSLRQSVDTLLTLIHQKEKHHACL

SEQ ID NO: 9467 - DNA, 1137 bp, Escherichia coli
atgattatcaataacgtcaaactggtgctggaaaacgaggtggtacacggttctctggagatgcaggacggcgaaatccgcgcctttgccgaaagccagagtcacctgtcagaagcaatggacggcgaaggcggctggctgctaccggggctgattgagctgcataccgataatctggataaattcttcaccccgcgcccgaaagttgactggccagcccactcggcgatgagcagccacgacgcgctgatggtggcgagcggcatcaccaccgtgctggacgccgtggcgattggtgatgtacgcgacggcggcgatcggctggagaatctggagaagatgatcaacgccatcgaagagacgcagaaacgcggcgtcaaccgtgccgagcaccgtctgcacctacgctgcgaactgccgcatcacaccacgctgccgctgtttgaaaaactggtacagcgcgaactggtaacgctggtgtcgctgatggatcactcaccgggccagcgccagttcgccaaccgcgaaaaatatcgtgaatattatcagggcaaatactcgctcaccgatgcgcagatgcaacagtacgaagaggagcaactggcgcttgccgcacgctggtcacagcctaatcgcgaaactatcgccgcaatgtgccgcgcgcgacacattgccctcgccagccacgatgacgccacgcacgcccacgttgccgaatcccaccagcttggcagcgtgatcgccgaatttcccaccacgttcgaagcggcagaagcctcgcgcaagcatggcatgaacgtactgatgggcgcgccgaatatcgtgcgcggcggttcgcactccggcaacgtggcggccagtgaactggcacagcttggcctgctggatatcctctcttccgactactaccccgccagcctgctcgatgcggcatttcgcgtcgccgatgacgagagcaaccgctttacgctgccgcaggcggtgaagctggtgactaaaaatccggcgcaggcgcttaatcttcaggatcgcggggtgattggcgagggcaaacgcgccgacctggtgctggcgcatcgcaagggcaaccacattcatatcgaccacgtctggcgtcagggtaaaagggtgttctga

SEQ ID NO: 9468 - protein, 378 aa, Escherichia coli
MIINNVKLVLENEVVHGSLEMQDGEIRAFAESQSHLSEAMDGEGGWLLPGLIELHTDNLDKFFTPRPKVDWPAHSAMSSHDALMVASGITTVLDAVAIGDVRDGGDRLENLEKMINAIEETQKRGVNRAEHRLHLRCELPHHTTLPLFEKLVQRELVTLVSLMDHSPGQRQFANREKYREYYQGKYSLTDAQMQQYEEEQLALAARWSQPNRETIAAMCRARHIALASHDDATHAHVAESHQLGSVIAEFPTTFEAAEASRKHGMNVLMGAPNIVRGGSHSGNVAASELAQLGLLDILSSDYYPASLLDAAFRVADDESNRFTLPQAVKLVTKNPAQALNLQDRGVIGEGKRADLVLAHRKGNHIHIDHVWRQGKRVF

SEQ ID NO: 9469 - DNA, 795 bp, Escherichia coli
ttgagctggtgccggatgcggcgtaaacgccttatccggcctacaaatgcgctccccgtaggtcggataagacgcatcagcgtcgcatccgacacccgaaccacgaggcgaaaaatgattaacgtacaaaacgtcagtaaaaccttcatcctgcaccagcaaaacggcgtgcgcctgcctgtattacaaggcgcctcactcaccgtcaacgccggcgaatgcgtggtactccacggccattccggcagtggaaaatcaactctgctacgctcgctgtatgccaactatctacccgacgaagggcaaatccagatcaaacacggtgatgaatgggtcgacctggtcaccgcgccagcgcgcaaagtggtggagatccgcaaaaccactgtcggctgggtaagccagtttctgcgcgtcatcccacgtatttcggcactggaagtggtgatgcagccgctgctcgataccggcgtaccgcgtgaagcctgcgccgctaaagccgcgcgtctcctcacccacctgaacgtgcctgaacgcctgtggcacctggcaccatcgaccttctccggcggcgaacagcagcgtgtcaacatcgcccgtggctttatcgtcgactaccccattctgctgctcgacgaacctaccgcctcgctggacgctaaaaacagcgccgccgtagtggaactgatccgcgaagccaaagcccgcggcgcggccatcgtcggtatcttccatgacgaaaccgtgcgcgagcaagtcgccgaccgcctgcacccaatgggagtctcttcatga

SEQ ID NO: 9470 - protein, 264 aa, Escherichia coli
MSWCRMRRKRLIRPTNALPVGRIRRISVASDTRTTRRKMINVQNVSKTFILHQQNGVRLPVLQGASLTVNAGECVVLHGHSGSGKSTLLRSLYANYLPDEGQIQIKHGDEWVDLVTAPARKVVEIRKTTVGWVSQFLRVIPRISALEVVMQPLLDTGVPREACAAKAARLLTHLNVPERLWHLAPSTFSGGEQQRVNIARGFIVDYPILLLDEPTASLDAKNSAAVVELIREAKARGAAIVGIFHDETVREQVADRLHPMGVSS

SEQ ID NO: 9471 - DNA, 789 bp, Escherichia coli
ttgccgccaacagaacgaggccaaaagccaatgaatcaaccgttactttcggtcaataacctgacccacctttatgccccgggcaaaggcttcagcgatgtctcttttgatttatggccgggagaagttctgggcattgttggggagtccggctccgggaagaccacgctgctgaagtcgatctccgcccgcctgacaccacagcaaggggaaattcgctacgagaaccgttcgctgtacgcgatgagcgaggccgaccgccgtcgcctgctgcgcaccgaatggggtgtggtgcatcagcatccgcttgacggcctgcgccgccaggtgtcggcaggcggcaatatcggcgaacggttgatggcaaccggagcgcgtcattacggcgatattcgcgccaccgcgcagaaatggctggaagaggtggagattcccgccaaccggatcgacgacctgccgaccaccttttccggcggcatgcagcaacgtttgcagattgcccgcaacctggtgacgcatccgaagctggtgtttatggatgaacccactggcgggctggatgtgtcggtacaggcgcgcctgctggacctgctccgcggtctggtgatggagcttaacctggcggtggtgattgtcacccacgatttaggcgtcgcccgtctgctggcggaccgtttgctggtaatgaagcaagggaaagtggtggagagtgggttaaccgaccgcgtgctcgacgacccgcaccatccgtatacccagttgctggtgtcatcggttttgcagaattga

SEQ ID NO: 9472 - protein, 262 aa, Escherichia coli
MPPTERGQKPMNQPLLSVNNLTHLYAPGKGFSDVSFDLWPGEVLGIVGESGSGKTTLLKSISARLTPQQGEIRYENRSLYAMSEADRRRLLRTEWGVVHQHPLDGLRRQVSAGGNIGERLMATGARHYGDIRATAQKWLEEVEIPANRIDDLPTTFSGGMQQRLQIARNLVTHPKLVFMDEPTGGLDVSVQARLLDLLRGLVMELNLAVVIVTHDLGVARLLADRLLVMKQGKVVESGLTDRVLDDPHHPYTQLLVSSVLQN

SEQ ID NO: 9473 - DNA, 846 bp, Escherichia coli
atggctaatctgagcggctacaactttgcttacctcgacgagcagaccaaacgcatgatccgccgcgctatcttaaaagcggtggcaatccccggttatcaggtgccgtttggcggacgcgagatgccgatgccctacggctggggaaccggcggcattcagctcaccgccagcgtgattggcgaaagcgacgtgttgaaggtgattgaccagggcgcagacgataccaccaacgccgtgtcgattcgtaacttctttaagcgcgtgaccggggtgaacaccaccgagcgcacggacgatgcgacacttatccagacgcgtcaccgcatacccgaaacgccgctgaccgaagatcagatcattatcttccaggtgccgatccccgaaccgctgcgctttattgagccgcgtgagacggaaacgcgcaccatgcacgcgctggaggagtacggcgtgatgcaggtgaaactgtatgaagatatcgcccgcttcggtcatatcgccaccacctacgcctatccggtgaaggtgaacgggcgctacgtaatggacccgtcgccgatcccgaaattcgataacccgaaaatggacatgatgcccgccctgcaactgtttggcgcggggcgcgagaagcgcatctatgccgtgccaccgtttacccgcgtggaaagcctcgatttcgatgatcatccgttcaccgtccagcagtgggatgaaccatgcgccatctgcggatcgacccacagttacctcgacgaagtggtgctggatgacgccggaaaccgcatgtttgtctgctccgataccgattattgccgccaacagaacgaggccaaaagccaatga

SEQ ID NO: 9474 - protein, 281 aa, Escherichia coli
MANLSGYNFAYLDEQTKRMIRRAILKAVAIPGYQVPFGGREMPMPYGWGTGGIQLTASVIGESDVLKVIDQGADDTTNAVSIRNFFKRVTGVNTTERTDDATLIQTRHRIPETPLTEDQIIIFQVPIPEPLRFIEPRETETRTMHALEEYGVMQVKLYEDIARFGHIATTYAYPVKVNGRYVMDPSPIPKFDNPKMDMMPALQLFGAGREKRIYAVPPFTRVESLDFDDHPFTVQQWDEPCAICGSTHSYLDEVVLDDAGNRMFVCSDTDYCRQQNEAKSQ

SEQ ID NO: 9475 - DNA, 1065 bp, Escherichia coli
atgtacgttgccgtgaaagggggcgaaaaggcgatcgacgccgcccacgccctgcaagagagccgacgccggggcgatactgatttgcctgaactgagcgtcgcccagattgaacagcagcttaacctcgcggtagatcgcgtgatgaccgaaggcggtattgccgaccgcgagctggccgcgctggcgctgaaacaggccagcggcgataacgtcgaagcgattttcctgttgcgcgcctaccgcaccacgctggcgaagctggcggtcagtgagccgctcgacaccaccgggatgcgtctcgaacggcgtatttcagcaatttataaagacattcccggcggccaactgcttggccccacctacgactacacccatcgcctgctcgatttcaccctgctggcaaacggcgaaacgccaacgctgaccaccgctgacagcgaacagcaaccgtcgccacacgtcttcagcctgctggcgcgtcaggggctggcgaagtttgaagaagatagcggcgcacaaccggacgacatcacccgcacgccgccggtttatccctgttcgcgttcttcccgtctacaacaattaatgcgcggtgacgaaggctatttgttggcgctggcctactccacccaacgcggttacgggcgcaatcacccgttcgcaggcgaaattcgcagtggctatatcgatatatttattgtgccggaagagctgggatttgcggtgaacgtcggcgaattgttgatgaccgagtgtgaaatggtcaacggttttatcgacccgccggatgaaccaccgcattttacacgcggctatgggctggtgttcggcatgagcgagcgcaaagcaatggcgatggcgctggttgaccgtgcgttgcaggcaccggaatacggcgagcacgcaacaggtccggcacaggatgaagagttcgtgctggcccatgccgacaacgtcgaagccgcaggctttgtttcgcatctcaaactcccgcactacgtcgatttccaggccgaactggagctactcaaacgtctgcaacaggagcagaaccatggctaa

SEQ ID NO: 9476 - protein, 354 aa, Escherichia coli
MYVAVKGGEKAIDAAHALQESRRRGDTDLPELSVAQIEQQLNLAVDRVMTEGGIADRELAALALKQASGDNVEAIFLLRAYRTTLAKLAVSEPLDTTGMRLERRISAIYKDIPGGQLLGPTYDYTHRLLDFTLLANGETPTLTTADSEQQPSPHVFSLLARQGLAKFEEDSGAQPDDITRTPPVYPCSRSSRLQQLMRGDEGYLLALAYSTQRGYGRNHPFAGEIRSGYIDIFIVPEELGFAVNVGELLMTECEMVNGFIDPPDEPPHFTRGYGLVFGMSERKAMAMALVDRALQAPEYGEHATGPAQDEEFVLAHADNVEAAGFVSHLKLPHYVDFQAELELLKRLQQEQNHG

SEQ ID NO: 9477 - DNA, 585 bp, Escherichia coli
atgaccctggaaaccgcttttatgcttcccgtgcaggatgcccaacacagttttcgtcgcctgttaaaggccatgagcgagccgggcgtgattgtcgccctgcatcagctcaagcgcggctggcagccgctgaatatcgccaccaccagcgtgctgctgacgctggccgataacgacacgccggtgtggcttgccgcgccattgagcaacgatatcgtcaatcagagcctgcgttttcataccaacgcgccgctggttaatcagccgaaacaggcgaccttcgcggtaacagatgaggcgatctccagcgagcagctcaacgccctttccaccggcactgccgttgcaccagaagcgggcgcaacgctgattttacaggtcaccagcctgagcggtgggcgtatgttgcgcctcaccggcgcaggtattgccgaagaacggatgatcgccccgcaactgccaaagtgcattcttcatgaacttaccgagcgcccgcacccgttcccgctcggcatcgacctgatcctgacctgcggcgagcgcctgctggctattccgcgaaccactcatgtggaggtgtgctga

SEQ ID NO: 9478 - protein, 194 aa, Escherichia coli
MTLETAFMLPVQDAQHSFRRLLKAMSEPGVIVALHQLKRGWQPLNIATTSVLLTLADNDTPVWLAAPLSNDIVNQSLRFHTNAPLVNQPKQATFAVTDEAISSEQLNALSTGTAVAPEAGATLILQVTSLSGGRMLRLTGAGIAEERMIAPQLPKCILHELTERPHPFPLGIDLILTCGERLLAIPRTTHVEVC

SEQ ID NO: 9479 - DNA, 453 bp, Escherichia coli
atgcacgcagataccgcgacccgccagcactggatgtccgtgctggcgcacagccaaccggctgaactggcagcccgcctgaacgcgctgaacatcaacgccgattatgaggtgatccgcgccgctgaaactggcctggtgcagattcaggcgcgaatgggcggcaccggcgaacgcttttttgctggcgacgccacgctcacccgcgccgccgtgcgtctgactgacggcacgctcggctatagctgggtgctggggcgcgacaaacagcacgccgaacgttgtgcgctgattgatgcgctgatgcagcaaaaccgccactttcaaaacttatcagaaacccttatcaccccgctggacgctgaccgtatggcacgcattgccgcgcgccaggccgaagtgaacgccagccgggtcgacttctttacgatggttcgcggagacaacgcatga

SEQ ID NO: 9480 - protein, 150 aa, Escherichia coli
MHADTATRQHWMSVLAHSQPAELAARLNALNINADYEVIRAAETGLVQIQARMGGTGERFFAGDATLTRAAVRLTDGTLGYSWVLGRDKQHAERCALIDALMQQNRHFQNLSETLITPLDADRMARIAARQAEVNASRVDFFTMVRGDNA

SEQ ID NO: 9481 - DNA, 732 bp, Escherichia coli
atggctatgcacttgtctacacatccgaccagctacccaacacgctatcaggagatagccgcaaaacttgagcaggagcttcgtcaacactaccgctgcggcgactatcttcccgccgagcagcaactggcggcgcgctttgaggtgaaccgccacaccctgcgccgcgccatcgaccaactggtggaaaaaggctgggtacagcgccgtcagggcgtcggcgtactggtgctgatgcgcccgttcgattacccgctcaacgcccaggcgcgttttagccagaacctgctggaccagggcagccatcccaccagcgaaaaattgctatcggtgctgcgccccgcctccggtcacgtcgctgacgcgctggggataaccgagggggagaacgtcatccacctgcgcaccctgcgtcgggtcaacggcgtcgcgctctgtttaatcgaccactactttgcggacctcaccctctggccgacgctgcaacgtttcgacagcggttcgctgcacgattttctgcgcgagcaaacggggattacgctacgacgcagccagacgcggatcagcgcccgccgcgcccaggccaaagagtgccagcgtcttgaaatcccgaatatgtcgccgctgctgtgcgtgcgcacccttaaccaccgtgacggtgaaagcagcccggcggagtactccgtcagcctgacgcgcgccgacatgattgaattcactatggagcactga

SEQ ID NO: 9482 - protein, 243 aa, Escherichia coli
MAMHLSTHPTSYPTRYQEIAAKLEQELRQHYRCGDYLPAEQQLAARFEVNRHTLRRAIDQLVEKGWVQRRQGVGVLVLMRPFDYPLNAQARFSQNLLDQGSHPTSEKLLSVLRPASGHVADALGITEGENVIHLRTLRRVNGVALCLIDHYFADLTLWPTLQRFDSGSLHDFLREQTGITLRRSQTRISARRAQAKECQRLEIPNMSPLLCVRTLNHRDGESSPAEYSVSLTRADMIEFTMEH

SEQ ID NO: 9483 - DNA, 780 bp, Escherichia coli
atgcaaaccatcaccatcgccccacccaagcgcagctggttctcgcttctgagctgggccgttgttatcgccgtgctggtcgtctcgtggcagggcgcggaaatggcaccgcttacgctgattaaagatggcggcaacatggcgacgttcgccgccgacttcttcccgcccgatttcagccagtggcaggattacctcaccgaaatggccgtcacgctgcaaatcgccgtctggggcaccgcgctggcggtggttctctccatccccttcggcctgatgagcgctgaaaacctggtaccgtggtgggtctaccaacctgtacgccgcctgatggacgcctgccgcgccattaacgaaatagtcttcgccatgctgttcgtggtcgccgtcggcctcggcccgttcgctggcgtgctggcgctgtttatccacaccaccggcgtactttccaaactgctttccgaagcggtagaagcgattgaacccggcccggtggagggcattcgcgctaccggtgccaacaagctggaagagatcctctacggcgtactaccgcaggtcatgccgctgctgatttcctactctctctatcgcttcgaatccaacgtccgctcggcgaccgtcgtcggtatggttggcgcgggcgggatcggcgtcacgctgtgggaagcgattcgcggtttccagttccagcaaacctgcgccctgatggtgctcatcatcgtcacggtcagcctgctggatttcctctctcaacggttgcgtaagcactttatctga

SEQ ID NO: 9484 - protein, 259 aa, Escherichia coli
MQTITIAPPKRSWFSLLSWAVVIAVLVVSWQGAEMAPLTLIKDGGNMATFAADFFPPDFSQWQDYLTEMAVTLQIAVWGTALAVVLSIPFGLMSAENLVPWWVYQPVRRLMDACRAINEIVFAMLFVVAVGLGPFAGVLALFIHTTGVLSKLLSEAVEAIEPGPVEGIRATGANKLEEILYGVLPQVMPLLISYSLYRFESNVRSATVVGMVGAGGIGVTLWEAIRGFQFQQTCALMVLIIVTVSLLDFLSQRLRKHFI

SEQ ID NO: 9485 - DNA, 1017 bp, Escherichia coli
atgaacgctaagataattgcctcgctggccttcaccagcatgttcagcctcagcaccctgttaaatccggcatacgccgaagagcaggaaaaggcgctgaatttcggcattatttcaacggaatcacagcaaaacctgaaaccgcaatggacgccgttcttacaggatatggagaagaagctgggcgtaaaggtcaacgccttctttgccccggactacgcgggcattatccaggggatgcgcttcaataaagtggatatcgcctggtacggcaacctgtcggcgatggaagcggtggatcgcgccaacggccaggtcttcgcccagacggtcgcggcggatggatcgccgggttactggagcgtgttgatcgtcaacaaagatagcccgatcaacaacctgaacgatctgctggcgaagcggaaagatctcaccttcggcaatggcgatcctaactctacctccggcttcctcgtccccggttactacgtcttcgctaaaaacaatatctccgccagcgacttcaagcgcaccgtcaacgccgggcatgaaaccaatgcgctggccgtcgccaacaagcaagtggatgtggcgaccaataacaccgaaaacctcgacaagctgaaaacctccgcgccggagaagctcaaagaactgaaggtgatctggaaatcgccgctgatcccaggcgatccgatcgtctggcgcaaaaatctgtccgaaaccaccaaagacaagatctacgacttctttatgaactacggcaaaacgccggaagagaaagcggtgctggaacgcctgggctgggcgccgttccgcgcctccagcgacctgcaactggtgccgattcgccagctcgcgctgtttaaagagatgcaaagcgtgaaggacaacaaagggctgaacgaacaggacaagctggcaaaaaccaccgccattcaggcgcaactggatgatttggaccgcctgaacaacgcgttaagcgcaatgagttcggtgagtaaagcggtgcagtaa

SEQ ID NO: 9486 - protein, 338 aa, Escherichia coli
MNAKIIASLAFTSMFSLSTLLNPAYAEEQEKALNFGIISTESQQNLKPQWTPFLQDMEKKLGVKVNAFFAPDYAGIIQGMRFNKVDIAWYGNLSAMEAVDRANGQVFAQTVAADGSPGYWSVLIVNKDSPINNLNDLLAKRKDLTFGNGDPNSTSGFLVPGYYVFAKNNISASDFKRTVNAGHETNALAVANKQVDVATNNTENLDKLKTSAPEKLKELKVIWKSPLIPGDPIVWRKNLSETTKDKIYDFFMNYGKTPEEKAVLERLGWAPFRASSDLQLVPIRQLALFKEMQSVKDNKGLNEQDKLAKTTAIQAQLDDLDRLNNALSAMSSVSKAVQ

SEQ ID NO: 9487 - DNA, 789 bp, Escherichia coli
atgcaaacgattatccgtgtcgagaagctcgccaaaaccttcaatcagcatcaggcgctgcacgcggttgatctgaacattcatcatggtgaaatggtggctctgcttgggccgtcgggttccggaaaatccacccttttacgtcacttaagcggtttgattaccggcgataaatctgtcggtagccatatcgagctgctgggccgcactgtccagcgcgaaggccgtctggcccgcgatatccgtaaaagccgcgcccataccggctacatctttcaacaattcaacctggtgaatcgcctgagcgtactggagaacgtgctgattggcgcgctcggcagcacgccattctggcgaacctgttttagctacttcacccgcgagcagaaacagcgcgcgttacaggcgctgacccgcgttggcatggtgcactttgcccatcaacgcgtttccacactctccggcggccagcaacagcgtgtggcgattgcccgcgcgctgatgcagcaggcgaaggtcattctcgctgacgaacccatcgcctcgctggacccggaatcggcacgcatcgtgatggacaccctgcgcgacatcaaccagaacgacggcattaccgtggtcgtcacgctgcatcaggtggattacgccctgcgctactgcgaacgcatcgtcgccctgcgccaggggcacgtcttctacgacggctgcagccaacagtttgataacgaacgttttgaccatctctaccgcagcattaaccgcgtcgaagagaacgcgaaagctgcctga

SEQ ID NO: 9488 - protein, 262 aa, Escherichia coli
MQTIIRVEKLAKTFNQHQALHAVDLNIHHGEMVALLGPSGSGKSTLLRHLSGLITGDKSVGSHIELLGRTVQREGRLARDIRKSRAHTGYIFQQFNLVNRLSVLENVLIGALGSTPFWRTCFSYFTREQKQRALQALTRVGMVHFAHQRVSTLSGGQQQRVAIARALMQQAKVILADEPIASLDPESARIVMDTLRDINQNDGITVVVTLHQVDYALRYCERIVALRQGHVFYDGCSQQFDNERFDHLYRSINRVEENAKAA

SEQ ID NO: 9489 - DNA, 444 bp, Escherichia coli
atgccgttaagtccctacctctcttttgccggtaactgttccgacgcgattgcctattatcaacgtacgttgggcgcggaactgctctataaaatcagcttcggcgaaatgccgaaatcagcgcaggacagcgccgaaaactgcccttccggaatgcaatttcccgataccgccatcgctcatgccaacgtgcgcattgcaggaagcgacatcatgatgagcgatgctataccgtcaggaaaagccagctactccggctttacgctggtgctcgattcgcaacaggtcgaagaaggaaaacgctggtttgacaaccttgccgctaacggaaaaatcgaaatggcctggcaggaaactttctgggcgcatggcttcggcaaagtcaccgataaatttggcgtaccgtggatgattaatgtcgtcaaacaacagccaacgcaataa

SEQ ID NO: 9490 - protein, 147 aa, Escherichia coli
MPLSPYLSFAGNCSDAIAYYQRTLGAELLYKISFGEMPKSAQDSAENCPSGMQFPDTAIAHANVRIAGSDIMMSDAIPSGKASYSGFTLVLDSQQVEEGKRWFDNLAANGKIEMAWQETFWAHGFGKVTDKFGVPWMINVVKQQPTQ

SEQ ID NO: 9491 - DNA, 483 bp, Escherichia coli
ttgcgtttcctttcaaatgaaaacgatcgtcgtctaaaatcagcagtacccccgacaaactcagggattttgtgtataattgcggcctttttcggcaatctgccgttttttggcgcttttgccctgctgacttttgaggaaatccacatgtcattaccacactgcccaaaatgcaactccgaatacacctacgaagataacggcatgtacatctgcccggaatgtgcctacgaatggaacgacgcagaacctgcacaggaaagcgacgagctgatcgttaaagatgctaacggcaatctgctggctgacggcgacagcgtgaccatcattaaagatctgaaggtgaaaggtagctcttcgatgctgaaaattggcaccaaagtgaaaaacatccgcctggttgaaggcgaccataacatcgattgcaaaatcgacggttttggtccgatgaaactgaaatctgagtttgtgaaaaagaactga

SEQ ID NO: 9492 - protein, 160 aa, Escherichia coli
MRFLSNENDRRLKSAVPPTNSGILCIIAAFFGNLPFFGAFALLTFEEIHMSLPHCPKCNSEYTYEDNGMYICPECAYEWNDAEPAQESDELIVKDANGNLLADGDSVTIIKDLKVKGSSSMLKIGTKVKNIRLVEGDHNIDCKIDGFGPMKLKSEFVKKN

SEQ ID NO: 9493 - DNA, 2229 bp, Escherichia coli
atgtacacacagaccctgtatgagttaagtcaggaggctgaacgcctgttacagctttctcgccaacagttgcagttactggaaaaaatgcctctctctgtacccggagacgatgcgccacaactggctttaccctggagtcagcctaatatcgccgaacgtcacgcgatgctgaataatgagttgcgtaaaatttcccgactggaaatggtgctggcgattgccggtactatgaaagcagggaaatcaaccaccattaatgccattgttggtacggaggttctgcctaatcgcaatcgcccaatgactgcgctgccaacgcttattcgccatacgcccgggcaaaaagaaccggtactgcatttttcacatgtcgcgccaatcgaccatttaattcaacaattacaacagcgcctgcgtgattgcgatattaagcatctgaccgatgtgctggaaatagataaagatatgcgtgcgcttatgcagcggattgaaaatggcatcgctttcgaaaaatattatctgggtgctcaacctatttttcattgtctgaaaagtttgaatgatttggtgcgactggcgaaggcgctggacgtcgattttcctttttctgcttacgccgccattgagcatattcccgtgattgaagtggagtttgtccatctggcggggctggagagttatcccggtcagttgacgttactggatacccccgggccaaatgaagccgggcaaccgcatctgcaaaaaatgcttaaccagcagctggcacgcgcctcggcggtactggcggtgctggattatacgcaactgaaatcgatctccgatgaagaggtccgtgaggcaattttggcggtggggcaatcggtgccgttgtatgtgctggtcaataagttcgatcaacaggatcgtaacagtgacgacgccgaccaggtgcgggcactgatttccggaacgctgatgaaaggctgtattacgccacagcagatatttccggtgtcgtcgatgtggggctacctggcgaatcgggcgcgccatgagttagccaacaacggtaagttaccaccgccagagcaacaacgctgggtggaagattttgcccatgccgcgctcggcaggcgctggcgtcatgccgatctggcggacctcgaacatattcgccatgctgccgatcagttgtgggaagattcgctgttcgcccagccaattcaggcgttgcttcatgccgcttacgctaacgcctcgttgtatgctctgcgatctgccgcgcataaactgttgaattacgcgcagcaggcgcgggaatacctggattttcgtgcgcacgggttaaacgtcgcttgtgaacaattgcagcaaaatatccatcaggtcgaagaaagtttgcagctattgcaactcaatcaggcgcaggtgagcggcgagattaaacatgaaatcgagttggccctgacctccaccaaccactttctgcgtcaacagcaagatgcggtgaatgcgcagttagccgcgttgtttcaggatgattcggagtcgttaagtgagatgcgtacccgctgtgagacactgttacagacggcgcagaacaccatcagtcgcgactttacgctgcgctttgccgagcttgagtccaccctttgccgggtgttaaccgatgttattcgccccattgagcaacaagtcaaaatggaattgagtgagtctgggtttcgtcctgggtttcattttcctgtttttcacggcgtagttccccacttcaacacccgccagctgttcagcgatgcaatatcccgtcaggaagcaacggatgagcagatcacccgttttggcgttgtgcgtgagattttttcgcgctggttgaatcagcccgactggggacggggaaatgagaaattcccgacagagacggttgattacagtgtgttgcaacgagcattaagcgcagaagtcgatctttattgccaacaaatggctaaagttatggcagagcaggtcgatgaatctgttacggcaggcatgaatacttttttcgctgagttcgcttcatgtttgacggaattacagacgcgtttacgcgaaagtctggctctgcgtcaacaaaatgaatccgtggtcaggctgatgcaacagcaattgcagcagactgtgatgactcacggctggatttacaccgacgctcagctgttacgcgatgatattcaaacacttttcacggcagaacgatattga

SEQ ID NO: 9494 - protein, 742 aa, Escherichia coli
MYTQTLYELSQEAERLLQLSRQQLQLLEKMPLSVPGDDAPQLALPWSQPNIAERHAMLNNELRKISRLEMVLAIAGTMKAGKSTTINAIVGTEVLPNRNRPMTALPTLIRHTPGQKEPVLHFSHVAPIDHLIQQLQQRLRDCDIKHLTDVLEIDKDMRALMQRIENGIAFEKYYLGAQPIFHCLKSLNDLVRLAKALDVDFPFSAYAAIEHIPVIEVEFVHLAGLESYPGQLTLLDTPGPNEAGQPHLQKMLNQQLARASAVLAVLDYTQLKSISDEEVREAILAVGQSVPLYVLVNKFDQQDRNSDDADQVRALISGTLMKGCITPQQIFPVSSMWGYLANRARHELANNGKLPPPEQQRWVEDFAHAALGRRWRHADLADLEHIRHAADQLWEDSLFAQPIQALLHAAYANASLYALRSAAHKLLNYAQQAREYLDFRAHGLNVACEQLQQNIHQVEESLQLLQLNQAQVSGEIKHEIELALTSTNHFLRQQQDAVNAQLAALFQDDSESLSEMRTRCETLLQTAQNTISRDFTLRFAELESTLCRVLTDVIRPIEQQVKMELSESGFRPGFHFPVFHGVVPHFNTRQLFSDAISRQEATDEQITRFGVVREIFSRWLNQPDWGRGNEKFPTETVDYSVLQRALSAEVDLYCQQMAKVMAEQVDESVTAGMNTFFAEFASCLTELQTRLRESLALRQQNESVVRLMQQQLQQTVMTHGWIYTDAQLLRDDIQTLFTAERY

SEQ ID NO: 9495 - DNA, 879 bp, Escherichia coli
ttgaccaagacgttactggacggccccggtcgcgtgctggagtcggttcatccgcgctttttagtggatctggcgcagggcgatgatgcccgccttccacaagcccatcagcagcagtttcgtgaacgactgatgcaggaacttcttgcgcgcgtgcagcttcagacatggacgaacggcggcatgttaaatgcgccgcttagcctgcgtctgacattggtggaaaaactggcgtcgatgctggatcccggtcatctggcgctgacgcagatcgcgcagcatctggcgctgctgcaaaaaatggatcaccgccagcactctgctttcccggagctcccccagcaaattgtcgacttgtatgagtggttttcagcccgttgtcgctggaaggaaaaggcgttaacgcaacgaggcctattggtgcaggcgggtgaacagagcgagcaaatttttacccgctggcgtgctggggcgtataacgcctggtcgttgcctgggcgctgctttatcgttctggaggagttgcgctggggtgcatttggcgatgcctgccgtctgggaagaccgcaagcggtggcgttgttgctgggtgatttgcgcgtgaaagcgacacaacatttggcagagagtatcaatgcggccccgaccacgcgtcactattaccatcagtggtttgcctcttcgaccgtttcgacgggcggggagcatgctgattttttaagttggctgggaaagtggtccacggcagataaacaacccgtttgctggtcagtgacccaacgctggcgaactgtcgcactggggatgccacgactctgttcagcgcagcgtctggcgggagcaatggtcgaggaaatcttctctgtaaatttggtgtaa

SEQ ID NO: 9496 - protein, 292 aa, Escherichia coli
MTKTLLDGPGRVLESVHPRFLVDLAQGDDARLPQAHQQQFRERLMQELLARVQLQTWTNGGMLNAPLSLRLTLVEKLASMLDPGHLALTQIAQHLALLQKMDHRQHSAFPELPQQIVDLYEWFSARCRWKEKALTQRGLLVQAGEQSEQIFTRWRAGAYNAWSLPGRCFIVLEELRWGAFGDACRLGRPQAVALLLGDLRVKATQHLAESINAAPTTRHYYHQWFASSTVSTGGEHADFLSWLGKWSTADKQPVCWSVTQRWRTVALGMPRLCSAQRLAGAMVEEIFSVNLV

SEQ ID NO: 9497 - DNA, 1536 bp, Escherichia coli
ttgcggaaatgggccaactctgcgaggaaagctatgctgaaaaggaaaaaagtaaaaccgattacccttcgtgatgtcaccattattgatgacggtaaactgcgtaaagccattaccgcagcatcactgggtaatgcaatggaatggttcgattttggtgtttatggttttgttgcttacgcattaggtaaagtttttttcccgggggctgaccccagcgtgcagatggttgctgcactcgccactttctccgttccctttctgattcgaccgcttggcgggctcttctttggtatgttgggcgataaatatggtcgccagaagatcctcgctatcactattgtgattatgtcgatcagtacgttctgtattggcttaataccgtcctacgacacgattggtatttgggcaccgattctgctgttgatctgtaagatggcacaaggtttctcggtcggcggtgaatataccggggcgtcaatatttgttgcggaatactcccctgaccgtaaacgtggctttatgggcagctggctggactttggttctattgccgggtttgtgctgggagctggcgtagtggtgttaatttcgaccattgtcggcgaagagaacttcctcgattggggctggcgtattccgttctttatcgctctgccgttagggattatcgggctttacctgcgccatgcgctggaagagactccggcgttccagcagcatgtcgataaactggaacagggcgaccgcgaaggtttgcaggatggcccgaaagtctcgtttaaagagattgccaccaaacactggcgcagcctgttgacatgtattggtctggtaattgccaccaacgtgacttactacatgttgctgacctatatgccgagttatttgtcgcataacctgcattactccgaagaccacggggtgctgattattatcgccattatgatcggtatgctgtttgttcaaccggtgatgggcttgctgagtgaccgttttggccgtcgtccgtttgtgcttcttggtagtgttgcactgtttgtgttggcgatcccggcgtttattctgattaacagtaacgtcatcggcctgatttttgccggcttattgatgctggcggtgatccttaactgctttacgggcgttatggcttctaccttgcctgcgatgttcccgacgcatatccgttacagcgcgctggcggcggcatttaatatttcggtgctggttgccggtctgacgccaacgctggcggcctggctggtcgaaagctcgcagaatctgatgatgcctgcctattacctgatggtagtggcggtggttggtttaatcaccggcgtaaccatgaaagagacggcgaatcgaccgttgaaaggtgcgacaccagcggcgtcagatatacaggaagcgaaggaaattctcgtcgagcattacgataatatcgagcagaaaatcgatgatattgaccacgagattgccgatttgcaggcgaaacgtacccgcctggtgcagcaacatccgcgaattgatgaataa

SEQ ID NO: 9498 - protein, 511 aa, Escherichia coli
MRKWANSARKAMLKRKKVKPITLRDVTIIDDGKLRKAITAASLGNAMEWFDFGVYGFVAYALGKVFFPGADPSVQMVAALATFSVPFLIRPLGGLFFGMLGDKYGRQKILAITIVIMSISTFCIGLIPSYDTIGIWAPILLLICKMAQGFSVGGEYTGASIFVAEYSPDRKRGFMGSWLDFGSIAGFVLGAGVVVLISTIVGEENFLDWGWRIPFFIALPLGIIGLYLRHALEETPAFQQHVDKLEQGDREGLQDGPKVSFKEIATKHWRSLLTCIGLVIATNVTYYMLLTYMPSYLSHNLHYSEDHGVLIIIAIMIGMLFVQPVMGLLSDRFGRRPFVLLGSVALFVLAIPAFILINSNVIGLIFAGLLMLAVILNCFTGVMASTLPAMFPTHIRYSALAAAFNISVLVAGLTPTLAAWLVESSQNLMMPAYYLMVVAVVGLITGVTMKETANRPLKGATPAASDIQEAKEILVEHYDNIEQKIDDIDHEIADLQAKRTRLVQQHPRIDE

SEQ ID NO: 9499 - DNA, 1101 bp, Escherichia coli
ttgaatctgatgcgttttctgcgccgaccaatatcgctgcgccaacggctgatattgaccatcggggccattttgttggtgtttgagctgatcagcgtcttctggctgtggcatgaaagtaccgagcagattcagctgtttgagcaggcgctacgcgacaatcgcaacaacgatcgccacatcatgcgtgagatccgcgaggcggtcgccagcctgattgtccccggcgtctttatggttagcctgacgctatttatctgctatcaggcggtacgccgcatcacccgaccgctggcggagctgcaaaaagagctggaagcgcgcaccgccgataacttaacgcccattgccattcatagcgccaccctcgaaatcgatgcggtggtttcggcgttaaacgatctggtcagtcgcctgaccagcacgctggataacgaaaggttgtttaccgctgacgtcgcgcacgaactgcgaacgccactggcgggggtgcgtttgcatctggaactgctggcgaaaacgcatcacattgatgtagcaccgttagtggcacgacttgatcagatgatggagagcgtctcccagctgctgcaactggcgcgtgccggacagtcattttcttccggtaattatcaacatgtaaaactgctggaagatgtcattctcccctcgtatgacgaacttagtaccatgctcgaccagcgccagcaaaccctgctattgccagagagcgccgccgacatcaccgttcagggtgatgcaaccctgctgcggatgttattgcgaaacctggtagaaaacgcccatcgttatagcccacaaggcagcaacattatgattaagctgcaagaagatggcggagcggtcatggccgttgaagatgaagggccgggtattgatgagagtaaatgcggggagttgagtaaagcgtttgtacgaatggacagccgttatggcgggattggtctggggttaagtattgtcagccgcattacacagttgcatcacgggcagtttttcctgcaaaaccggcaagagacttccggcacgcgggcctggatacggctgaaaaaagatcagtacgtggcaaaccagatataa

SEQ ID NO: 9500 - protein, 366 aa, Escherichia coli
MNLMRFLRRPISLRQRLILTIGAILLVFELISVFWLWHESTEQIQLFEQALRDNRNNDRHIMREIREAVASLIVPGVFMVSLTLFICYQAVRRITRPLAELQKELEARTADNLTPIAIHSATLEIDAVVSALNDLVSRLTSTLDNERLFTADVAHELRTPLAGVRLHLELLAKTHHIDVAPLVARLDQMMESVSQLLQLARAGQSFSSGNYQHVKLLEDVILPSYDELSTMLDQRQQTLLLPESAADITVQGDATLLRMLLRNLVENAHRYSPQGSNIMIKLQEDGGAVMAVEDEGPGIDESKCGELSKAFVRMDSRYGGIGLGLSIVSRITQLHHGQFFLQNRQETSGTRAWIRLKKDQYVANQI

SEQ ID NO: 9501 - DNA, 669 bp, Escherichia coli
atgaaaattctgattgttgaagacgatacgctgttattgcagggattgattctggcggcgcaaaccgaaggctacgcgtgcgatggcgtgagcaccgcgcggatggcggaacaaagccttgaagccggtcattacagcctggtggtactggatttaggcttacccgatgaagatgggctgcattttcttgcccgtatccggcagaaaaaatacactctgccggtgttaattctcaccgcccgcgatacccttaccgacaaaatcgccgggctggatgtcggggccgacgattatctggtgaagccttttgcgctggaagagttgcacgcccgtatccgcgccctgctacgacgccataataatcagggcgaaagtgagctgaacgttggcaacctgacgctgaatatgggtcgccgccaggtatggatgagcggagaagaactgattctgacgcccaaagaatatgctctgctgtcgcgcctgatgcttaaagcaggcagcccggtgcatcgggaaattctctacaacgatatctacaactgggacaacgagccctcgaccaacaccctggaagtgcatatccataacctgcgcgacaaagtgggcaaagcccgtatccgcaccgtgcgcggatttggctatatgctggtcgcaaatgaggaaaactaa

SEQ ID NO: 9502 - protein, 222 aa, Escherichia coli
MKILIVEDDTLLLQGLILAAQTEGYACDGVSTARMAEQSLEAGHYSLVVLDLGLPDEDGLHFLARIRQKKYTLPVLILTARDTLTDKIAGLDVGADDYLVKPFALEELHARIRALLRRHNNQGESELNVGNLTLNMGRRQVWMSGEELILTPKEYALLSRLMLKAGSPVHREILYNDIYNWDNEPSTNTLEVHIHNLRDKVGKARIRTVRGFGYMLVANEEN

SEQ ID NO: 9503 - DNA, 1689 bp, Escherichia coli
ttgctttgcgagcatatgcgcactttgttcgatggaaacaccgtgatgttgaagcgcctactaaaaagaccctctttgaatttactcgcctggctattgttagccgctttttatatctctatctgcctgaatattgccttttttaaacaggtgttgcaggcgctgccgctggactcgctgcataacgtactggttttcttgtcgatgccggtcgtcgccttcagcgtgattaatattgtcctgacactaagctctttcttgtggcttaatcgaccgctggcctgcctgtttattctggttggcgcggctgcacaatatttcataatgacttacggcatcgtcatcgaccgctcgatgattgccaatattattgataccactccggcagaaagttatgcgttgatgacgccgcaaatgttattaacgctgggattcagcggcgtgcttgctgcgctgattgcctgctggatcaaaatcaaacccaccacctcacgcctgcgcagcgttcttttccgcggggccaacatcctgatttctgtactgctgattctgctggttgccgcactgttctacaaagactatgcatcgctgtttcgcaacaacaaagaactggtgaaatccttaagcccgtccaacagcattgttgctagctggtcgtggtactctcaccagcggtcagccaacctgccactgatacgcattggtgaagatgctcaccgcaacccattaatgcaaaatgggaaacgcaaaaacctgaccattttgatcgtcggagaaacgtcgcgcgcagagaatttctcgctgaatggttatccacgcgaaaccaatcctcgcctggcaaaagataacgtggtctatttccctaataccgcctcttgtggcacagcaacagccgtctcagtgccgtgcatgttctcggatatgccgcgtgagcactacaaagaagagctggcacagcaccaggaaggcgtgctggatatcattcagcgagcgggcatcaacgtgctgtggaatgacaacgatggcggctgtaaaggcgtttgcgatcgcgtacctcaccagaacgtcaccgcgctgaacctgcctggtcagtgcatcaacggcgaatgctatgacgaagtgctgttccacgggctggaagagtacatcaataatctgcaaagcgatggcctcattgtattacacactatcggcagccacggcccgacctattacaaccgctatccgccgcagttcaggaaatttaccccaacctgcgacactaacgagatccagacctgtacccaagagcaactggtgaacacttacgacaacacgctggtttacgtcgactatattgttgataaagcgattaatctgctgaaagaacatcaggataaatttaccaccagcctggtttatctttctgaccacggtgaatcgttaggtgaaaatggcatctatctgcacggtctgccttatgccatcgccccggatagccaaaaacaggtgccgatgctgctgtggctatcggaggattatcaaaaacggtatcaggttgaccagaactgcctgcaaaaacaggcgcaaacgcaacactattcacaagacaatttattctcaaccttattgggcctgactggcgttgagacgaagtattaccaggctgcggatgatattctgcaaacttgcaggagagtgagtgaatga

SEQ ID NO: 9504 - protein, 562 aa, Escherichia coli
MLCEHMRTLFDGNTVMLKRLLKRPSLNLLAWLLLAAFYISICLNIAFFKQVLQALPLDSLHNVLVFLSMPVVAFSVINIVLTLSSFLWLNRPLACLFILVGAAAQYFIMTYGIVIDRSMIANIIDTTPAESYALMTPQMLLTLGFSGVLAALIACWIKIKPTTSRLRSVLFRGANILISVLLILLVAALFYKDYASLFRNNKELVKSLSPSNSIVASWSWYSHQRSANLPLIRIGEDAHRNPLMQNGKRKNLTILIVGETSRAENFSLNGYPRETNPRLAKDNVVYFPNTASCGTATAVSVPCMFSDMPREHYKEELAQHQEGVLDIIQRAGINVLWNDNDGGCKGVCDRVPHQNVTALNLPGQCINGECYDEVLFHGLEEYINNLQSDGLIVLHTIGSHGPTYYNRYPPQFRKFTPTCDTNEIQTCTQEQLVNTYDNTLVYVDYIVDKAINLLKEHQDKFTTSLVYLSDHGESLGENGIYLHGLPYAIAPDSQKQVPMLLWLSEDYQKRYQVDQNCLQKQAQTQHYSQDNLFSTLLGLTGVETKYYQAADDILQTCRRVSE

SEQ ID NO: 9505 - DNA, 1338 bp, Escherichia coli
atgtcttcggatgctgatgctcacaaagtgggcttaatccccgtcaccctgatggtgtcggggaatattatggggtcaggtgtttttctgttacctgcaaacctggcctccactggcgggattgccatttatggatggttggtgacgattatcggtgcgctggggctctcgatggtatacgccaaaatgtcgttcctcgacccaagtcctggtggttcttacgcttacgcccgccgctgctttggcccgtttctcggttatcaaaccaacgtcctctactggctggcctgctggatcggcaatatcgctatggtggtcattggcgtaggatatttaagttacttcttcccgattctgaaagatccattggtattaaccatcacctgcgtcgtggtgctgtggatcttcgtcctgctgaacattgtcggtccgaaaatgatcacccgcgtacaggccgttgctaccgtgctggcgctgatccccatcgtcgggattgccgtatttggctggttctggttccgtggtgaaacctatatggcggcatggaacgtcagcggcctgggcaccttcggtgcgattcaaagtacccttaacgttacgctgtggtcgttcatcggtgtggaaagtgcctccgttgccgcaggtgtggtgaaaaacccgaaacgcaacgtccctatcgccaccattggcggggtattgattgctgccgtttgctatgtactttctaccaccgcgattatggggatgatccctaatgccgcactgcgcgtttctgcttcgccattcggtgatgccgcacggatggcgttgggtgacaccgccggggccattgtttccttctgcgcagctgcgggttgcttaggttcactgggcggctggacgttgctggcgggtcaaacggcgaaagccgctgccgatgacggactgttcccaccgatttttgcccgtgtaaataaagcgggcacgccagtggcggggctgattatcgtcggtattttgatgaccatcttccagctcagtagcatttcgccaaacgcgaccaaagaattcggtctggtttcttccgtgtcggtcatctttacactggtgccatatctttacacctgtgcggcgttactactgctcggccacggtcactttggtaaagcacgcccggcatatctggcagtgactaccattgccttcctctactgcatctgggccgtagtagggtccggcgcgaaagaggttatgtggtcatttgtcactctgatggtaatcaccgccatgtatgcgctgaattacaaccggctgcataaaaacccgtatcccttagatgcaccaataagcaaagattaa

SEQ ID NO: 9506 - protein, 445 aa, Escherichia coli [sequence omitted]

SEQ ID NO: 9507 - DNA, 762 bp, Escherichia coli
atgaggatttgcagcgaccaaccttgtattgttttattgactgaaaaagatgtctggataagggtgaatgggaaagaacctattagccttaaagctaaccacatggcgttattaaattgtgaaaataatattatcgacgtctcctctcttaataacactttggttgctcatattagtcacgacatcatcaaagattacctccggtttctgaataaagatctctcgcaaataccagtatggcaacgtagcgctacgcccatcctcaccctgccatgcctgacgccagacgtctttcgcgttgccgcgcagcatagcatgatgcccgctgaaactgagtcagaaaaggaacgaacacgtgcattattattcactgtgctatcccgttttctcgacagtaaaaaattcctttcactaatgatgtatatgttacgtaattgtgtaagtgacagcgtttatcaaattattgaaagcgatatccacaaagactggaatcttagtatggtagccagttgtttatgtcttagcccaagtctgttaaagaaaaagctgaaaagcgaaaacaccagttatagccaaataatcaccacctgccgcatgcgttatgccgtaaatgaattaatgatggacggtaaaaatatctctcaggtatcacagtcctgcggctacaacagtacgtcgtactttatttctgtctttaaagacttctacggtatgacgccgctgcattatgttagtcagcacagagaacgcactgtcgcctga

SEQ ID NO: 9508 - protein, 253 aa, Escherichia coli
MRICSDQPCIVLLTEKDVWIRVNGKEPISLKANHMALLNCENNIIDVSSLNNTLVAHISHDIIKDYLRFLNKDLSQIPVWQRSATPILTLPCLTPDVFRVAAQHSMMPAETESEKERTRALLFTVLSRFLDSKKFLSLMMYMLRNCVSDSVYQIIESDIHKDWNLSMVASCLCLSPSLLKKKLKSENTSYSQIITTCRMRYAVNELMMDGKNISQVSQSCGYNSTSYFISVFKDFYGMTPLHYVSQHRERTVA

SEQ ID NO: 9509 - DNA, 162 bp, Escherichia coli
atgctgctgtctggtgaaaacttcggcgataaaaacagtccgcaagtaagttatttacgctcgctgcaatcctgggaccatcatttccctggatttgaacacgaaacagaagggacagaaattattgacggtatttaccacgttatgtgtgtgaaagcgtaa

SEQ ID NO: 9510 - protein, 53 aa, Escherichia coli
MLLSGENFGDKNSPQVSYLRSLQSWDHHFPGFEHETEGTEIIDGIYHVMCVKA

SEQ ID NO: 9511 - DNA, 1992 bp, Escherichia coli
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagatactgccgactttatcgccggacgcgccgttgccgcgatgacccgctaccgccagcagctattgccgccactgttcagcgcgctgatgaaatatagcgacatccatgaatattcctgggcagcgccaggccaccagggcggcgttggttttaccaaaacacccgccggacgtttctaccatgactactatggtgaaaatctgttccgcaccgacatgggcatcgaacgcacttccctcggttctttgcttgaccatactggcgcatttggcgaaagcgaaagatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggcttgatgctgacaggcgcgaaaccggtctacatggtgccaagccgcaaccgctacggcattatcgggccaatctatccgcaggaaatgcaacctgaaaccttgcagaagaaaatcagtgaaagcccgctgaccaaagacaaagtcgggcaaaaaccgtcttactgcgtggtgaccaactgtacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcccaggcctcttatattcatgtacgtgaaggtcgtggggcgattaacttctcccgcttcaaccaggcctacatgatgcatgccaccacctccccgctgtatgccatctgcgcatccaacgacgtggcagtgtcgatgatggacggcaacagcggcctgtcactgacccaggaagtgatcgacgaagcggttgatttccgtcaggcgatggcgcggctgtataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtcatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcacagcctggcttggtcgccacggcattgtgcctacccgtaccactgacttccagattatgttcctgttctctatgggcgtgacccgtgggaaatgggggactctggttaacaccctttgctccttcaaacgccactatgatgccaacacaccgctggcgcaggtgatgccggaacttgttgaacaatatcctgacacttacgcgaacatagggattcacgatctgggtgacaccatgtttgcctggctgaaagaaaacaaccctggcgcacggttgaatgaagcctattccggcctaccggtccccgcgtga

SEQ ID NO: 9512 - protein, 663 aa, Escherichia coli
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESERYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKVGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANIGIHDLGDTMFAWLKENNPGARLNEAYSGLPVPA

SEQ ID NO: 9513 - DNA, 909 bp, Escherichia coli
atgaatacagatacgtttatgtgcagcagcgacgaaaagcagacccgtagcccactgtcgctgtattcagaataccagcggatggaaattgagtttcgcgcaccgcatatcatgcccaccagccactggcatggtcaggtcgaagtgaatgtgcctttcgatggcgatgtggaatacctgatcaacaatgaaaaagtgaatatcaatcagggtcatatcacgctgttctgggcctgtacaccgcaccaactaacagataccggaacctgtcagagcatggcgatttttaatctgccgatgcatctgtttctctcctggccgctggataaagacctgattaaccacgtcactcacggcatggtgatcaaatcactggcgacacagcaacttagcccgtttgaagtgcgccgctggcagcaggaattaaacagtcagaacgagcaaattcgccagctcgccattgatgaaattggcctgatgctcaagcgatttagcctctctggctgggaaccgattctggtcaataaaacctcgcgcacacacaaaaacagcgtctcgcgccatgcgcaattttatgtcagccagatgctgggctttattgccgaaaactatgatcaggcgctgaccatcaacgatgtggctgagcacgtcaaacttaacgccaactatgcaatggggatattccagcgggtcatgcaattgacgatgaaacagtacattaccgcgatgcgcatcaaccacgttcgcgcgttactgagcgataccgataaaagtattctcgatattgccctgacggcaggctttcgttcgagtagccgtttttacagcacgttcggcaaatatgtcggcatgtcgccgcaacaataccgcaaacttagccaacagcgccgccagacgtttcccggctaa

SEQ ID NO: 9514 - protein, 302 aa, Escherichia coli
MNTDTFMCSSDEKQTRSPLSLYSEYQRMEIEFRAPHIMPTSHWHGQVEVNVPFDGDVEYLINNEKVNINQGHITLFWACTPHQLTDTGTCQSMAIFNLPMHLFLSWPLDKDLINHVTHGMVIKSLATQQLSPFEVRRWQQELNSQNEQIRQLAIDEIGLMLKRFSLSGWEPILVNKTSRTHKNSVSRHAQFYVSQMLGFIAENYDQALTINDVAEHVKLNANYAMGIFQRVMQLTMKQYITAMRINHVRALLSDTDKSILDIALTAGFRSSSRFYSTFGKYVGMSPQQYRKLSQQRRQTFPG

SEQ ID NO: 9515 - DNA, 1356 bp, Escherichia coli
atgatgtctgcacccaaaattacatttatcggcgctggttcgacgattttcgttaaaaatattcttggtgatgtgttccatcgagaggcgctgaaaacggcgcatattgccctgatggatatcgatcccacccgcctggaagagtcgcacattgtggtgcgtaagctgatggattcagcaggggccagcggcaaaatcacctgccacacccaacagaaagaagccttacaggatgctgattttgtggtggtggcatttcagattggcggttatgaaccttgcacggtgactgatttcgaggtctgtaagcggcatggtctggaacaaaccattgccgatacgctggggccgggcggcattatgcgtgcgctacgtaccattccgcacctgtggcagatttgcgaggacatgacggaagtctgccccgatgccaccatgctcaactacgttaatccaatggcgatgaatacctgggcgatgtatgcccgctatccgcatatcaagcaggtagggctgtgccattcggtgcagggaacggcggaagagctggcgcgtgacctcaatatcgacccggctacgctgcgttaccgttgcgcaggtatcaaccatatggcgttttacctggaactggagcgcaaaaccgccgacggcagttacgtgaatctctacccggaactgctggcggcttatgaagcagggcaggcaccgaagccaaatattcatggtaatactcgctgccagaatattgtgcgttacgaaatgttcaaaaagctgggctacttcgtcacagaatcgtcagaacattttgctgagtacacaccgtggtttattaagccaggtcgtgaggatttgattgagcgttataaagtaccgctggatgagtacccgaaacgctgcgtcgagcagctggcgaactggcataaagagctggaggagtataaaaacgcctcccggattgatattaaaccgtcacgggaatatgccagcacaatcatgaacgctatctggactggcgagccgagtgtgatttatggcaatgtccgtaacgatggcttgattgataacctgccacaaggatgttgcgtggaagtggcctgtctggttgatgctaatggcattcagccgaccaaagccggtacgctaccttcgcatctggccgccctgatgcaaaccaacatcaacgtacagacgctgctgacagaagctattcttacggaaaatcgcgaccgtgtttaccacgccgcgatgatggacccgcatactgccgccgtgctgggcattgacgaaatatatgctcttgttgacgacctgattgccgcccacggcgactggctgccaggctggttgcaccgttaa

SEQ ID NO: 9516 - protein, 451 aa, Escherichia coli
MMSAPKITFIGAGSTIFVKNILGDVFHREALKTAHIALMDIDPTRLEESHIVVRKLMDSAGASGKITCHTQQKEALQDADFVVVAFQIGGYEPCTVTDFEVCKRHGLEQTIADTLGPGGIMRALRTIPHLWQICEDMTEVCPDATMLNYVNPMAMNTWAMYARYPHIKQVGLCHSVQGTAEELARDLNIDPATLRYRCAGINHMAFYLELERKTADGSYVNLYPELLAAYEAGQAPKPNIHGNTRCQNIVRYEMFKKLGYFVTESSEHFAEYTPWFIKPGREDLIERYKVPLDEYPKRCVEQLANWHKELEEYKNASRIDIKPSREYASTIMNAIWTGEPSVIYGNVRNDGLIDNLPQGCCVEVACLVDANGIQPTKAGTLPSHLAALMQTNINVQTLLTEAILTENRDRVYHAAMMDPHTAAVLGIDEIYALVDDLIAAHGDWLPGWLHR

SEQ ID NO: 9517 - DNA, 651 bp, Escherichia coli
atgacccgcacactcaagccgttaattcttaacaccggcgcactggcgctaacgttaatcctgatttataccggcatttcggcccatgacaaactcacctggctgatggaagtgacaccggtgattattgtcgtgccgctactgcttgccaccgctaaacgttacccgttaacgccgctgctctatacgctcattttctttcacgccatcatcctgatggtcggcgggcaatacacctacgcgaaagtccccgttggttttgaggtgcaggaatggctggggttgagccgtaatccgtatgataaactggggcattttttccaggggctggtgcctgcactggtggcacgagagatcctcgtgcgcgggatgtacgttcgcgggcgtaaaatggtggcgtttctggtctgttgtgtcgcgctggcgataagcgcgatgtatgagttaatcgagtggtgggcagcgctggcaatgggccagggcgcagatgattttctcggtactcaaggcgacccgtgggatacgcaatccgatatgttctgcgcactactgggcgcattaacgacggtgatattcctcgcccgctttcattgccgccagctacggcgctttggcttaatcaccagagcgccggaagcgattaccccttaa

SEQ ID NO: 9518 - protein, 216 aa, Escherichia coli
MTRTLKPLILNTGALALTLILIYTGISAHDKLTWLMEVTPVIIVVPLLLATAKRYPLTPLLYTLIFFHAIILMVGGQYTYAKVPVGFEVQEWLGLSRNPYDKLGHFFQGLVPALVAREILVRGMYVRGRKMVAFLVCCVALAISAMYELIEWWAALAMGQGADDFLGTQGDPWDTQSDMFCALLGALTTVIFLARFHCRQLRRFGLITRAPEAITP

SEQ ID NO: 9519 - DNA, 1647 bp, Escherichia coli
atgtcaaacaaaccctttatctaccaggcacctttcccgatggggaaagacaataccgaatactatctactcacttctgattacgttagcgttgccgacttcgacggcgaaaccatcctgaaagtggaaccagaagccctgaccctgctggcgcagcaagcctttcacgacgcttctttcatgctccgcccggcacaccagaaacaggttgcggctattcttcacgatccagaagccagcgaaaacgacaagtacgtggcgctgcaattcttaagaaactccgaaatcgccgctaaaggcgtgctgccgacctgccaggataccggcaccgcgatcatcgtcggtaaaaaaggtcagcgcgtgtggaccggtggcggtgatgaagaagcgctgtcgaaaggcgtctataacacctatatcgaagataacctgcgctattcacagaacgcgccgctggacatgtataaagaggtcaacaccggcacgaacctgcctgcgcaaatcgacctgtacgcggtagatggcgatgagtacaaattcctctgtgtcgctaaaggcggcggctctgccaacaaaacgtatctctaccaggaaaccaaagccctgctgacgcccggcaaactgaaaaacttcctcgtcgagaaaatgcgtaccctcggtactgcagcctgcccgccgtaccatatcgcgtttgtgattggcggtacgtctgcggaaaccaacctgaaaaccgtcaagttagcaagcgctcactattacgatgaactgccgacggaagggaacgaacatggtcaggcgttccgcgatatccagctggaacaggaactgctggaagaggcccagaaactcggtcttggcgcgcagtttggcggtaaatacttcgcgcacgacatccgcgttatccgtctgccacgtcacggcgcatcctgcccggtaggcatgggagtctcctgctccgctgaccgtaacattaaagcgaaaatcaaccgcgaaggtatctggatcgaaaaactggaacacaatccaggccagtacattccagaagaactgcgtcaggcaggtgaaggcgaagcagtgaaagtcgaccttaaccgcccgatgaaagagatccttgcccagctttcgcaatacccggtatccacccgcttgtcgctcaccggcaccattatcgtgggtcgcgatattgcacacgccaagctgaaagagctgattgacgccggtaaagaactgccgcagtacatcaaagatcacccgatctactacgcgggtccggcgaaaacgcctgccggttatccatcaggttcacttggcccaaccaccgcaggtcgtatggactcctacgtggatctgctgcaatcccacggcggcagcatgatcatgctggcgaaaggtaaccgcagccagcaggttaccgacgcgtgccataaacacggcggcttctacctcggtagcatcggcggtccggcggcggtactggcgcagcagagcatcaagcatctggaatgcgtcgcttatccggagctgggtatggaagctatctggaaaatcgaagtagaagatttcccggcgtttatcctggtcgatgacaaaggtaacgacttcttccagcagatcgtcaacaaacagtgcgcgaactgcactaagtaa

SEQ ID NO: 9520 - protein, 548 aa, Escherichia coli
MSNKPFIYQAPFPMGKDNTEYYLLTSDYVSVADFDGETILKVEPEALTLLAQQAFHDASFMLRPAHQKQVAAILHDPEASENDKYVALQFLRNSEIAAKGVLPTCQDTGTAIIVGKKGQRVWTGGGDEEALSKGVYNTYIEDNLRYSQNAPLDMYKEVNTGTNLPAQIDLYAVDGDEYKFLCVAKGGGSANKTYLYQETKALLTPGKLKNFLVEKMRTLGTAACPPYHIAFVIGGTSAETNLKTVKLASAHYYDELPTEGNEHGQAFRDIQLEQELLEEAQKLGLGAQFGGKYFAHDIRVIRLPRHGASCPVGMGVSCSADRNIKAKINREGIWIEKLEHNPGQYIPEELRQAGEGEAVKVDLNRPMKEILAQLSQYPVSTRLSLTGTIIVGRDIAHAKLKELIDAGKELPQYIKDHPIYYAGPAKTPAGYPSGSLGPTTAGRMDSYVDLLQSHGGSMIMLAKGNRSQQVTDACHKHGGFYLGSIGGPAAVLAQQSIKHLECVAYPELGMEAIWKIEVEDFPAFILVDDKGNDFFQQIVNKQCANCTK

SEQ ID NO: 9521 - DNA, 1341 bp, Escherichia coli
atgttatttactatccaacttatcataatactgatatgtctgttttatggtgccagaaaggggggtatcgcgctgggtttattaggcggtatcggtctggtcattctggtcttcgtcttccaccttcagccaggtaaaccaccggttgatgtcatgctggttatcattgcggtggtggcggcatcggcgaccttgcaagcttcgggcggtcttgatgtcatgctgcaaattgccgagaagctgctgcgtcgcaacccgaaatatgtctcaattgtcgcgccgtttgtgacctgtacgctgaccattctttgcggtacgggtcatgtggtttacaccattctgccgatcatctacgacgttgctattaagaacaacatccgtccggaacgtccgatggcggcaagttctatcggtgcacagatggggattatcgccagtccggtgtcggttgcggtcgtatctttggttgcgatgctgggtaatgtcacctttgatggtcgccatcttgagttcctcgacctgctggcaatcaccattccatcgacgttaatcggtatcctggcgatcggtatcttcagctggttccgcggtaaagatctggataaagacgaagagttccaaaaattcatctccgtaccggaaaaccgtgagtatgtttacggtgataccgcgacgctgctggataaaaaactgccgaaaagcaactggctggcaatgtggatcttcctcggggcaatcgctgtagtcgcccttcttggtgctgattcggacctgcgtccatccttcggcggcaaaccgctgtcgatggtactggttattcagatgtttatgctgctgaccggggcgctgattattatcctgaccaaaaccaatcccgcgtctatctcaaaaaacgaagtcttccgttccggtatgatcgccatcgtggcggtgtacggtatcgcatggatggctgaaaccatgttcggtgcgcatatgtctgaaattcagggcgtactgggtgaaatggtgaaagagtatccgtgggcctatgccattgttctgctgctggtttccaagtttgtaaactctcaggctgcggcgctggcggcgattgttccggtcgcgctggcgatcggcgttgatccggcatacatcgtggcttcagcaccggcttgctacggttattacatcctgccgacttatccgagcgatctggcagcgattcagtttgaccgttccggcaccacccacatcggtcgcttcgtcatcaaccacagctttattctgccggggttgattggtgtgagcgtatcgtgcgtcttcggctggatcttcgccgcgatgtacgggttcttataa

SEQ ID NO: 9522 - protein, 446 aa, Escherichia coli
MLFTIQLIIILICLFYGARKGGIALGLLGGIGLVILVFVFHLQPGKPPVDVMLVIIAVVAASATLQASGGLDVMLQIAEKLLRRNPKYVSIVAPFVTCTLTILCGTGHVVYTILPIIYDVAIKNNIRPERPMAASSIGAQMGIIASPVSVAVVSLVAMLGNVTFDGRHLEFLDLLAITIPSTLIGILAIGIFSWFRGKDLDKDEEFQKFISVPENREYVYGDTATLLDKKLPKSNWLAMWIFLGAIAVVALLGADSDLRPSFGGKPLSMVLVIQMFMLLTGALIIILTKTNPASISKNEVFRSGMIAIVAVYGIAWMAETMFGAHMSEIQGVLGEMVKEYPWAYAIVLLLVSKFVNSQAAALAAIVPVALAIGVDPAYIVASAPACYGYYILPTYPSDLAAIQFDRSGTTHIGRFVINHSFILPGLIGVSVSCVFGWIFAAMYGFL

SEQ ID NO: 9523 - DNA, 159 bp, Escherichia coli
atgaactgttttcagagcctgactaaatatccgtttggtcgttaccggcttgagcaaatacctcacagtgaatattggctgattaaagcagcggcaaatttatgcactgtgataagcggctttttcagagagaaagactctctggcgatgggtttatag

SEQ ID NO: 9524 - protein, 52 aa, Escherichia coli
MNCFQSLTKYPFGRYRLEQIPHSEYWLIKAAANLCTVISGFFREKDSLAMGL

SEQ ID NO: 9525 - DNA, 720 bp, Escherichia coli
atgatcaatgtattaattatcgatgacgacgcaatggtcgcggagctgaatcgccgatacgtggcacaaatcccgggctttcaatgctgtggaacggcttcgacgctggagaaagccaaagagattatcttcaatagcgatacgcctatcgacctgatattgctagatatctatatgcaaaaagagaacgggctcgatttactgcctgtcctgcataacgcgcgttgcaaaagtgatgtgattgtcatctcctccgctgccgatgcagtaaccattaaagattcgctgcattacggtgttgtggattacctgatcaaacccttccaggcttcccgctttgaagaggcgctcaccggctggcggcaaaagaaaatggcgctggaaaaacatcagtattatgaccaggccgagcttgatcagctaatccacggcagcagctccaacgagcaggatcctcgtcgcttgccaaaaggcttaacgccgcagacgttacgcacgctgtgccagtggattgacgcgcatcaggactatgagttttcaaccgacgagctggctaacgaggttaacatctcgcgtgtttcctgccgtaaataccttatctggctggtcaactgccacatattgttcaccagtatccattatggcgtcacggggcgtccggtttaccgttaccgtattcaggcagaacactactcactactgaaacaatattgccaataa

SEQ ID NO: 9526 - protein, 239 aa, Escherichia coli
MINVLIIDDDAMVAELNRRYVAQIPGFQCCGTASTLEKAKEIIFNSDTPIDLILLDIYMQKENGLDLLPVLHNARCKSDVIVISSAADAVTIKDSLHYGVVDYLIKPFQASRFEEALTGWRQKKMALEKHQYYDQAELDQLIHGSSSNEQDPRRLPKGLTPQTLRTLCQWIDAHQDYEFSTDELANEVNISRVSCRKYLIWLVNCHILFTSIHYGVTGRPVYRYRIQAEHYSLLKQYCQ

SEQ ID NO: 9527 - DNA, 1527 bp, Escherichia coli
gtgcatctgatttacttctcgcaaatcagtgatatgacgcgagacgggctagctaacaaggcactggcagtagcgcgtaccctcgccgactcgccggaaatccgtcagggcttgcagaaaaaaccgcaggagagtggaatccaggccatcgcggaagccgtgcgcaaacgcaacgatctgctgtttattgtcgttaccgatatgcaaagccttcgctactcgcatcctgaagcccagcgtattggtcagccatttaaaggtgatgacatccttaaagcgctgaatggcgaagaaaatgtcgctatcaatcgcggttttctggcgcaggctttacgcgtatttacccccatctacgatgaaaatcataaacaaattggcgtggtggcgatcggccttgagttaagccgcgtgacccaacagatcaatgacagtcgctggagcattatctggtcggtactatttggcatgctggtcggactgatcggcacatgcattctggttaacgtactgaaaaaaatccttttcggcctggaaccctacgaaatctccacactgtttgagcaacgccaggccatgttgcagtccatcaaagaaggcgtcgttgccgtggacgatcgcggcgaggtcacgctgatcaacgatgccgcacaagaattgctgaattaccgtaagtcgcaggacgatgagaaactgtcgacgctaagccactcgtggtcacaggtggtagatgtctcggaagtgttacgcgacggaaccccacgccgcgacgaagagattacgattaaggaccgactattactgatcaacaccgttccggtgcgcagtaatggcgttatcatcggtgccatttcaaccttcagggacaaaactgaagtacgtaaactgatgcagcgactcgacggtctggtcaactatgctgacgcacttcgtgaacgatcccacgaatttatgaataaattgcatgtgattctcggattattgcatctgaagagttataagcagttggaagattacattctcaaaacagccaataactatcaggaagagattggctctctgctgggtaagatcaaatctccggttatcgctggttttttaatcagcaagattaaccgcgcgaccgatttaggccatacgctgattttaaacagtgaaagccagctgccagacagcggtagtgaggatcaggtcgcgacgctgattaccacgttgggaaatctgatagaaaacgcgctggaggcattaggaccggaacccggtggcgaaattagcgtaacattgcactaccgtcacggctggctgcactgcgaagttaacgatgatggaccggggatcgcacccgacaaaatcgatcacatttttgacaaaggtgtctcgacaaaaggaagcgagcgaggcgtcggtttagcacttgtcaaacaacaggtagaaaatctcggcggcagcatcgccgtggaatcggaacccgggattttcacacaattttttgtccagataccctgggacggggagaggtcgaacagatga

SEQ ID NO: 9528 - protein, 508 aa, Escherichia coli
MHLIYFSQISDMTRDGLANKALAVARTLADSPEIRQGLQKKPQESGIQAIAEAVRKRNDLLFIVVTDMQSLRYSHPEAQRIGQPFKGDDILKALNGEENVAINRGFLAQALRVFTPIYDENHKQIGVVAIGLELSRVTQQINDSRWSIIWSVLFGMLVGLIGTCILVNVLKKILFGLEPYEISTLFEQRQAMLQSIKEGVVAVDDRGEVTLINDAAQELLNYRKSQDDEKLSTLSHSWSQVVDVSEVLRDGTPRRDEEITIKDRLLLINTVPVRSNGVIIGAISTFRDKTEVRKLMQRLDGLVNYADALRERSHEFMNKLHVILGLLHLKSYKQLEDYILKTANNYQEEIGSLLGKIKSPVIAGFLISKINRATDLGHTLILNSESQLPDSGSEDQVATLITTLGNLIENALEALGPEPGGEISVTLHYRHGWLHCEVNDDGPGIAPDKIDHIFDKGVSTKGSERGVGLALVKQQVENLGGSIAVESEPGIFTQFFVQIPWDGERSNR

SEQ ID NO: 9529 - DNA, 156 bp, Escherichia coli
ttgtcacacaaggaagctgatgagacattcattgccctaccgtatgttacgcaaacgtccgatgaaattgagtaccactgtgatcttaatggtcagcgcggtactgttctcggtgctattggtggtgcatctgatttacttctcgcaaatcagtga

SEQ ID NO: 9530 - protein, 51 aa, Escherichia coli
MSHKEADETFIALPYVTQTSDEIEYHCDLNGQRGTVLGAIGGASDLLLANQ

SEQ ID NO: 9531 - DNA, 231 bp, Escherichia coli
atggatcgggcgctactggacgggggttatcgctgttataccggcgaaaatatcgatgtctattttaacactgcgatatgtcagcattctggcaattgcgtacgtggcaacggcaagttatttaatctcaaacgaaagccgtggatcatgccggatgaagtcgacgttgccactgtggttaaagtgattgatacgtgcccgagtggcgcgctgaaataccgtcataaataa

SEQ ID NO: 9532 - protein, 76 aa, Escherichia coli
MDRALLDGGYRCYTGENIDVYFNTAICQHSGNCVRGNGKLFNLKRKPWIMPDEVDVATVVKVIDTCPSGALKYRHK

SEQ ID NO: 9533 - DNA, 273 bp, Escherichia coli
atggaaatacgcgaaggccacaataaattttacattaatgacgaacaaggcaagcaaatcgctgaaattgtctttgtgccgaccggagagaatttagcgattatcgaacataccgatgtcgatgaaagcctgaaagggcaagggattggtaaacagctggttgcgaaagtcgtggaaaaaatgcgtcgggaaaaacgaaaaattatcccactatgcccatttgcgaaacacgaatttgataaaacacgggagtatgatgatattcgcagttga

SEQ ID NO: 9534 - protein, 90 aa, Escherichia coli
MEIREGHNKFYINDEQGKQIAEIVFVPTGENLAIIEHTDVDESLKGQGIGKQLVAKVVEKMRREKRKIIPLCPFAKHEFDKTREYDDIRS

SEQ ID NO: 9535 - DNA, 1518 bp, Escherichia coli
atgtctgaacgagaaacacggggagccaatgaggctattgattttaacgatgaactgagaaatcgccgcgaaaaactggcggcactacgtcagcaaggtgtggcgtttcccaatgattttcgccgcgaccatacctctgaccagttgcacgaagagtttgatgcgaaggataaccaggaactggaatccttaaacattgaagtctcggttgctggccgaatgatgacccgtcgtattatggggaaagcctcctttgtaacgttgcaggatgtcggtggccgtattcaactgtacgttgcaagagatagcctgccagaaggtgtttataacgatcagtttaaaaaatgggatctgggtgacattatcggtgcccgcggtacgctgtttaagacgcaaacgggtgagctttccattcactgtactgagctgcgcctgctgactaaagcactacgtcctttaccagataaattccatggtctgcaggatcaggaagtccgttatcgtcaacgttatctggacctcatcgctaacgataaatcccgtcaaacgtttgttgtccgttcaaaaattctggccgctatccgtcagttcatggtcgcgcgcggctttatggaagtagaaaccccgatgatgcaggtaattccaggtggggcatctgctcgcccgtttattacccatcataacgctctggatttagatatgtacctgcgtatcgcgccggagctgtatctgaaacgtctggttgtaggcggttttgaacgggtattcgaaatcaaccgtaacttccgtaatgaaggtatttctgttcgccataatcctgagttcacaatgatggaactctacatggcatatgcggattaccacgatttgattgaactgacggagtcactgttccgcaccctggcacaagaggtactgggtaccactaaagtcacttatggcgagcatgtgtttgatttcggcaaaccgtttgaaaaactcaccatgcgcgaagcaatcaaaaaatatcgtccagaaaccgatatggcggatctggataattttgatgctgctaaagcattagctgaatctatcggtattacggtagagaaaagctggggactgggacgtattgttacggagatctttgatgaagtggcagaagcacatctgattcagccaacctttattacggaatatccggcagaagtgtccccgctggcgcgccgtaatgatgttaacccggaaatcaccgaccgttttgaattcttcatcggtggtcgtgaaatcggtaatggttttagcgaattaaacgacgcagaagatcaggctgaacgtttccaggaacaggttaacgctaaagctgcaggtgacgacgaagccatgttctatgacgaagattacgtgactgcgctggaatatggtctgccgccaaccgctggtctgggtattggtatcgaccgaatgattatgctgtttacaaacagtcatactattcgcgacgttattctcttcccggcgatgcgcccacagaaataa

SEQ ID NO: 9536 - protein, 505 aa, Escherichia coli
MSERETRGANEAIDFNDELRNRREKLAALRQQGVAFPNDFRRDHTSDQLHEEFDAKDNQELESLNIEVSVAGRMMTRRIMGKASFVTLQDVGGRIQLYVARDSLPEGVYNDQFKKWDLGDIIGARGTLFKTQTGELSIHCTELRLLTKALRPLPDKFHGLQDQEVRYRQRYLDLIANDKSRQTFVVRSKILAAIRQFMVARGFMEVETPMMQVIPGGASARPFITHHNALDLDMYLRIAPELYLKRLVVGGFERVFEINRNFRNEGISVRHNPEFTMMELYMAYADYHDLIELTESLFRTLAQEVLGTTKVTYGEHVFDFGKPFEKLTMREAIKKYRPETDMADLDNFDAAKALAESIGITVEKSWGLGRIVTEIFDEVAEAHLIQPTFITEYPAEVSPLARRNDVNPEITDRFEFFIGGREIGNGFSELNDAEDQAERFQEQVNAKAAGDDEAMFYDEDYVTALEYGLPPTAGLGIGIDRMIMLFTNSHTIRDVILFPAMRPQK

SEQ ID NO: 9537 - DNA, 1458 bp, Escherichia coli
atgaaaacaccctcacagccgcgcgcgatatactatatcgtggcgatccaaatctgggagtacttcagtttttacggcatgcgtgccttactcattctctatctcacccatcagcttggttttgatgataaccatgccatcagcctgttcagcgcatatgcttctctggtttacgttacccctattctcggcggctggcttgccgaccgcctgctcggcaaccgcactgcagtgattgccggcgcgctgttaatgacccttggccatgtggtgctgggcattgatacaaattcaacctttagcctgtatctggcgctggcaatcattatttgtggctacggtttattcaaatcaaacatcagctgtttgcttggcgagctctacgacgagaacgatcatcgacgtgatggcggtttttcgctgctgtatgctgcgggcaatatcggttctatcgccgcgcccatcgcctgcggcctggctgctcagtggtatggatggcatgttggctttgcccttgcgggaggcggcatgtttatcggtttgttgattttcttaagtggtcatcgtcatttccagtccacgcgtagtatggataaaaaagcgctcacaagcgtcaaatttgccttaccagtatggagctggttagtggtgatgctctgtttagccccagtattttttaccctgctgctggagaacgactggtccggatatttgctggcgatcgtttgcctcattgccgcacaaatcattgcccgcatgatgatcaaattccccgaacaccgccgtgctctttggcaaattgtattgttgatgtttgtcgggacgttgttctgggtactggcacaacagggcggcagtaccatcagcttgtttatcgatcgctttgtgaatcgtcaggcattcaatattgaagtacctacagcactattccagtcggtgaatgccattgcggtgatgctcgctggggttgttctggcctggctggcgtcgccagaaagccgcggcaattcagcattgcgcgtctggctgaagtttgcctttggcttactgctgatggcttgtggctttatgttgctggcatttgatgcccgacatgcagcggctggcggtcaagcgtcaatgggcgtgatgatatccgggctggcgctaatgggctttgctgaactctttattgacccggtggcgattgcgcaaatcacgcgtctgaaaatgtctggcgtattaaccggtatttatatgctggcaacaggcgcagtcgccaactggctggcaggcgtcgtggcacagcagacgacagagtcgcaaattagcggtatggcaattgccgcttaccagcgattcttttctcagatgggagagtggacgttggcttgtgtcgcgatcatcgtggtattggcctttgctacccgttttctgtttagcacgccgacgaatatgatacaggagagcaacgattaa

SEQ ID NO: 9538 - protein, 485 aa, Escherichia coli
MKTPSQPRAIYYIVAIQIWEYFSFYGMRALLILYLTHQLGFDDNHAISLFSAYASLVYVTPILGGWLADRLLGNRTAVIAGALLMTLGHVVLGIDTNSTFSLYLALAIIICGYGLFKSNISCLLGELYDENDHRRDGGFSLLYAAGNIGSIAAPIACGLAAQWYGWHVGFALAGGGMFIGLLIFLSGHRHFQSTRSMDKKALTSVKFALPVWSWLVVMLCLAPVFFTLLLENDWSGYLLAIVCLIAAQIIARMMIKFPEHRRALWQIVLLMFVGTLFWVLAQQGGSTISLFIDRFVNRQAFNIEVPTALFQSVNAIAVMLAGVVLAWLASPESRGNSALRVWLKFAFGLLLMACGFMLLAFDARHAAAGGQASMGVMISGLALMGFAELFIDPVAIAQITRLKMSGVLTGIYMLATGAVANWLAGVVAQQTTESQISGMAIAAYQRFFSQMGEWTLACVAIIVVLAFATRFLFSTPTNMIQESND

SEQ ID NO: 9539 - DNA, 2148 bp, Escherichia coli
atgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgatgatattgctaacaagatcaagcagaccactgacgaatatatcaacactattctgcctccgctgaccaaagcactgtttaaatatgttcgtgaaggtaaatatactttctgtactcctggtcacatgggtggtactgcattccagaaaagcccggtaggtagcctgttctatgatttctttggtccgaacaccatgaaatctgatatttccatttcagtatctgaattgggttctctgctggatcacagtggtccacacaaagaagcagaacagtatatcgctcgcgtctttaacgcagaccgcagctacatggtgaccaacggtacttccactgcgaacaaaattgttggtatgtactctgctccggcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtctactcacaaactgctggcggcgttctctcaggcttccatgatccacgttaaaggtgacgtaaacgaagaaacctttaacgaagcctacatgatgcacaccaccacctctccgcactacggtatcgtggcgtccactgaaaccgctgcggcgatgatgaaaggcaatgcaggtaaacgtctgatcaatggttccattgaacgtgcgatcaaattccgtaaagagatcaaacgtctgagaacggaatctgatggctggttctttgatgtatggcagccggatcatatcgatacgactgaatgctggccgctgcgttctgacagcacctggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgacttcaaacgtgcgttcgatctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagttctgccgactatggtaatgactccgtatgctgcgttccagaaagagctgcacggtatgaccgaagaagtttacctcgacgaaatggtaggtcgtattaacgccaatatgatccttccgtatccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaggtattgaaagaagaaagcaaaaaataa

SEQ ID NO: 9540 - protein, 715 aa, Escherichia coli
MNVIAILNHMGVYFKEEPIRELHRALERLNFQIVYPNDRDDLLKLIENNARLCGVIFDWDKYNLELCEEISKMNENLPLYAFANTYSTLDVSLNDLRLQISFFEYALGAADDIANKIKQTTDEYINTILPPLTKALFKYVREGKYTFCTPGHMGGTAFQKSPVGSLFYDFFGPNTMKSDISISVSELGSLLDHSGPHKEAEQYIARVFNADRSYMVTNGTSTANKIVGMYSAPAGSTILIDRNCHKSLTHLMMMSDVTPIYFRPTRNAYGILGGIPQSEFQHATIAKRVKETPNATWPVHAVITNSTYDGLLYNTDFIKKTLDVKSIHFDSAWVPYTNFSPIYEGKCGMSGGRVEGKVIYETQSTHKLLAAFSQASMIHVKGDVNEETFNEAYMMHTTTSPHYGIVASTETAAAMMKGNAGKRLINGSIERAIKFRKEIKRLRTESDGWFFDVWQPDHIDTTECWPLRSDSTWHGFKNIDNEHMYLDPIKVTLLTPGMEKDGTMSDFGIPASIVAKYLDEHGIVVEKTGPYNLLFLFSIGIDKTKALSLLRALTDFKRAFDLNLRVKNMLPSLYREDPEFYENMRIQELAQNIHKLIVHHNLPDLMYRAFEVLPTMVMTPYAAFQKELHGMTEEVYLDEMVGRINANMILPYPPGVPLVMPGEMITEESRPVLEFLQMLCEIGAHYPGFETDIHGAYRQADGRYTVKVLKEESKK

SEQ ID NO: 9541 - DNA, 1335 bp, Escherichia coli
atgagttctgccaagaagatcgggctatttgcctgtaccggtgttgttgccggtaatatgatggggagcggtattgcattattacctgcgaacctagcaagtatcggtggtattgctatctggggttggattatctctattattggtgcaatgtcgctggcatatgtatatgcccgactggcaacaaaaaacccgcaacaaggtggcccaattgcgtatgccggagaaatttcccctgcatttggttttcagacaggtgttctttattaccatgctaactggattggtaacctggcaattggtattaccgctgtatcttatctttccaccttcttcccagtattaaatgatcctgttccggcgggtatcgcctgtattgctatcgtctgggtatttacctttgtgaatatgctcggcggtacctgggtaagccgtttaaccacgattggtctggtgctggttcttattcctgtggtgatgactgctattgttggctggcattggtttgatgcagcaacttatgcagctaactggaatactgcggataccactgatggtcatgcgatcattaaaagtattctgctctgcctgtgggccttcgtgggtgttgaatccgcagcagtaagtactggtatggttaaaaacccgaaacgtaccgttccgctggcaaccatgctgggtactggtttagcaggtattgtttacatcgctgcgactcaggtgctttccggtatgtatccgtcttctgtaatggcggcttccggtgctccgtttgcaatcagtgcttcaactatcctcggtaactgggctgcgccactggtttctgcattcaccgcctttgcgtgcctgacttctctgggctcctggatgatgttggtaggccaggcaggtgtacgtgccgctaacgacggtaacttcccgaaagtttatggtgaagtcgacagcaacggtattccgaaaaaaggtctgctgctggctgcagtgaaaatgactgccctgatgatcctcatcactctgatgaactctgccggtggtaaagcctctgacctgttcggtgaactgaccggtatcgcagtactgctgactatgctgccgtacttctactcttgcgttgacctgattcgttttgaaggcgttaacatccgcaactttgtcagcctgatctgctctgtactgggttgcgtgttctgcttcatcgcgctgatgggcgcaagctccttcgagctggcaggtaccttcatcgtcagcctgattatcctgatgttctacgctcgcaaaatgcacgagcgccagagccactcaatggataaccacacagcgtctaacgcacattaa

SEQ ID NO: 9542 - protein, 444 aa, Escherichia coli
MSSAKKIGLFACTGVVAGNMMGSGIALLPANLASIGGIAIWGWIISIIGAMSLAYVYARLATKNPQQGGPIAYAGEISPAFGFQTGVLYYHANWIGNLAIGITAVSYLSTFFPVLNDPVPAGIACIAIVWVFTFVNMLGGTWVSRLTTIGLVLVLIPVVMTAIVGWHWFDAATYAANWNTADTTDGHAIIKSILLCLWAFVGVESAAVSTGMVKNPKRTVPLATMLGTGLAGIVYIAATQVLSGMYPSSVMAASGAPFAISASTILGNWAAPLVSAFTAFACLTSLGSWMMLVGQAGVRAANDGNFPKVYGEVDSNGIPKKGLLLAAVKMTALMILITLMNSAGGKASDLFGELTGIAVLLTMLPYFYSCVDLIRFEGVNIRNFVSLICSVLGCVFCFIALMGASSFELAGTFIVSLIILMFYARKMHERQSHSMDNHTASNAH

SEQ ID NO: 9543 - DNA, 1539 bp, Escherichia coli
atgcaacaacctgtagttcgcgttggcgaatggcttgttactccgtccataaaccaaattagccgcaatgggcgtcaacttacccttgagccgagattaatcgatcttctggttttctttgctcaacacagtggcgaagtacttagcagggatgaacttatcgataatgtctggaagagaagtattgtcaccaatcacgttgtgacgcagagtatctcagaactacgtaagtcattaaaagataatgatgaagatagtcctgtctatatcgctactgtaccaaagcgcggctataaattaatggtgccggttatctggtacagcgaagaagagggagaggaaataatgctatcttcgcctccccctataccagaggcggttcctgccacagattctccctcccacagtcttaacattcaaaacaccacaacgccacctgaacaatccccagttaaaagcaaacgattcactaccttttgggtatggttttttttcctgttgtcgttaggtatctgtgtcgcactggtagcgttttcaagtcttgaaacacgtcttcctatgagtaaatcgcgcattttgctcaatccacgcgatattgacattaatatggttaataagagttgtaacagctggagttctccgtatcagctctcttacgcgataggcgtgggtgatttggtggcgacatcacttaacaccttctccacctttatggtgcatgacaaaatcaactacaacattgatgaaccgagcagttccggtaaaacattatctattgcgtttgttaatcagcgccaataccgtgctcaacaatgctttatgtcggtaaaattggtagacaatgcagatggttcaaccatgctggataaacgttatgtcatcactaacggtaatcagctggcgattcaaaatgatttgctccagagtttatcaaaagcgttaaaccaaccgtggccacaacgaatgcaggagatgctccagcaaattttgccgcatcgtggtgcgttattaactaatttttatcaggcacatgattatttactgcatggtgatgataaatcattggatcgtgccagtgaattattaggtgagattgttcaatcatccccagaatttacctacgcgagagcagaaaaagcattagttgatatcgtgcgccattctcaacatcctttagacgaaaaacaattagcagcactgaacacagaaatagataacattgttacactgccggaattgaacaacctgtccattatatatcaaataaaagcggtcagtgccctggtaaaaggtaaaacagatgagtcttatcaggcgataaataccggcattgatcttgaaatgtcctggctaaattatgtgttgcttggcaaggtttatgaaatgaaggggatgaaccgggaagcagctgatgcatatctcaccgcctttaatttacgcccaggggcaaacaccctttactggattgaaaatggtatattccagacttctgttccttatgttgtaccttatctcgacaaatttctcgcttcagaataa

SEQ ID NO: 9544 - protein, 512 aa, Escherichia coli
MQQPVVRVGEWLVTPSINQISRNGRQLTLEPRLIDLLVFFAQHSGEVLSRDELIDNVWKRSIVTNHVVTQSISELRKSLKDNDEDSPVYIATVPKRGYKLMVPVIWYSEEEGEEIMLSSPPPIPEAVPATDSPSHSLNIQNTTTPPEQSPVKSKRFTTFWVWFFFLLSLGICVALVAFSSLETRLPMSKSRILLNPRDIDINMVNKSCNSWSSPYQLSYAIGVGDLVATSLNTFSTFMVHDKINYNIDEPSSSGKTLSIAFVNQRQYRAQQCFMSVKLVDNADGSTMLDKRYVITNGNQLAIQNDLLQSLSKALNQPWPQRMQEMLQQILPHRGALLTNFYQAHDYLLHGDDKSLDRASELLGEIVQSSPEFTYARAEKALVDIVRHSQHPLDEKQLAALNTEIDNIVTLPELNNLSIIYQIKAVSALVKGKTDESYQAINTGIDLEMSWLNYVLLGKVYEMKGMNREAADAYLTAFNLRPGANTLYWIENGIFQTSVPYVVPYLDKFLASE

SEQ ID NO: 9545 - DNA, 102 bp, Escherichia coli
gtgattggtgacaatacttctcttccagacattatcgataagttcatccctgctaagtacttcgccactgtgttgagcaaagaaaaccagaagatcgattaa

SEQ ID NO: 9546 - protein, 33 aa, Escherichia coli
MIGDNTSLPDIIDKFIPAKYFATVLSKENQKID

SEQ ID NO: 9547 - DNA, 576 bp, Escherichia coli
gtgcaacgtgaagatgtactgggagaagccctgaaattattagaattacaagggattgccaacaccacgctggagatggttgctgaacgtgtggattatccactggacgagctacgccgcttctggccagacaaagaggcaatcctctacgatgcgctgcgttatcttagccaacagatagatgtctggcgtcgtcagctgatgctggacgaaacgcaaaccgccgaacaaaagttgctggcacgttatcaggcgttatcggagtgcgttaaaaacaaccgctatccgggctgtctgtttatcgctgcctgtacgttttaccccgatcctggccaccctattcatcaactggccgatcagcaaaaaagcgcggcctacgatttcacccacgaactgttaaccacgctggaagttgacgatccggcgatggtagcaaagcagatggaactggtgctggaaggctgtttaagccgaatgctggtgaatcgtagccaggcggatgtcgacaccgcacatcggctggcggaagatatcctgcgcttcgcccgctgccgtcagggtggtgcactgacctga

SEQ ID NO: 9548 - protein, 191 aa, Escherichia coli
MQREDVLGEALKLLELQGIANTTLEMVAERVDYPLDELRRFWPDKEAILYDALRYLSQQIDVWRRQLMLDETQTAEQKLLARYQALSECVKNNRYPGCLFIAACTFYPDPGHPIHQLADQQKSAAYDFTHELLTTLEVDDPAMVAKQMELVLEGCLSRMLVNRSQADVDTAHRLAEDILRFARCRQGGALT

SEQ ID NO: 9549 - DNA, 1698 bp, Escherichia coli
atggctcaacgcatctttacgctgatcctgctactttgcagcacttccgtttttgccggattattcgacgcgccgggacgttcacaatttgtccccgcggatcaagcctttgcttttgattttcagcaaaatcaacatgatctgaatctgacctggcagatcaaagacggttactacctctaccgtaaacagatccgcattacgccggaacacgcgaaaattgctgacgtgcagctgccgcaaggcgtctggcatgaagatgagttttacggcaaaagcgagatttaccgcgatcggctgacgcttcccgtaaccatcaaccaggcgagtgcgggagcaacgttaactgtcacctaccagggctgtgctgatgccggtttctgttatccgccagaaaccaaaaccgttccgttaagcgaagtggtcgctaacaacgaagcgtcacagcctgtgtctgttccgcagcaagagcagcccaccgcgcaattgcccttttccgcgctctgggcgttgttgatcggtattggtatcgcctttacgccatgcgtgctgccaatgtacccactgatttctggcatcgtgctgggcggtaaacagcggctttccactgccagagcattgttgctgacctttatttatgtgcaggggatggcgctgacttacacggcgctgggtctggtggttgccgccgcagggttacagttccaggcggcgctacagcacccatacgtgctcattggcctcgccatcgtctttaccttgctggcgatgtcaatgtttggcttgtttactctgcaactcccctcttcgctgcaaacacgtctcacgctgatgagcaatcgccaacagggcggctcacctggcggtgtgtttattatgggggcgattgccggactgatctgttcaccatgcaccactgcaccgcttagcgcgattctgctgtatatcgcccaaagcgggaacatgtggctgggcggcggcacgctttatctttatgcgctgggcatgggcctgccgctgatgctaattaccgtctttggtaaccgcttgctgccgaaaagcggcccgtggatggaacaagtcaaaaccgcgtttggttttgtgatcctcgcactgccggtcttcctgctggagcgagtgattggtgatatatggggattacgcttgtggtcggcgcttggtgtcgcattctttggctgggcctttatcaccagcctacaggccaaacgcggctggatgcgcgtggtgcaaataatcctgctggcagcggcattggttagcgtgcgcccacttcaggattgggcatttggtgaaacacataccgcgcaaactcagacgcatctcaactttacacaaatcaaaacagtagatgagttaaatcaggcgctcgttgaagccaaaggcaaaccagtgatgttagatctctatgccgactggtgcgtcgcctgtaaagagtttgagaaatacaccttcagcgacccgcaggtgcaaaaagcgttagcagatacggtcttacttcaggccaacgtcactgccaacgacgcacaagatgtggcgctgttaaagcatcttaatgtccttggcctaccgacaattctcttttttgacggacaaggccaggagcatccacaagcacgcgtcacgggctttatggatgctgaaaccttcagcgcacatttgcgcgatcgccaaccgtga

SEQ ID NO: 9550 - protein, 565 aa, Escherichia coli
MAQRIFTLILLLCSTSVFAGLFDAPGRSQFVPADQAFAFDFQQNQHDLNLTWQIKDGYYLYRKQIRITPEHAKIADVQLPQGVWHEDEFYGKSEIYRDRLTLPVTINQASAGATLTVTYQGCADAGFCYPPETKTVPLSEVVANNEASQPVSVPQQEQPTAQLPFSALWALLIGIGIAFTPCVLPMYPLISGIVLGGKQRLSTARALLLTFIYVQGMALTYTALGLVVAAAGLQFQAALQHPYVLIGLAIVFTLLAMSMFGLFTLQLPSSLQTRLTLMSNRQQGGSPGGVFIMGAIAGLICSPCTTAPLSAILLYIAQSGNMWLGGGTLYLYALGMGLPLMLITVFGNRLLPKSGPWMEQVKTAFGFVILALPVFLLERVIGDIWGLRLWSALGVAFFGWAFITSLQAKRGWMRVVQIILLAAALVSVRPLQDWAFGETHTAQTQTHLNFTQIKTVDELNQALVEAKGKPVMLDLYADWCVACKEFEKYTFSDPQVQKALADTVLLQANVTANDAQDVALLKHLNVLGLPTILFFDGQGQEHPQARVTGFMDAETFSAHLRDRQP

SEQ ID NO: 9551 - DNA, 339 bp, Escherichia coli
atgcttgatgaaaaaagttcgaataccacgtctgtcgtggtgctatgtacggcaccggatgaagcgacagcccaggatttagccgccaaagtgctggcggaaaaactggcggcctgcgcgaccttgatccccggcgctacctctctctattactgggaaggtaagctggagcaagaatacgaagtgcagatgattttaaaaactaccgtatctcaccagcaggcgctgctggaatgcctgaagtctcatcatccatatcaaaccccggaacttctggttttacctgttacacacggagacacagattacctctcatggctcaacgcatctttacgctga

SEQ ID NO: 9552 - protein, 112 aa, Escherichia coli
MLDEKSSNTTSVVVLCTAPDEATAQDLAAKVLAEKLAACATLIPGATSLYYWEGKLEQEYEVQMILKTTVSHQQALLECLKSHHPYQTPELLVLPVTHGDTDYLSWLNASLR

SEQ ID NO: 9553 - DNA, 1302 bp, Escherichia coli
atgctagttgtagaactcatcatagttttgctggcgatcttcttgggcgccagattggggggaataggtattggttttgcaggcggattgggggtgctggttcttgccgctattggcgttaaacccggtaacatcccgttcgatgtcatttccattatcatggcggttatcgccgctatttctgccatgcaggttgctggcggtctggactatctggttcatcagacagaaaagctgctgcgccgtaacccgaaatacatcacgatcctcgcaccgatcgtgacctatttcctgacaatctttgctggtactggcaacatctctctggcgacactgccagttatcgctgaagttgcgaaggaacaaggcgttaaaccttgccgtccgctgtctactgcagtggtatccgcgcagattgcgatcaccgcatcgccaatctcagcggcagtggtttacatgtcttccgtaatggaaggtcatggcatcagctacctccatctgctctccgtggtcatcccgtccaccctgctggcggttctggtgatgtccttcctggtcactatgctgttcaactccaaactctctgacgatccgatttatcgcaagcgtctggaagagggcctggttgaactgcgcggtgaaaagcagattgaaatcaaatccggtgcaaaaacgtccgtctggctgttcctgctgggcgtagttggcgtggttatctatgcaatcatcaacagcccaagcatgggtctggttgaaaaaccgctgatgaacaccaccaacgcaatcctgatcatcatgctcagcgttgcaactctgaccaccgttatctgtaaagtcgataccgacaacattctcaactccagcaccttcaaagcaggtatgagcgcctgtatttgtatcctgggtgttgcgtggctgggcgatactttcgtttccaacaacatcgactggatcaaagataccgctggtgaagtgattcagggtcatccgtggctgctggccgtcatcttcttctttgcttctgctctgctgtactctcaggctgcaaccgcaaaagcactgatgccgatggctctggcactgaacgtttctccgctgaccgctgttgcttctttcgctgcggtgtctggtctgttcattctgccgacctacccgacactggttgctgcggtacagatggatgacacgggtactacccgtatcggtaaattcgtcttcaaccatccgttcttcatcccgggtactctgggcgttgccctggccgtttgcttcggcttcgtgctgggtagcttcatgctgtaa

SEQ ID NO: 9554 - protein, 433 aa, Escherichia coli
MLVVELIIVLLAIFLGARLGGIGIGFAGGLGVLVLAAIGVKPGNIPFDVISIIMAVIAAISAMQVAGGLDYLVHQTEKLLRRNPKYITILAPIVTYFLTIFAGTGNISLATLPVIAEVAKEQGVKPCRPLSTAVVSAQIAITASPISAAVVYMSSVMEGHGISYLHLLSVVIPSTLLAVLVMSFLVTMLFNSKLSDDPIYRKRLEEGLVELRGEKQIEIKSGAKTSVWLFLLGVVGVVIYAIINSPSMGLVEKPLMNTTNAILIIMLSVATLTTVICKVDTDNILNSSTFKAGMSACICILGVAWLGDTFVSNNIDWIKDTAGEVIQGHPWLLAVIFFFASALLYSQAATAKALMPMALALNVSPLTAVASFAAVSGLFILPTYPTLVAAVQMDDTGTTRIGKFVFNHPFFIPGTLGVALAVCFGFVLGSFML

SEQ ID NO: 9555 - DNA, 1437 bp, Escherichia coli
atgtcaaacaacattcgtatcgaagaagatctgttgggtaccagggaagttccagctgatgcctactatggtgttcacactctgagagcgattgaaaacttctatatcagcaacaacaaaatcagtgatattcctgaatttgttcgcggtatggtaatggttaaaaaagccgcagctatggcaaacaaagagctgcaaaccattcctaaaagtgtagcgaatgccatcattgccgcatgtgatgaagtcctgaacaacggaaaatgcatggatcagttcccggtagacgtctaccagggcggcgcaggtacttccgtaaacatgaacaccaacgaagtgctggccaatatcggtctggaactgatgggtcaccagaaaggtgaatatcagtacctgaacccgaacgaccatgttaacaaatgtcagtccactaacgacgcctacccgaccggtttccgtatcgcagtttactcttccctgattaaactggtagatgcgattaaccaactgcgtgaaggctttgaacgtaaagctgtcgaattccaggacatcctgaaaatgggtcgtacccagctgcaggacgcagtaccgatgaccctcggtcaggaattccgcgccttcagcatcttgctgaaagaagaagtgaaaaatatccaacgtaccgctgaactgctgctggaagttaaccttggcgcaacagcaatcggtactggtctgaacacgccgaaagagtactctccgctggcagtgaaaaaactggctgaagtcactggcttcccatgcgtaccggctgaagacctgatcgaagcgacctccgactgcggcgcttatgttatggttcacggcgcgctgaaacgcctggctgtgaagatgtccaaaatctgtaacgacctgcgcttgctctcttctggtccacgtgccggcctgaacgagatcaacctgccggaactgcaggcaggctcttccatcatgccagctaaagtaaacccggttgttccggaagtggttaaccaggtatgcttcaaagtcatcggtaacgacaccactgttaccatggcagcagaagcaggtcagctgcagttgaacgttatggagccagtcattggccaggccatgttcgaatccgttcacattctgaccaacgcttgctacaacctgctggaaaaatgcattaacggcatcactgctaacaaagaagtgtgcgaaggttacgtttacaactctatcggtatcgttacttacctgaacccgttcatcggtcaccacaacggtgacatcgtgggtaaaatctgtgccgaaaccggtaagagtgtacgtgaagtcgttctggaacgcggtctgttgactgaagcggaacttgacgatattttctccgtacagaatctgatgcacccggcttacaaagcaaaacgctatactgatgaaagcgaacagtaa

SEQ ID NO: 9556 - protein, 478 aa, Escherichia coli
MSNNIRIEEDLLGTREVPADAYYGVHTLRAIENFYISNNKISDIPEFVRGMVMVKKAAAMANKELQTIPKSVANAIIAACDEVLNNGKCMDQFPVDVYQGGAGTSVNMNTNEVLANIGLELMGHQKGEYQYLNPNDHVNKCQSTNDAYPTGFRIAVYSSLIKLVDAINQLREGFERKAVEFQDILKMGRTQLQDAVPMTLGQEFRAFSILLKEEVKNIQRTAELLLEVNLGATAIGTGLNTPKEYSPLAVKKLAEVTGFPCVPAEDLIEATSDCGAYVMVHGALKRLAVKMSKICNDLRLLSSGPRAGLNEINLPELQAGSSIMPAKVNPVVPEVVNQVCFKVIGNDTTVTMAAEAGQLQLNVMEPVIGQAMFESVHILTNACYNLLEKCINGITANKEVCEGYVYNSIGIVTYLNPFIGHHNGDIVGKICAETGKSVREVVLERGLLTEAELDDIFSVQNLMHPAYKAKRYTDESEQ

SEQ ID NO: 9557 - DNA, 477 bp, Escherichia coli
ttgcgctggttaccttttattgccattttcctttatgtctatattgagatttcaatctttattcaggttgctcatgtattgggggtattgctgaccctcgtgctggttatattcacgtcagttatcggtatgtcactggtacgcaaccagggctttaagaatttcgtgctgatgcagcaaaaaatggcggcgggtgaaaacccagcggcggagatgattaaaagtgtttcgctgatcattgccggtttgctgcttttattaccgggctttttcaccgacttcctcggtcttctgcttttattgccgccggtgcaaaagcatctgacagtgaagttgatgcctcatctgcgtttttcccgtatgccaggcggcggttttagcgccgggaccggtagcggtaatacttttgatggtgagtaccagcgaaaggatgatgaccgcgaccgccttgatcataaagacgatcgccaggattaa

SEQ ID NO: 9558 - protein, 158 aa, Escherichia coli
MRWLPFIAIFLYVYIEISIFIQVAHVLGVLLTLVLVIFTSVIGMSLVRNQGFKNFVLMQQKMAAGENPAAEMIKSVSLIIAGLLLLLPGFFTDFLGLLLLLPPVQKHLTVKLMPHLRFSRMPGGGFSAGTGSGNTFDGEYQRKDDDRDRLDHKDDRQD

SEQ ID NO: 9559 - DNA, 1317 bp, Escherichia coli
gtgctaccatcgaaaatctacgcagttgcccaaaatttgggcgcaatcggacatcaacccatgagtggactcaaacaagaactggggctggcccagggcatcggcctgctatcgacgtcattattaggcactggcgtgtttgccgttcctgcgttagctgcgctagtagcaggcaataacagcctgtgggcgtggcccgttttgattatcttagtgttcccgattgcgattgtgtttgcgattctgggtcgccactatcccagcgcaggcggcgtcgcacacttcgtcggtatggcgtttggttcgcggcttgagcgagtcaccggctggttgtttttatcggtcattcccgtgggtttgcctgccgcgctacaaattgctgccggattcggccaggcaatgtttggctggcatagcgagcaactgttgttggcagaactcggtacgctggcgctggtgtggtatatcggtactcgcggtgccagttccagtgctaatctacaaacagttattgccggacttatcgtcgcactgattgtcgctatctggtgggcgggcgatatcaaacctgcgaatatccccttccctgcgccaggaaatatcgaacttaccgggttattcgctgcgttatcagtgatgttctggtgttttgtcggtctggaagcatttgcccatcttgcctcggaatttaaaaatccagagcgtgattttcctcgtgctttgatgattggcctgctgctggcaggattagtctattggggctgtacggtagtcgtcttacacttcgacgcctatggtgaacaaatggcggcggcagcatcgcttcccaaaattgtagtgcagttgttcggtgtaggagcgttatggattgcctgcgtaattggctatctggcctgctttgccagtctcaacatttatatacagagcttcgcccgcctggtctggtcgcaggcgcaacataatcctgaccactacctggcacgcctctcttctcgccatattccgaataatgccctcaatgcggtgctcggctgctgcgtggtgagcacgttggtgattcatgctttagagatcaatctggacgctcttattatttatgccaatggcatctttattatgatttatctgttatgcatgctggcaggctgtaaattattgcaaggacgttatcgactactggcagtggttggcgggctattatgcgttctgttactggcaatggtcggctggaaaagtctctacgcgctgatcatgctggcggggttatggctgtttctgccaaaacgaaaaacgccgggaaatggcataaccacataa

SEQ ID NO: 9560 - protein, 438 aa, Escherichia coli
MLPSKIYAVAQNLGAIGHQPMSGLKQELGLAQGIGLLSTSLLGTGVFAVPALAALVAGNNSLWAWPVLIILVFPIAIVFAILGRHYPSAGGVAHFVGMAFGSRLERVTGWLFLSVIPVGLPAALQIAAGFGQAMFGWHSEQLLLAELGTLALVWYIGTRGASSSANLQTVIAGLIVALIVAIWWAGDIKPANIPFPAPGNIELTGLFAALSVMFWCFVGLEAFAHLASEFKNPERDFPRALMIGLLLAGLVYWGCTVVVLHFDAYGEQMAAAASLPKIVVQLFGVGALWIACVIGYLACFASLNIYIQSFARLVWSQAQHNPDHYLARLSSRHIPNNALNAVLGCCVVSTLVIHALEINLDALIIYANGIFIMIYLLCMLAGCKLLQGRYRLLAVVGGLLCVLLLAMVGWKSLYALIMLAGLWLFLPKRKTPGNGITT

SEQ ID NO: 9561 - DNA, 294 bp, Escherichia coli
atgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaa

SEQ ID NO: 9562 - protein, 97 aa, Escherichia coli [sequence omitted]

SEQ ID NO: 9563 - DNA, 1647 bp, Escherichia coli
atggcagctaaagacgtaaaattcggtaacgacgctcgtgtgaaaatgctgcgcggcgtaaacgtactggcagatgcagtgaaagttaccctcggtccgaaaggccgtaacgtagttctggataaatctttcggtgcaccgaccatcaccaaagatggtgtttccgttgctcgtgaaatcgaactggaagacaagttcgaaaacatgggtgcgcagatggtgaaagaagttgcctctaaagcgaacgacgctgcaggcgacggtaccaccactgcaaccgtactggctcaggctatcatcactgagggtctgaaagctgttgctgcgggcatgaacccgatggacctgaaacgtggtatcgacaaagcagttaccgctgcagttgaagaactgaaagcgctgtccgtaccgtgctctgactctaaagcgattgctcaggttggtaccatctctgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgttggctgacaagaaaatctccaacatccgcgaaatgctgccggttctggaagctgttgccaaagcaggtaaaccgctgctgatcatcgctgaagatgttgaaggcgaagcactggcaactctggttgttaacaccatgcgtggcatcgtgaaagttgctgcggttaaagctccgggcttcggcgatcgtcgtaaagctatgctgcaggatatcgcaaccctgactggcggtaccgtaatctctgaagagatcggtatggagctggaaaaagcaaccctggaagacctgggtcaggctaaacgtgttgtgatcaacaaagacaccaccaccatcatcgatggcgtgggtgaagaagctgcaatccagggccgtgttgctcagatccgtcagcagattgaagaagcaacttctgactacgaccgtgaaaaactgcaggagcgcgtagcgaaactggcaggcggcgttgcagttatcaaagttggtgctgctaccgaagttgaaatgaaagagaaaaaagcacgcgttgaagacgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtcctgaactgcggcgaagaaccgtctgttgttgctaacaccgttaaaggcggcgacggcaactacggttacaacgcagcaactgaagaatacggcaacatgatcgatatgggtatcctggatccaaccaaagtaacccgttctgctctgcagtacgcggcttctgtggctggcctgatgatcaccaccgagtgcatggttaccgacctgccgaaaaacgatgcagctgacttaggcgctgctggcggtatgggcggcatgggtggcatgggcggcatgatgtaa

SEQ ID NO: 9564 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 9565 - DNA, 387 bp, Escherichia coli
gtggcgtccagctcattgattatggggaataacatgcacgtaaaatacttagcagggattgtcggtgccgcgctactgatggcgggttgtagctccagcaacgaattgagtgctgccggtcagagtgtacgcattgtggacgagcaaccaggtgcagagtgccagctgattggtactgcgacaggtaagcaaagcaactggctttccgggcaacacggagaagaaggcggttctatgcgcggcgcagcaaacgatctgcgcaaccaggcggctgcaatgggcggtaacgtgatttatggcatcagcagcccgtcgcagggaatgttgtccagttttgtcccgacggatagccagattatcggtcaggtttataagtgcccgaactga

SEQ ID NO: 9566 - protein, 128 aa, Escherichia coli
MASSSLIMGNNMHVKYLAGIVGAALLMAGCSSSNELSAAGQSVRIVDEQPGAECQLIGTATGKQSNWLSGQHGEEGGSMRGAANDLRNQAAAMGGNVIYGISSPSQGMLSSFVPTDSQIIGQVYKCPN

SEQ ID NO: 9567 - DNA, 870 bp, Escherichia coli
atggccataagcatcaagggtgttaataccggtgttattcgcaagagtaataatttcattgcactggcgctgaaaattaaagaacctcgcaataaagaatcgttgttctttatgtctgccatggaattgcgcgaccttctgattgcgctggaaagtcgtctgcatcaaaagcataaactggatgctgctgcacgccttcagtatgaacaagctcgcgataaagtcattaagaaaatggcagaaaatatcccagaaattctggttgatgagcttaaaaatgccgatattaatcgtcgggttaacacgctggaacttaccgatgatcagggcgaaaatcttaccttcgtattaacgctacatgacggtagcaaatgtgagttagtcgtcaatgagttgcagattgaaatgctggcgcgagcaatcattcatgcaattaataatgcggaaatgcgtgaactggcattacgtattacctcactgttagatttcctgccgttatacgacgttgactgccaggaaaatggcaatctggaatatgacacctattcccaaccggaatggaaacataacttgttcaaccattatctggcggtgctttaccgctttaaagatgaaagtggcaatgaacaatttagcggcgcagtggtgaaaacgcgtgaagcaacgccgggtaaagaagtggaggcgatcactcgccgaatgcttgatttcagcccccgactgaaaaaactcgcgggtgtgccatgtcaggtctatgttcgcaccgtagcggcaaataacgcccaaccgctaacccaggatcaatgcttacgcgcgctgcatcacttacgtgttcaatccaccagcaaaactgcaccacaggcgaaataa

SEQ ID NO: 9568 - protein, 289 aa, Escherichia coli
MAISIKGVNTGVIRKSNNFIALALKIKEPRNKESLFFMSAMELRDLLIALESRLHQKHKLDAAARLQYEQARDKVIKKMAENIPEILVDELKNADINRRVNTLELTDDQGENLTFVLTLHDGSKCELVVNELQIEMLARAIIHAINNAEMRELALRITSLLDFLPLYDVDCQENGNLEYDTYSQPEWKHNLFNHYLAVLYRFKDESGNEQFSGAVVKTREATPGKEVEAITRRMLDFSPRLKKLAGVPCQVYVRTVAANNAQPLTQDQCLRALHHLRVQSTSKTAPQAK

SEQ ID NO: 9569 - DNA, 1029 bp, Escherichia coli
atggcgcatattgtaaccctaaataccccatccagagaagattggttaacgcaacttgccgatgttgtgaccgatcctgatgaacttctgcgtcttttgaatatagacgcggacgaaaaactgttggccggacgcagcgccaaaaagctgtttgccctgcgtgtgccccgctcatttatcgatcgcatggagaaaggcaatccgaacgatccgcttttgcgtcaggtacttacctcgcaagatgagtttgtcgtcgcgcccggattctccaccgacccgctggaagaacagcatagcgtagtgcctggtttgttgcataaataccacaaccgggcgcttttgctggtcaaaggcggctgcgcggtaaattgccgctattgcttccgtcgccacttcccctatgccgaaaatcagggcaataagcgtaactggcagactgcacttgagtatgttgctgcgcatccggaactggacgagatgattttctccggcggcgatccgctgatggcgaaagatcacgagctggactggttgctcacacaactggaagccatcccgcatatcaaacgtctgcggattcacagccgtctgccgattgtgatcccggcacgcatcacagatgcgctggttgaacgcttttctcattctacgctgcaaatcttgctggtgaatcacatcaaccatgccaatgaggtagatgaaacattccgtcaggcgatggctaagttgcgccgggtgggcgttactttgctgaaccagagcgttctgttacgtggtgtgaacgataacgcgcaaacgctggcaaacctgagtaatgcgttgttcgatgcgggcgtgatgccgtattacctgcatgtgctcgataaagtacagggcgcggcgcattttatggtgagtgatgacgaagcacggcagattatgcgtgagttgctgacactggtgtcgggatatctggtgcctaaactggcgcgagaaattggcggcgaacccagcaaaacgccgctggatctccagctacgccagcagtaa

SEQ ID NO: 9570 - protein, 342 aa, Escherichia coli
MAHIVTLNTPSREDWLTQLADVVTDPDELLRLLNIDADEKLLAGRSAKKLFALRVPRSFIDRMEKGNPNDPLLRQVLTSQDEFVVAPGFSTDPLEEQHSVVPGLLHKYHNRALLLVKGGCAVNCRYCFRRHFPYAENQGNKRNWQTALEYVAAHPELDEMIFSGGDPLMAKDHELDWLLTQLEAIPHIKRLRIHSRLPIVIPARITDALVERFSHSTLQILLVNHINHANEVDETFRQAMAKLRRVGVTLLNQSVLLRGVNDNAQTLANLSNALFDAGVMPYYLHVLDKVQGAAHFMVSDDEARQIMRELLTLVSGYLVPKLAREIGGEPSKTPLDLQLRQQ

SEQ ID NO: 9571 - DNA, 567 bp, Escherichia coli
atggcaacgtactatagcaacgattttcgtgctggtcttaaaatcatgttagacggcgaaccttacgcggttgaagcgagtgaattcgtaaaaccgggtaaaggccaggcatttgctcgcgttaaactgcgtcgtctgctgaccggtactcgcgtagaaaaaaccttcaaatctactgattccgctgaaggcgctgatgttgtcgatatgaacctgacttacctgtacaacgacggtgagttctggcacttcatgaacaacgaaactttcgagcagctgtctgctgacgcaaaagcaattggcgacaacgctaaatggttgctggatcaggcagagtgtatcgtaactctgtggaatggtcagccgatctccgttactccgccgaacttcgttgaactggaaatcgttgataccgatccgggcctgaaaggtgataccgcaggtactggcggcaaaccggctaccctgtctactggcgctgtggttaaagttccgctgtttgtacaaatcggcgaagtcatcaaagtggatacccgctctggtgaatacgtctctcgcgtgaagtaa

SEQ ID NO: 9572 - protein, 188 aa, Escherichia coli
MATYYSNDFRAGLKIMLDGEPYAVEASEFVKPGKGQAFARVKLRRLLTGTRVEKTFKSTDSAEGADVVDMNLTYLYNDGEFWHFMNNETFEQLSADAKAIGDNAKWLLDQAECIVTLWNGQPISVTPPNFVELEIVDTDPGLKGDTAGTGGKPATLSTGAVVKVPLFVQIGEVIKVDTRSGEYVSRVK

SEQ ID NO: 9573 - DNA, 126 bp, Escherichia coli
atgatgaaacgccttatcgttcttgttttgcttgccagcacgctgcttacgggctgtaacaccgctcgcggtttcggcgaagatatcaaacacctcggcaactccatctcccgcgctgccagctaa

SEQ ID NO: 9574 - protein, 41 aa, Escherichia coli
MMKRLIVLVLLASTLLTGCNTARGFGEDIKHLGNSISRAAS

SEQ ID NO: 9575 - DNA, 147 bp, Escherichia coli
atggtgaagaagacaattgcagcgatcttttctgttctggtgctttcaacagtattaactgcctgcaacaccacgcgtggcgttggtgaagacatttctgatggcggtaacgcgatttctggcgcagcaacgaaagcgcagcaataa

SEQ ID NO: 9576 - protein, 48 aa, Escherichia coli
MVKKTIAAIFSVLVLSTVLTACNTTRGVGEDISDGGNAISGAATKAQQ

SEQ ID NO: 9577 - DNA, 381 bp, Escherichia coli
ttgcaggacgacctgcaaacgcgtcttttcaccggggacggccccaattttccggagcctgatatgtcctggattatcttagttattgctggtctgctggaagtggtatgggccgttggcctgaaatatactcacggctttagtcgtttgacgccaagtgttattaccgtgacggcgatgattgtcagtctggcgctacttgcctgggcgatgaaatcgttaccagtagggacggcttatgccgtgtggacgggtattggcgcagtcggcgcggccatcaccggcattgtgctgctcggtgagtccgctaacccgatgcgcctggcgagtctggcgttaatcgtattggggattattggtctgaaactcagcactcattaa

SEQ ID NO: 9578 - protein, 126 aa, Escherichia coli
MQDDLQTRLFTGDGPNFPEPDMSWIILVIAGLLEVVWAVGLKYTHGFSRLTPSVITVTAMIVSLALLAWAMKSLPVGTAYAVWTGIGAVGAAITGIVLLGESANPMRLASLALIVLGIIGLKLSTH

SEQ ID NO: 9579 - DNA, 534 bp, Escherichia coli
atgcgcctgctccctctcgttgccgcagcgacagctgcatttctggtcgttgcctgcagttcccctacgccgccgcgtggcgtgaccgtagtgaataatttcgacgctaaacgttatctcggtacctggtatgagattgcccgttttgatcaccgctttgaacgtggactggaaaaagtcaccgcaacatacagcctgcgtgatgacggcggcctgaatgtcattaataaaggctataaccctgacagagaaatgtggcagcagagtgaagggaaagcgtactttaccggagcaccaactcgcgctgcgctgaaagtgtcattctttggtcctttctatggcggttataacgttattgcactcgatcgggaataccgccatgcgctggtttgcggcccggaccgcgactacctgtggatactctcccgcacgccaaccatttctgacgaagtgaaacaggagatgctggcagtcgcgacccgggaagggtttgatgtcagtaagtttatttgggtacagcagcccggtagttaa

SEQ ID NO: 9580 - protein, 177 aa, Escherichia coli
MRLLPLVAAATAAFLVVACSSPTPPRGVTVVNNFDAKRYLGTWYEIARFDHRFERGLEKVTATYSLRDDGGLNVINKGYNPDREMWQQSEGKAYFTGAPTRAALKVSFFGPFYGGYNVIALDREYRHALVCGPDRDYLWILSRTPTISDEVKQEMLAVATREGFDVSKFIWVQQPGS

SEQ ID NO: 9581 - DNA, 1167 bp, Escherichia coli
atggcgggccgttttgtatggaaaccagaccctatgttcaaaacgacgctctgcaccttattaattaccgcctcttgctccacatttgccgcacctcaacaaatcaacgatattgtgcatcgcacaattaccccgcttatagagcaacaaaagatccccggtatggcggtagcggtaatttatcagggtaaaccttattactttacctggggctatgcggacatcgccaaaaagcagcccgtcacacagcaaacgttgtttgagttaggttcggtcagcaaaacatttacgggcgtgcttggtggcgacgctattgctcgaggggaaatcaagttaagcgatcccacaacaaaatactggcctgaacttaccgctaaacagtggaatgggatcacactattacatctcgcaacctacaccgctggcggcctgccattgcaggtgccggatgaggtgaaatcctcaagcgacttgctgcgcttctatcaaaactggcagcctgcatgggctccaggaacacaacgtctgtatgccaactccagtatcggtttgttcggcgcactggctgtgaagccgtctggtttgagttttgagcaggcgatgaaaactcgtgtcttccagccactcaaactcaatcatacgtggattaatgtaccgtccgcagaagaaaagaactacgcctggggatatcgcgaaggtaaggcagtacatgtttcgccaggggcgttagatgctgaagcttatggtgtgaagtcgaccattgaagatatggcccgctgggtgcaaagcaatttaaaaccctttgatatcaatgagaaaatacttcaacaagggatacagctggcacaatctcgctactggcaaaccggcgatatgtatcagggtctgggctgggaaatgctggactggccggtaaatcctgacatcatcattaacggcagtgacaataaaattgcactggcagcacgccccgtaaaaccgattacgcccccaactcctgcagtacgcgcatcatgggtacataaaacgggggcgaccggcggatttggtagctatgtcgcgtttattccagaaaaagagctgggtatcgtgatgctggctaacaaaaactatcccaatccagcgagagttaccgccgcctggcagattctcaacactctacagtaa

SEQ ID NO: 9582 - protein, 388 aa, Escherichia coli
MAGRFVWKPDPMFKTTLCTLLITASCSTFAAPQQINDIVHRTITPLIEQQKIPGMAVAVIYQGKPYYFTWGYADIAKKQPVTQQTLFELGSVSKTFTGVLGGDAIARGEIKLSDPTTKYWPELTAKQWNGITLLHLATYTAGGLPLQVPDEVKSSSDLLRFYQNWQPAWAPGTQRLYANSSIGLFGALAVKPSGLSFEQAMKTRVFQPLKLNHTWINVPSAEEKNYAWGYREGKAVHVSPGALDAEAYGVKSTIEDMARWVQSNLKPFDINEKILQQGIQLAQSRYWQTGDMYQGLGWEMLDWPVNPDIIINGSDNKIALAARPVKPITPPTPAVRASWVHKTGATGGFGSYVAFIPEKELGIVMLANKNYPNPARVTAAWQILNTLQ

SEQ ID NO: 9583 - DNA, 360 bp, Escherichia coli
atgattaatccaaatccaaagcgttctgacgaaccggtattctggggcctcttcggggccggtggtatgtggagcgccatcattgcgccggtgatgatcctgctggttggtattctgctgccgctagggctgtttccgggtgatgcactgagctacgagcgcgttctggcgttcgcgcagagcttcattggtcgcgtattcctgttcctgatgatcgttctgccgctgtggtgtggtttacaccgtatgcaccacgcgatgcacgatctgaaaatccacgtacctgcgggtaaatgggttttctacggtctggctgctatcctgacagttgtcacactgattggtgtcgttacaatctaa

SEQ ID NO: 9584 - protein, 119 aa, Escherichia coli
MINPNPKRSDEPVFWGLFGAGGMWSAIIAPVMILLVGILLPLGLFPGDALSYERVLAFAQSFIGRVFLFLMIVLPLWCGLHRMHHAMHDLKIHVPAGKWVFYGLAAILTVVTLIGVVTI

SEQ ID NO: 9585 - DNA, 396 bp, Escherichia coli
atgacgactaaacgtaaaccgtatgtacggccaatgacgtccacctggtggaaaaaattgccgttttatcgcttttacatgctgcgcgaaggcacggcggttccggctgtgtggttcagcattgaactgattttcgggctgtttgccctgaaaaatggcccggaagcctgggcgggattcgtcgactttttacaaaacccggttatcgtgatcattaacctgatcactctggcggcagccctgctgcacaccaaaacctggtttgagctggcaccaaaagcagccaatatcattgtaaaagacgaaaaaatgggaccagagccaattatcaaaagtctctgggcggtaactgtggttgccaccatcgtaatcctgtttgttgccctgtactggtaa

SEQ ID NO: 9586 - protein, 131 aa, Escherichia coli
MTTKRKPYVRPMTSTWWKKLPFYRFYMLREGTAVPAVWFSIELIFGLFALKNGPEAWAGFVDFLQNPVIVIINLITLAAALLHTKTWFELAPKAANIIVKDEKMGPEPIIKSLWAVTVVATIVILFVALYW

SEQ ID NO: 9587 - DNA, 735 bp, Escherichia coli
atggctgagatgaaaaacctgaaaattgaggtggtgcgctataacccggaagtcgataccgcaccgcatagcgcattctatgaagtgccttatgacgcaactacctcattactggatgcgctgggctacatcaaagacaacctggcaccggacctgagctaccgctggtcctgccgtatggcgatttgtggctcctgcggcatgatggttaacaacgtgccaaaactggcatgtaaaaccttcctgcgtgattacaccgacggtatgaaggttgaagcgttagctaacttcccgattgaacgcgatctggtggtcgatatgacccacttcatcgaaagtctggaagcgatcaaaccgtacatcatcggcaacgcccgcaccgcggatcagggtactaacatccagaccccggcgcagatggcgaagtatcaccagttctccggttgcatcaactgtggtctgtgctacgccgcgtgcccgcagtttggcctgaacccagagttcatcggtccggctgccattacgctggcgcatcgttataacgaagatagccgcgaccacggtaagaaggagcgtatggcgcagttgaacagccagaacggcgtatggagctgtactttcgtgggctactgctccgaagtctgcccgaaacacgtcgatccggctgcggccattcagcagggcaaagtagaaagttcgaaagactttcttatcgcgaccctgaaaccacgctaa

SEQ ID NO: 9588 - protein, 244 aa, Escherichia coli
MAEMKNLKIEVVRYNPEVDTAPHSAFYEVPYDATTSLLDALGYIKDNLAPDLSYRWSCRMAICGSCGMMVNNVPKLACKTFLRDYTDGMKVEALANFPIERDLVVDMTHFIESLEAIKPYIIGNARTADQGTNIQTPAQMAKYHQFSGCINCGLCYAACPQFGLNPEFIGPAAITLAHRYNEDSRDHGKKERMAQLNSQNGVWSCTFVGYCSEVCPKHVDPAAAIQQGKVESSKDFLIATLKPR

SEQ ID NO: 9589 - DNA, 1809 bp, Escherichia coli
gtgcaaacctttcaagccgatcttgccattgtaggcgccggtggcgcgggattacgtgctgcaattgctgccgcgcaggcaaatccaaatgcaaaaatcgcactaatctcaaaagtatacccgatgcgtagccataccgttgctgcagaagggggctccgccgctgtcgcgcaggatcatgacagcttcgaatatcactttcacgatacagtagcgggtggcgactggttgtgtgagcaggatgtcgtggattatttcgtccaccactgcccaaccgaaatgacccaactggaactgtgggggtgcccatggagccgtcgtccggatggtagcgtcaacgtacgtcgcttcggcggcatgaaaatcgagcgtacctggttcgccgccgataagaccggcttccatatgctgcacacgctgttccagacctctctgcaattcccgcagatccagcgttttgacgaacatttcgtgctggatattctggttgatgatggtcatgttcgcggcctggtagcaatgaacatgatggaaggcacgctggtgcagatccgtgctaacgcggtcgttatggctaccggcggtgcgggtcgcgtttatcgttacaacaccaacggcggcatcgttaccggtgacggtatgggtatggcgctaagccacggcgttccgctgcgtgacatggaattcgttcagtatcacccaaccggtctaccaggttccggtatcctgatgaccgaaggctgccgcggtgaaggtggtattctggtcaacaaaaatggctaccgttatctgcaagattacggcatgggcccggaaactccgctgggcgagccgaaaaacaaatatatggaactgggtccacgcgacaaagtttctcaggccttctggcacgaatggcgtaaaggcaacaccatctccacgccacgtggcgatgtggtttacctcgacctgcgtcacctcggcgagaaaaaactgcatgaacgtctgccgttcatctgcgaactggcgaaagcgtacgttggcgtcgatccggttaaagaaccgattccggtacgtccgaccgcacactacaccatgggcggtatcgaaaccgatcagaactgtgaaacccgcattaaaggtctgttcgccgtgggtgaatgttcctctgttggtctgcacggtgcgaaccgtctgggctccaactcgctggcggaactggtggtcttcggtcgtctggccggtgaacaagcgacagagcgtgcagcaactgccggtaatggcaacgaagcggcaattgaagcgcaggcagctggcgttgaacaacgtctgaaagatctggttaaccaggatggcggcgaaaactgggctaagatccgcgacgaaatgggcatggccatggaagaaggctgcggtatctaccgtacgccggaactgatgcagaaaaccatcgacaagctggcagagctgcaggaacgcttcaagcgcgtgcgcatcaccgacacttccagcgtgttcaacaccgacctgctctacaccattgagctgggccacggtctgaacgttgctgaatgtatggcgcactccgcaatggcacgtaaagagtcccgcggcgcgcaccagcgtctggacgaaggttgcaccgagcgtgacgacgtcaacttcctcaaacacaccctcgccttccgcgatgctgatggcacgactcgcctggagtacagcgacgtgaagattactacgctgccgccagctaaacgtgtttacggtggcgaagcggatgcagccgataaggcggaagcagccaataagaaggagaaggcgaatggctga

SEQ ID NO: 9590 - protein, 602 aa, Escherichia coli
MQTFQADLAIVGAGGAGLRAAIAAAQANPNAKIALISKVYPMRSHTVAAEGGSAAVAQDHDSFEYHFHDTVAGGDWLCEQDVVDYFVHHCPTEMTQLELWGCPWSRRPDGSVNVRRFGGMKIERTWFAADKTGFHMLHTLFQTSLQFPQIQRFDEHFVLDILVDDGHVRGLVAMNMMEGTLVQIRANAVVMATGGAGRVYRYNTNGGIVTGDGMGMALSHGVPLRDMEFVQYHPTGLPGSGILMTEGCRGEGGILVNKNGYRYLQDYGMGPETPLGEPKNKYMELGPRDKVSQAFWHEWRKGNTISTPRGDVVYLDLRHLGEKKLHERLPFICELAKAYVGVDPVKEPIPVRPTAHYTMGGIETDQNCETRIKGLFAVGECSSVGLHGANRLGSNSLAELVVFGRLAGEQATERAATAGNGNEAAIEAQAAGVEQRLKDLVNQDGGENWAKIRDEMGMAMEEGCGIYRTPELMQKTIDKLAELQERFKRVRITDTSSVFNTDLLYTIELGHGLNVAECMAHSAMARKESRGAHQRLDEGCTERDDVNFLKHTLAFRDADGTTRLEYSDVKITTLPPAKRVYGGEADAADKAEAANKKEKANG

SEQ ID NO: 9591 - DNA, 978 bp, Escherichia coli
atgagcgaaacggcatcctggcagccgagcgcatccattcctaacttattaaaacgcgcggcgattatggcggagatccgtcgtttctttgccgatcgtggagtgctggaggtggagacgccttgtatgagccaggcgacggtaaccgatattcatttggtcccgtttgagacacgtttcgttggccccgggcattcgcaggggatgaatctctggttaatgaccagcccggaataccatatgaagcgcctgctggttgccggttgtgggccggtattccagctgtgccgcagcttccgtaatgaagagatggggcgttatcacaaccctgagttcactatgcttgagtggtatcgaccgcactatgatatgtaccggttgatgaacgaggtggacgatctcttgcaacaggtgctggactgtccggcagcagaaagcctttcttatcaacaagctttcttgcgttatctggaaattgacccactatctgccgacaaaacgcaactgcgggaagtggcagcgaaactggatttgagcaacgttgccgatactgaagaagaccgcgacacgcttctacaattgctgtttacctttggcgtagagccaaatattggcaaagaaaaaccgacctttgtgtaccactttccagccagccaggcatcactggcgcaaatcagtaccgaagatcatcgggtcgctgaacgctttgaggtttattataaaggtattgagctggcgaatggtttccatgaattgacggatgcccgtgagcagcaacaacgctttgaacaagataaccgtaagcgcgcggcgcgcggtttgccgcagcaccccattgaccagaatctgattgaagccttgaaagtcggtatgcctgactgctccggcgtggcattaggtgttgatcgtctggtgatgttggcgctgggcgcggagacactggctgaagtcatcgcctttagcgttgaccgggcataa

SEQ ID NO: 9592 - protein, 325 aa, Escherichia coli
MSETASWQPSASIPNLLKRAAIMAEIRRFFADRGVLEVETPCMSQATVTDIHLVPFETRFVGPGHSQGMNLWLMTSPEYHMKRLLVAGCGPVFQLCRSFRNEEMGRYHNPEFTMLEWYRPHYDMYRLMNEVDDLLQQVLDCPAAESLSYQQAFLRYLEIDPLSADKTQLREVAAKLDLSNVADTEEDRDTLLQLLFTFGVEPNIGKEKPTFVYHFPASQASLAQISTEDHRVAERFEVYYKGIELANGFHELTDAREQQQRFEQDNRKRAARGLPQHPIDQNLIEALKVGMPDCSGVALGVDRLVMLALGAETLAEVIAFSVDRA

SEQ ID NO: 9593 - DNA, 1503 bp, Escherichia coli
atgcctcactcgataaaaaagatgagtctgataggactcatattgatgatctttacttctgtatttggatttgccaatagcccatcggcttattacttaatgggttatagtgcgattcccttttatatattttctgcattgttattctttattccattcgccttaatgatggctgaaatgggagctgcttatcgcaaagaagaaggcggtatctattcctggatgaataatagtgtcggaccacgttttgccttcattggtacgtttatgtggttttcctcttatatcatctggatggtgagtacctccgcgaaagtttgggtaccgttctcaacattcctctacggtagcgacatgacccagcactggcatattgccggactggagcctacgcaggtggttggtctgctggcagtggcatggatgattctggtcaccgtcgttgcttcaaaagggattaataaaattgcccgcattactgcggtgggcggtattgcagtaatgtgtctgaatttagtattgctgttagtaagcattactattttgttattaaatggtgggcatttcgcgcaggatattaatttccttgcatcaccgaacccaggttatcagtccggtctggcaatgctatcgtttgtggtatttgccatttttgcctatggcggaattgaagcggttggtggtctagttgataaaacggaaaatccagaaaagaactttgccaaaggtattgtttttgccgctattgttatttcaatcggttattcgctggcaatatttttatggggcgtcagcacaaactggcagcaggtattaagtaatggttccgttaacctcggcaatattacctatgtgctgatgaagagcctcggggtgacgctgggtaacgcactgcatttgtcacctgaagcgtcattgtcgctgggcgtatggtttgcgcgtattaccggactgtcgatgttcctcgcttataccggtgcgttctttacactttgctattcaccgctgaaagccatcatccaggggacgccgaaagcattgtggccggaaccgatgacgcgcctgaatgcgatggggatgccgtctatcgccatgtggatgcagtgtgggttggttactgtcttcatcctgctggtttcgtttggtggcggtaccgcatcggcgttctttaacaagctgacgctgatggcgaacgtgtctatgacgcttccttacctgttcctcgcgctggctttcccattttttaaagcacgtcaggatctcgacagaccgtttgtgattttcaaaacgcatatgtcggcaatgattgcaacagtggttgtcgtactggtggtgacatttgcgaacgtcttcaccatcattcaacctgtggttgaagctggagactgggacagcacattgtggatgattggcggccctgtcttcttctcgctgttagcgatggcgatttaccagaactattgcagtcgcatggcgaacaaacctgagttagctctcgactga

SEQ ID NO: 9594 - protein, 500 aa, Escherichia coli
MPHSIKKMSLIGLILMIFTSVFGFANSPSAYYLMGYSAIPFYIFSALLFFIPFALMMAEMGAAYRKEEGGIYSWMNNSVGPRFAFIGTFMWFSSYIIWMVSTSAKVWVPFSTFLYGSDMTQHWHIAGLEPTQVVGLLAVAWMILVTVVASKGINKIARITAVGGIAVMCLNLVLLLVSITILLLNGGHFAQDINFLASPNPGYQSGLAMLSFVVFAIFAYGGIEAVGGLVDKTENPEKNFAKGIVFAAIVISIGYSLAIFLWGVSTNWQQVLSNGSVNLGNITYVLMKSLGVTLGNALHLSPEASLSLGVWFARITGLSMFLAYTGAFFTLCYSPLKAIIQGTPKALWPEPMTRLNAMGMPSIAMWMQCGLVTVFILLVSFGGGTASAFFNKLTLMANVSMTLPYLFLALAFPFFKARQDLDRPFVIFKTHMSAMIATVVVVLVVTFANVFTIIQPVVEAGDWDSTLWMIGGPVFFSLLAMAIYQNYCSRMANKPELALD

SEQ ID NO: 9595 - DNA, 315 bp, Escherichia coli
atggacgacgctagtcgggatccagtgataaccgaagatgaaatcagggagctgcaattttctgccggggatgtggcggaaatagagcaaacggtcctctcttttgtcgatacccgccacacccgcaaagtagcgatggtggtgggtaacactattaataccctcaaagagcgcgatggtccgcggtggggaaacctgccggatatctattgcgcttatcttattagatgtctggtttttcgcggagaattagtgggatacggcgatttgtttcgtatgcgctatagcgaaattaagcgaccgattatctcatga

SEQ ID NO: 9596 - protein, 104 aa, Escherichia coli
MDDASRDPVITEDEIRELQFSAGDVAEIEQTVLSFVDTRHTRKVAMVVGNTINTLKERDGPRWGNLPDIYCAYLIRCLVFRGELVGYGDLFRMRYSEIKRPIIS

SEQ ID NO: 9597 - DNA, 303 bp, Escherichia coli
atgtttatcttgtgctgcatctggtttattgtggcgttcctctggataaccatcacttccgcgctggacaaagagtggatgattgatggacgcgggattaataacgtctgcgatgtgctgatgtatctcgaagatgacgatacccgtgatgtcggtgtgataatgacgttaccgctctttttcccttttctctggttcgctttgtggcgaaaaaaacgcggctggtttatgtacgccaccgcgctggctattttcggctattggctgtggcagttttttctgcgctatcagttttgcttataa

SEQ ID NO: 9598 - protein, 100 aa, Escherichia coli
MFILCCIWFIVAFLWITITSALDKEWMIDGRGINNVCDVLMYLEDDDTRDVGVIMTLPLFFPFLWFALWRKKRGWFMYATALAIFGYWLWQFFLRYQFCL

SEQ ID NO: 9599 - DNA, 3324 bp, Escherichia coli
gtgcgcctgattatcacttttctgatggcctggtgcctcagttggggggcgtacgccgcgacggcccccgatagcaaacaaatcacccaggaactggagcaggcaaaagcggcgaaacctgcgcagccggaagtcgtagaggcgctccagtctgccttaaatgcgcttgaggaacgaaaaggttcccttgagcgcatcaagcaatatcaagaagtcattgataattatccgaaactttccgccactctgcgcgcgcagttaaacaacatgcgtgacgagccacgcagcgtgtcgccgggaatgtctaacgatgcgctgaatcaggaaattctccagatcagcagtcagttgctggataaaagccgtcaggcccagcaagagcaggagcgcgcccgcgagattgccgattcgctgaatcaactgccgcaacagcaaaccgatgcccgccgtcagttgaatgaaatcgagcgccgcctggggacgcttaccggcaataccccgctcaatcaggcacaaaatttcgcgttgcagtctgactccgcacgtctgaaagcgctcgttgatgaactggagctggcgcagctatctgccaataaccgccaggaattagcgcgcttgcgctctgagctggcggaaaaagagagccagcagctggatgcatatttgcaagcactacgcaaccagttgaatagtcaacgccaacaggaagcggaacgggctctggaaagtaccgagcaactggcggaaagtagcgccgatttgccaaaagatatcgtcgcccagtttaaaattaaccgcgaactatcggcggcactgaatcaacaggcgcagcggatggatctcgttgcctcgcaacagcgtcaggctgccagccagacgttacaggtccggcaggcgttgaatacgctgcgtgaacagtcgcaatggctgggatcatctaacctgctcggcgaagcgttgcgggcgcaggtggcacggctaccggaaatgccaaaaccacaacagcttgataccgaaatggcgcagttacgtgtgcaacggttacgttatgaggatctgcttaataaacagccgctgctacggcaaatccatcaggccgacggtcagccgctgaccgccgagcaaaaccgtattctggaagcacagctacgcactcagcgtgagttgctaaactcattgttgcagggtggcgacacgctactgctggagctgaccaagctgaaagtctccaacgggcaactggaggatgcgctgaaagaggtgaacgaagcgacgcaccgctatctgttctggacctctgacgtgcgcccgatgaccatcgcctggccgctggaaatcgcccaggatctgcgtcgtctcatttcgctggacaccttcagtcagttgggcaaagccagtgtgatgatgctgaccagtaaggagacgattttgccgctgtttggcgcgttgattctggtcggttgcagtatttactcgcgccgctatttcacccgttttcttgaacgttcggcggcgaaagtcggcaaagtgactcaggatcacttctggctgacgttacgcactcttttctggtcgattctcgtcgcgtcaccgctgcctgtgctgtggatgacgctgggttacggcttgcgcgaggcgtggccttatccgctggcggtcgcgattggtgatggcgtaacagccaccgtgccgctgctgtgggtagtgatgatttgcgccacctttgctcgcccgaacggcttgtttatcgctcattttggctggccgcgcgaacgtgtttcccgtgggatgcgttactacctgatgagcatcgggcttattgtgccgctgattatggcgctgatgatgttcgataacctcgacgaccgcgaattttccggttcgctgggacggctttgctttatcctcatttgcggtgcgctggcggtggtcaccctcagcctgaaaaaggccgggatcccgctgtatctcaacaaagagggcagcggcgacaacattaccaaccatatgctgtggaacatgatgattggcgcacctctggttgccattctggcgtcggcggtgggttatctggcaacggcgcaggcactgttagcgaggcttgaaacctcggttgccatctggttcctgctactggtggtttatcacgttatccgccgctggatgctgatccagcgccgcaggctggcgtttgaccgggcgaagcatcgccgggcagagatgttagcgcagcgtgcgcgtggcgaagaggaagcgcatcatcacagtagcccggaaggagcaattgaagtcgatgaaagcgaagtcgatctcgatgccatcagtgcgcaatccttgcggctggtgcgctcaattttgatgttgatcgccctgctttcggtcattgtgctgtggtcagaaatccattccgctttcggcttcctcgaaaatatttcgctgtgggatgtcacttccacggtacagggcgtagaaagcctggagccgattaccctcggtgcggtactgattgccattctggtgtttatcatcaccacgcagctggtgcgcaacctgcccgcgctgctggaactggcgattctgcagcacctggatttaacgccgggtacgggctacgccatcaccaccatcaccaaatatctgctgatgctgattggcgggctggtcggcttctcaatgattggtattgagtggtcgaaattgcagtggctggttgccgcgctcggtgttggtctcggttttggtttgcaggaaattttcgccaactttatctctggcctgatcatcctgttcgaaaaaccgattcgcattggcgatacggtaacgatccgcgatcttaccggtagtgtgacgaaaattaacacccgcgccaccaccatcagcgactgggaccgcaaagaaattatcgtgccgaacaaggcgtttattaccgagcagtttatcaactggtcgctctctgactcggtcacgcgtgtggtgttgacaattccggcccctgccgatgccaacagtgaagaagtgacggaaatcctgctcaccgcagcgcgtcgctgctcactggtgatcgacaacccagcaccggaagtcttcctggtggatctgcagcaggggattcagattttcgagctgcgtatttacgccgctgagatgggtcaccgtatgccgctacgccatgagatccaccaactaattctggcgggcttccacgcccacggtatcgatatgccattcccgcccttccagatgcgtctggaaagcctcaacggtaaacaaacggggagaacattaacttctgcgggcaaaggtcgtcaggcgggaagtttgtaa

SEQ ID NO: 9600 - protein, 1107 aa, Escherichia coli
MRLIITFLMAWCLSWGAYAATAPDSKQITQELEQAKAAKPAQPEVVEALQSALNALEERKGSLERIKQYQEVIDNYPKLSATLRAQLNNMRDEPRSVSPGMSNDALNQEILQISSQLLDKSRQAQQEQERAREIADSLNQLPQQQTDARRQLNEIERRLGTLTGNTPLNQAQNFALQSDSARLKALVDELELAQLSANNRQELARLRSELAEKESQQLDAYLQALRNQLNSQRQQEAERALESTEQLAESSADLPKDIVAQFKINRELSAALNQQAQRMDLVASQQRQAASQTLQVRQALNTLREQSQWLGSSNLLGEALRAQVARLPEMPKPQQLDTEMAQLRVQRLRYEDLLNKQPLLRQIHQADGQPLTAEQNRILEAQLRTQRELLNSLLQGGDTLLLELTKLKVSNGQLEDALKEVNEATHRYLFWTSDVRPMTIAWPLEIAQDLRRLISLDTFSQLGKASVMMLTSKETILPLFGALILVGCSIYSRRYFTRFLERSAAKVGKVTQDHFWLTLRTLFWSILVASPLPVLWMTLGYGLREAWPYPLAVAIGDGVTATVPLLWVVMICATFARPNGLFIAHFGWPRERVSRGMRYYLMSIGLIVPLIMALMMFDNLDDREFSGSLGRLCFILICGALAVVTLSLKKAGIPLYLNKEGSGDNITNHMLWNMMIGAPLVAILASAVGYLATAQALLARLETSVAIWFLLLVVYHVIRRWMLIQRRRLAFDRAKHRRAEMLAQRARGEEEAHHHSSPEGAIEVDESEVDLDAISAQSLRLVRSILMLIALLSVIVLWSEIHSAFGFLENISLWDVTSTVQGVESLEPITLGAVLIAILVFIITTQLVRNLPALLELAILQHLDLTPGTGYAITTITKYLLMLIGGLVGFSMIGIEWSKLQWLVAALGVGLGFGLQEIFANFISGLIILFEKPIRIGDTVTIRDLTGSVTKINTRATTISDWDRKEIIVPNKAFITEQFINWSLSDSVTRVVLTIPAPADANSEEVTEILLTAARRCSLVIDNPAPEVFLVDLQQGIQIFELRIYAAEMGHRMPLRHEIHQLILAGFHAHGIDMPFPPFQMRLESLNGKQTGRTLTSAGKGRQAGSL

SEQ ID NO: 9601 - DNA, 969 bp, Escherichia coli
ttgttaaattcatttaaactttcgctacagtacattctgccgaaactatggcttactcgcctggcgggttggggcgcaagcaagcgggcaggatggctgacaaaactggttatcgatctgttcgttaaatactacaaggtcgacatgaaagaggcgcaaaagccggacaccgccagctaccgcacctttaacgaattctttgtccgtccgctgcgtgacgaagtacgcccaatcgataccgatccgaatgtactggttatgcctgccgatggcgttatcagccagttgggtaaaatcgaagaagataaaatcctgcaagccaaaggccacaactacagcctcgaagccctgctggcaggcaactatctgatggcggatctcttccgtaacggtacgtttgtgaccacttacctctccccacgtgactaccaccgcgtacacatgccgtgcaacggtattctgcgtgaaatgatctacgtgccgggcgatctcttctccgttaaccatctcactgctcagaacgtgccgaatctgtttgcccgtaacgaacgcgtgatctgcctgttcgataccgaatttggcccgatggcgcagattctggtcggtgcgacgattgtaggcagcattgagacggtctgggcgggcaccattacgccgccgcgcgaaggcatcatcaagcgctggacctggcctgccggggaaaacgacgattctgtggcattgctgaaaggccaggaaatgggtcgctttaaacttggctctaccgttatcaacctgtttgcaccaggtaaagtgaacctggttgagcaactggaaagcctgtctgtcacgaaaattggccagccgctggcagtatctaccgaaacctttgttacgccagacgctgaaccagccccgcttcctgctgaagagatcgaagcagaacacgacgccagcccattggttgacgacaaaaaagaccaggtctaa

SEQ ID NO: 9602 - protein, 322 aa, Escherichia coli
MLNSFKLSLQYILPKLWLTRLAGWGASKRAGWLTKLVIDLFVKYYKVDMKEAQKPDTASYRTFNEFFVRPLRDEVRPIDTDPNVLVMPADGVISQLGKIEEDKILQAKGHNYSLEALLAGNYLMADLFRNGTFVTTYLSPRDYHRVHMPCNGILREMIYVPGDLFSVNHLTAQNVPNLFARNERVICLFDTEFGPMAQILVGATIVGSIETVWAGTITPPREGIIKRWTWPAGENDDSVALLKGQEMGRFKLGSTVINLFAPGKVNLVEQLESLSVTKIGQPLAVSTETFVTPDAEPAPLPAEEIEAEHDASPLVDDKKDQV

SEQ ID NO: 9603 - DNA, 1014 bp, Escherichia coli
gtgaacgccaatcaccagcgtcgtcttaaaacgtctaaggagaagcccgactacgacgacaatctgtttggcgagcctgatgaaggtatcgtcatcagccgctttggtatgcacgctgatgtggaatccgccgatggcgacgttcaccgctgcaatattcgccgtaccatccgttcgttggtgaccggcgaccgcgtagtctggcgtccgggtaaaccagcggcggaaggcgtaaatgtcaaagggatcgtggaagcggtgcatgagcgcacctcagtgttgacgcgcccggatttttacgacggtgtgaaacctattgctgccaacatcgaccagattgtcattgtctccgccattttgccggagctgtcgctcaatattatcgaccgttacctggtggcctgcgaaaccttgcagattgagccgattattgtgctcaacaagatagacctgctggacgacgaaggcatggagttcgtcaacgagcagatggatatctaccgcaatatcggttatcgcgtattgatggtttccagtcatactcaggatgggctgaaaccgctggaagaggcgttgaccgggcgcatcagcatttttgccgggcagtctggcgttggcaaatccagcctgctgaacgcgttgctggggctgcaaaaagagatcctgaccaacgatgtctctgacaactcggggcttggtcagcacaccacgaccgccgcacgactgtatcacttcccgcacggcggtgatgtgattgattccccaggtgtgcgtgagtttggtctctggcacctggagccggaacaaatcactcagggctttgtcgaattccatgactatttaggtctgtgtaaatatcgcgattgcaaacacgataccgatccgggctgcgctatccgggaagcggttgaggaaggaaaaatcgcggaaacccgtttcgaaaactatcaccgtattctggaaagcatggcgcaggtaaaaacgcgtaaaaacttttctgatacggatgactga

SEQ ID NO: 9604 - protein, 337 aa, Escherichia coli
MNANHQRRLKTSKEKPDYDDNLFGEPDEGIVISRFGMHADVESADGDVHRCNIRRTIRSLVTGDRVVWRPGKPAAEGVNVKGIVEAVHERTSVLTRPDFYDGVKPIAANIDQIVIVSAILPELSLNIIDRYLVACETLQIEPIIVLNKIDLLDDEGMEFVNEQMDIYRNIGYRVLMVSSHTQDGLKPLEEALTGRISIFAGQSGVGKSSLLNALLGLQKEILTNDVSDNSGLGQHTTTAARLYHFPHGGDVIDSPGVREFGLWHLEPEQITQGFVEFHDYLGLCKYRDCKHDTDPGCAIREAVEEGKIAETRFENYHRILESMAQVKTRKNFSDTDD

SEQ ID NO: 9605 - DNA, 663 bp, Escherichia coli
ttggagagtttatttttactcaatcgtacagactcctggtcgcccctgatgggcaaaacatctatgatacacgcaattgtggatcaatatagtcactgtgaatgggtggaaaatagcatgagtgccaatgaaaacaacctgatttggatcgatcttgagatgaccggtctggatcccgagcgcgatcgcattattgagattgccacgctggtgaccgatgccaacctgaatattctggcagaagggccgaccattgcagtacatcagtccgatgaacagctggcgctgatggatgactggaacgtgcgcacccataccgccagcgggctggtagagcgtgtgaaagcgagcacgatgggcgatcgtgaagctgaactggcaacgctcgaattcttaaaacagtgggtgcctgcgggaaaatcgccgatttgtggtaacagcatcggtcaggaccgtcgcttcctgtttaaatacatgccggagctggaagcctacttccactaccgctatctcgatgttagcaccctgaaagagctggcgcgccgctggaagccggaaattcttgacggctttaccaagcaggggacgcatcaggcgatggatgatatccgtgaatcggtggcggagttggcttactaccgcgagcattttatcaagctgtaa

SEQ ID NO: 9606 - protein, 220 aa, Escherichia coli
MESLFLLNRTDSWSPLMGKTSMIHAIVDQYSHCEWVENSMSANENNLIWIDLEMTGLDPERDRIIEIATLVTDANLNILAEGPTIAVHQSDEQLALMDDWNVRTHTASGLVERVKASTMGDREAELATLEFLKQWVPAGKSPICGNSIGQDRRFLFKYMPELEAYFHYRYLDVSTLKELARRWKPEILDGFTKQGTHQAMDDIRESVAELAYYREHFIKL

SEQ ID NO: 9607 - DNA, 1185 bp, Escherichia coli
gtgtgtggtatacttacggggtttttcttcattgtatggtccgtcatgtcagagcccctcgatctcaatcaattagcgcaaaatattaaacagtgggggctggaactgggctttcagcaggtaggtattaccgataccgatctcagcgcgtccgagcccaaactgcaagcatggctggacaaacaataccacggcgaaatggactggatggcgcgtcacggtatgctgcgtgctcgtcctcacgaattattgcccggtacgctgcgcgtgatcagcgttcggatgaattaccttcctgctaacgccgcatttgccagcacgctgaaaaatcccaaactcggctatgttagccgttatgcgctgggccgtgactatcacaagcttctgcgcaaccgactcaaaaagctgggcgagatgattcagcaacattgtgtttcgctgaattttagaccgtttgtcgattctgcgcctattctcgagcgcccgttagctgaaaaagcaggtcttggctggacaggtaagcactcacttatcctcaatcgcgaggccggttcgttcttctttttaggcgaattgctggtcgatattccgctgcccgtggatcaaccagtcgaggaaggatgcggtaaatgcgtggcctgtatgacgatttgcccgaccggtgccatcgtcgagccatataccgtcgatgctcgccgctgtatctcttatctcaccatcgaactggagggggcgatcccggaagagttgcgaccgttaatgggaaatcgtatttatggttgcgatgactgccagcttatctgcccgtggaatcgctattcgcaactcactacagaagacgatttcagcccgcgtaagccgctacacgctccggaactcattgagttattcgcctggagcgaagagcagtttttaaaagtcacggaaggttcggcgattcgccgtataggtcacctgcgttggctgcgtaatatcgccgtagcattaggcaatgccccctgggatgaaacgattttgacagcgctggaaagtcgtaaaggtgagcacccacttctcgatgagcacatagcgtgggcgattgcgcagcaaatcgagaggcgaaatgcgtgcatagtcgaagtgcaattaccgaaaaaacagcgtctggttcgggtgattgaaaaagggttaccgcgtgacgcctga

SEQ ID NO: 9608 - protein, 394 aa, Escherichia coli
MCGILTGFFFIVWSVMSEPLDLNQLAQNIKQWGLELGFQQVGITDTDLSASEPKLQAWLDKQYHGEMDWMARHGMLRARPHELLPGTLRVISVRMNYLPANAAFASTLKNPKLGYVSRYALGRDYHKLLRNRLKKLGEMIQQHCVSLNFRPFVDSAPILERPLAEKAGLGWTGKHSLILNREAGSFFFLGELLVDIPLPVDQPVEEGCGKCVACMTICPTGAIVEPYTVDARRCISYLTIELEGAIPEELRPLMGNRIYGCDDCQLICPWNRYSQLTTEDDFSPRKPLHAPELIELFAWSEEQFLKVTEGSAIRRIGHLRWLRNIAVALGNAPWDETILTALESRKGEHPLLDEHIAWAIAQQIERRNACIVEVQLPKKQRLVRVIEKGLPRDA

SEQ ID NO: 9609 - DNA, 1548 bp, Escherichia coli
atgacggaccatacaatgaagaaaaaccccgtaagtataccacacaccgtctggtacgccgacgatatccgccgcggagaacgcgaggcggcagatgcgctggggctcacactctatgagctgatgcttcgcgctggcgaagccgcattccaggtgtgtcgttcggcttatcctgacgcccgccactggctggtgctgtgcggtcatggtaataacggcggcgatggctacgtggtcgcgcggctggccaaagcgatcggtattgatgtcacgctgctggcccaggaaagtgacaaaccgttgccggaagaggccgcgctggcacgcgaagcatggttaaacgcgggaggcgagatccatgcttcgaatattgtctggcccgaatcggtagatctgattgttgatgcgctgctcggcaccggcttgcagcaagcgccccgcgaatccattagccagttaatcgaccacgctaatactcaccctgcgccgattgtggcggttgatatcccttccggccttctggctgaaaccggcgctacgccaggcgcggtaatcaacgccgatcacaccatcacttttattgcgctgaaaccaggcttgctcactggaaaagcgcgggatgttaccggacaactgcattttgactcactggggctggatagctggctggcaggtcaggagacgaaaattcagcggttttcggcagaacaactttctcagtggctgataccgcgtcgcccgacttcgcataaaggcgatcacgggcggctggtgattattggtggcgatcacggcacggcgggggctattcgtatgacgggggaagcggcgctgcgtgctggtgctggtttagtccgagtactgacccgcagtgagaacattgcgccgctgctgactgcacgaccggaattgatggtgcatgaactgactatggactctcttaccgaaagcctggaatgggccgatgtggtggtgattggtcccggtctgggccagcaagagtgggggaaaaaagccctgcaaaaagttgagaattttcgcaaaccgatgttgtgggatgccgatgcattgaacctgctggcaatcaatcccgataagcgtcacaatcgcgtgatcacgccgcatcctggcgaggccgcacggttgttaggctgttccgtcgctgaaattgaaagtgaccgcttacattgcacccaacgtctggtacaacgttatggcggcgtagcggtgctgaaaggtgccggaaccgtggtcgccgcccatcctgacgctttaggcattattgatgccggaaatgcaggcatggcgagcggcggcatgggcgatgtgctctctggtattattggcgcattgcttgggcaaaaaatgagcccttatgatgcagcctgtgcgggctgtgtcgcgcacggtgcggcagctgacgtactggcggcgcgttttggaacgcgcgggatgctggcaaccgatctcttttccacgctacagcgtattgttaacccggaagtgactgataaaaaccatgatgaatcgagtaattccgctccctga

SEQ ID NO: 9610 - protein, 515 aa, Escherichia coli
MTDHTMKKNPVSIPHTVWYADDIRRGEREAADALGLTLYELMLRAGEAAFQVCRSAYPDARHWLVLCGHGNNGGDGYVVARLAKAIGIDVTLLAQESDKPLPEEAALAREAWLNAGGEIHASNIVWPESVDLIVDALLGTGLQQAPRESISQLIDHANTHPAPIVAVDIPSGLLAETGATPGAVINADHTITFIALKPGLLTGKARDVTGQLHFDSLGLDSWLAGQETKIQRFSAEQLSQWLIPRRPTSHKGDHGRLVIIGGDHGTAGAIRMTGEAALRAGAGLVRVLTRSENIAPLLTARPELMVHELTMDSLTESLEWADVVVIGPGLGQQEWGKKALQKVENFRKPMLWDADALNLLAINPDKRHNRVITPHPGEAARLLGCSVAEIESDRLHCTQRLVQRYGGVAVLKGAGTVVAAHPDALGIIDAGNAGMASGGMGDVLSGIIGALLGQKMSPYDAACAGCVAHGAAADVLAARFGTRGMLATDLFSTLQRIVNPEVTDKNHDESSNSAP

SEQ ID NO: 9611 - DNA, 462 bp, Escherichia coli
atgatgaatcgagtaattccgctccctgatgagcaggcaacattagacctgggcgagcgggtagcgaaagcctgcgatggcgcaaccgtaatctatctgtatggcgatttaggtgcaggtaaaaccacctttagccggggctttttacaggctctgggtcatcagggtaatgtcaaaagccccacttatacgctggtcgaaccctatatgctcgacaatttaatggtttatcactttgatttgtaccgccttgccgatcccgaggagctggagtttatggggatccgcgattattttgccaacgatgccatctgcctggtggagtggccacaacaaggtacaggtgttcttcctgacccggatgtcgaaatacacattgattatcaggcacaaggccgtgaggcgcgcgtgagtgcggtttcctctgcgggtgaattgttgctggcgcgtttagccggttaa

SEQ ID NO: 9612 - protein, 153 aa, Escherichia coli
MMNRVIPLPDEQATLDLGERVAKACDGATVIYLYGDLGAGKTTFSRGFLQALGHQGNVKSPTYTLVEPYMLDNLMVYHFDLYRLADPEELEFMGIRDYFANDAICLVEWPQQGTGVLPDPDVEIHIDYQAQGREARVSAVSSAGELLLARLAG

SEQ ID NO: 9613 - DNA, 1338 bp, Escherichia coli
atgatgtatcgcatcagaaattggttggtagcgacgttgctgctgctgtgcgcgcaggtgggtgccgcgacgctctctgatattcaggtttctaacggcaaccaacaggcgcggataacgttgagttttattggcgatcctgattatgcgtttagccatcaaagcaaacgcaccgtggcgctcgatatcaaacaaacgggcgtgattcagggactgccgttgttgttcagcggcaataatctggtgaaggcgattcgctctggaacgcctaaagatgcacaaacgctacggctggtggtcgatcttaccgaaaatggtaaaaccgaagcggtgaagcggcagaatggcagcaattacactgtcgtctttacgattaacgccgatgtgccgccaccgcctcctccgccgcctgtggttgcgaaacgcgttgaaacgcctgcggttgtcgcaccgcgcgtcagcgaaccggcgcgcaatccgtttaaaacggaaagtaaccgcactacgggtgttatcagcagtaatacggtaacgcgtccggcagcgcgcgcgacggctaacacaggcgataaaattatcatcgctattgatgccggacacggcggtcaggatcctggcgctatcggccccggtggtacgcgggagaaaaatgtcaccatcgccatcgcgcgtaaattgcgtactttgctcaataacgatccgatgtttaaaggcgttttaacccgtgacggggattactttatctcggtgatggggcgcagtgatgtggcacgtaagcaaaacgccaatttccttgtatcgattcatgccgatgccgcaccaaaccgtagtgccaccggtgcctctgtatgggtgctctcaaaccgtcgcgccaacagcgaaatggcaagctggctggaacagcatgagaagcagtcggagctgctgggcggggcgggtgatgtgctggcgaacagtcagtctgacccctatttaagccaggcggtgctggatttacagttcggtcattcccagcgggtagggtatgatgtagcgaccagtatgatcagtcagttgcaacgcattggcgaaatacataaacgccgaccagaacacgcgagtctcggcgttctgcgttcgccggatattccgtcagtactggtcgaaaccggttttatcagtaacaacagcgaagaacgtttgctggcgagcgacgattaccaacaacagctggcagaagccatttacaaaggcctgcgcaattacttccttgcgcatccgatgcaatctgcgccgcagggtgcaacggcacaaacggccagtacggtgacgacgccagatcgcacgctgccaaactaa

SEQ ID NO: 9614 - protein, 445 aa, Escherichia coli
MMYRIRNWLVATLLLLCAQVGAATLSDIQVSNGNQQARITLSFIGDPDYAFSHQSKRTVALDIKQTGVIQGLPLLFSGNNLVKAIRSGTPKDAQTLRLVVDLTENGKTEAVKRQNGSNYTVVFTINADVPPPPPPPPVVAKRVETPAVVAPRVSEPARNPFKTESNRTTGVISSNTVTRPAARATANTGDKIIIAIDAGHGGQDPGAIGPGGTREKNVTIAIARKLRTLLNNDPMFKGVLTRDGDYFISVMGRSDVARKQNANFLVSIHADAAPNRSATGASVWVLSNRRANSEMASWLEQHEKQSELLGGAGDVLANSQSDPYLSQAVLDLQFGHSQRVGYDVATSMISQLQRIGEIHKRRPEHASLGVLRSPDIPSVLVETGFISNNSEERLLASDDYQQQLAEAIYKGLRNYFLAHPMQSAPQGATAQTASTVTTPDRTLPN

SEQ ID NO: 9615 - DNA, 1848 bp, Escherichia coli
atgccaattcaggtcttaccgccacaactggcgaaccagattgccgcaggtgaggtggtcgagcgacctgcgtcggtagtcaaagaactggtggaaaacagcctcgatgcaggtgcgacgcgtatcgatattgatatcgaacgcggtggggcgaaacttattcgcattcgtgataacggctgcggtatcaaaaaagacgagctggcgctggcgctggcgcgtcatgccaccagtaaaatcgcctctctggacgatctcgaagccattatcagtctgggctttcgcggtgaggcgctggcgagtatcagttcggtttcccgcctgacgctcacttcacgcaccgcagaacagcaggaagcctggcaggcctatgccgaagggcgcgatatggacgtgacggttaaaccggcggcgcatccggtgggaacgacgctggaggtgctggacctgttctacaacaccccggcgcggcgcaaattcctgcgcaccgagaaaaccgaatttaaccatatcgatgaaatcatccgccgcattgcgctggcgcgtttcgacgtcactatcagtctgtcgcataacggcaaaatcgtacgccagtatcgtgcagtgccggaaggcgggcaaaaagaacggcgtttaggcgcgatttgcggcaccgcttttctcgaacaagcgctggcgattgaatggcaacacggcgatctcacgctgcgcggctgggtggccgatccaaatcacactacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccgcatcaggtggacgtcaacgtgcaccctgccaaacacgaagtgcgtttccatcagtcgcgtctggtgcatgactttatctatcagggcgtgctgagcgtgctacaacagcaactggaaacgccgctaccgctggacgatgaaccacaacctgcaccgcgtgccattccggaaaatcgcgtggcggctgggcgcaatcactttgctgaaccggcagttcgtgagccggtagctccgcgctactctcctgcgcccgcctcaggcagtcgtccggctgcctcctggccgaatgcgcagcctggttaccagaaacagcaaggtgaagtgtatcgccagcttttgcaaacgcccgctccgatgcaaaaaccaaaagcgccagaaccgcaggaacctgcacttgcggcgaacagtcagagttttggtcgggtactgactatcgtccattccgactgtgcgttgcttgagcgcgatggcaacatttcacttttatccttgccagtggcagaacgttggctgcgtcaggcacaattgacgccgggtgaagtgccagtttgcgcccaaccgctgcttattccgttgcggctaaaagtttctggcgaagaaaaatcggcattagaaaaagcgcagtctgccttggcggaactgggtattgatttccagtccgatgcgcagcatgtgaccatcagggccgtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtga

SEQ ID NO: 9616 - protein, 615 aa, Escherichia coli
MPIQVLPPQLANQIAAGEVVERPASVVKELVENSLDAGATRIDIDIERGGAKLIRIRDNGCGIKKDELALALARHATSKIASLDDLEAIISLGFRGEALASISSVSRLTLTSRTAEQQEAWQAYAEGRDMDVTVKPAAHPVGTTLEVLDLFYNTPARRKFLRTEKTEFNHIDEIIRRIALARFDVTISLSHNGKIVRQYRAVPEGGQKERRLGAICGTAFLEQALAIEWQHGDLTLRGWVADPNHTTPALAEIQYCYVNGRMMRDRLINHAIRQACEDKLGADQQPAFVLYLEIDPHQVDVNVHPAKHEVRFHQSRLVHDFIYQGVLSVLQQQLETPLPLDDEPQPAPRAIPENRVAAGRNHFAEPAVREPVAPRYSPAPASGSRPAASWPNAQPGYQKQQGEVYRQLLQTPAPMQKPKAPEPQEPALAANSQSFGRVLTIVHSDCALLERDGNISLLSLPVAERWLRQAQLTPGEVPVCAQPLLIPLRLKVSGEEKSALEKAQSALAELGIDFQSDAQHVTIRAVPLPLRQQNLQILIPELIGYLAKQSVFEPGNIAQWIARNLMSEHAQWSMAQAITLLADVERLCPQLVKTPPGGLLQSVDLHPAIKALKDE

SEQ ID NO: 9617 - DNA, 906 bp, Escherichia coli
atggggccgacggcctccggtaaaacagcgttagccattgagctgcgtaaaattttaccagtagagttgataagcgttgattctgcccttatttacaaagggatggatatcgggacggcgaagccgaacgctgaagagttactcgccgcgccgcaccgattgctgaatattcgcgatccgtcgcaggcttactcggctgctgattttcgccgcgatgcgctggcggaaatggccgatatcaccgcggcggggcggatcccactattagtgggcggtacgatgttgtatttcaaggcattgctggaagggttgtcgccgctaccgtcggcagacccggaagtacgggccagaattgagcaacaggcggcagagcaaggttgggagtcattgcatcgtcaacttcaggaggtagatccggttgcggcagcaaggattcatccaaatgatccacaaaggctttcccgggcactggaagtttttttcatttcgggtaaaactttaacggaactgacgcaaacgtcaggagacgctctaccgtatcaggtgcatcagttcgccatcgccccggcgagccgtgaactgctccatcaacgaattgagcagcgttttcatcagatgttggcttcaggttttgaagcagaagtccgggcgctttttgcccgaggagatttgcatacggatttgccttccattcgttgcgtgggttatcgccagatgtggtcttaccttgaaggcgaaatctcatacgatgaaatggtttatcgaggtgtttgcgccacgagacagttggcgaagcggcagataacctggctgcgtggttgggaaggggttcactggcttgacagtgaaaaaccagaacaggcgcgtgacgaagtattacaggttgttggtgctatcgcaggctga

SEQ ID NO: 9618 - protein, 301 aa, Escherichia coli
MGPTASGKTALAIELRKILPVELISVDSALIYKGMDIGTAKPNAEELLAAPHRLLNIRDPSQAYSAADFRRDALAEMADITAAGRIPLLVGGTMLYFKALLEGLSPLPSADPEVRARIEQQAAEQGWESLHRQLQEVDPVAAARIHPNDPQRLSRALEVFFISGKTLTELTQTSGDALPYQVHQFAIAPASRELLHQRIEQRFHQMLASGFEAEVRALFARGDLHTDLPSIRCVGYRQMWSYLEGEISYDEMVYRGVCATRQLAKRQITWLRGWEGVHWLDSEKPEQARDEVLQVVGAIAG

SEQ ID NO: 9619 - DNA, 309 bp, Escherichia coli
atggctaaggggcaatctttacaagatccgttcctgaacgcactgcgtcgggaacgtgttccagtttctatttatttggtgaatggtattaagctgcaaggacaaatcgagtcttttgatcagttcgtgatcctgttgaaaaacacggtcagccagatggtttacaagcacgcgatttctactgttgtcccgtctcgcccggtttctcatcacagtaacaacgccggtggcggtaccagcagtaactatcatcatggtagcagcgcgcagaatacttccgcgcaacaggacagcgaagaaaccgaataa

SEQ ID NO: 9620 - protein, 102 aa, Escherichia coli
MAKGQSLQDPFLNALRRERVPVSIYLVNGIKLQGQIESFDQFVILLKNTVSQMVYKHAISTVVPSRPVSHHSNNAGGGTSSNYHHGSSAQNTSAQQDSEETE

SEQ ID NO: 9621 - DNA, 1152 bp, Escherichia coli
gtgattaccggtagccgtaaagcgccgcacccaaagtattttgtaggtgaaggtaaagcagttgaaattgcggaagccgtaaaagcgacaggagcttcggtcgttctttttgaccatgccctgagcccggcgcaggagcgtaacctggagcgtttgtgcgagtgtcgtgtcatcgaccgcaccggccttattttagatattttcgcccaacgtgcgcgtacccatgagggtaagttgcaggttgagttggcgcagttgcgccatctggctacgcgcctggtgcgtggctggacccaccttgaaagacagaaaggcgggattggtttgcgtggtccgggtgaaacccagctcgaaaccgaccgtcgtttgttgcgtaatcgcatcgtgcagatacagtcgcgcctggaaagagttgaaaagcagcgtgagcaggggcggcaatcgcgtatcaaagccgacgttcctactgtttcgctggtgggatataccaacgccggtaaatctactcttttcaatcgcatcaccgaagcgcgggtctacgcggcagaccagttgtttgccaccctcgacccgacgttgcggcgtattgacgttgcggatgtcggtgaaaccgtgttggcagataccgtagggtttattcgccacctgccgcacgatctggtggcggcatttaaagccacgttacaagagacgcggcaagccacattgctgctgcacgtcattgacgcggcggatgtgcgtgtacaagaaaacatcgaagcggtgaatacggttcttgaagagattgatgctcacgagatcccaaccctgctggtgatgaacaagatcgatatgctggacgatttcgaaccgcgtattgacagagatgaagagaacaaaccgatccgtgtctggctttctgcgcagaccggagcggggataccacagctttttcaggctttgacggagcgtctttccggcgaggtggcgcagcatacattgcgtctgccgccgcaggaagggcgcctgagaagtcgtttttatcagcttcaggcaatagaaaaagagtggatggaggaggacggcagcgtaagtctgcaagttcgtatgccgatcgttgactggcgtcgcctctgcaaacaagaaccggcgttgatcgattacctgatctaa

SEQ ID NO: 9622 - protein, 383 aa, Escherichia coli
MITGSRKAPHPKYFVGEGKAVEIAEAVKATGASVVLFDHALSPAQERNLERLCECRVIDRTGLILDIFAQRARTHEGKLQVELAQLRHLATRLVRGWTHLERQKGGIGLRGPGETQLETDRRLLRNRIVQIQSRLERVEKQREQGRQSRIKADVPTVSLVGYTNAGKSTLFNRITEARVYAADQLFATLDPTLRRIDVADVGETVLADTVGFIRHLPHDLVAAFKATLQETRQATLLLHVIDAADVRVQENIEAVNTVLEEIDAHEIPTLLVMNKIDMLDDFEPRIDRDEENKPIRVWLSAQTGAGIPQLFQALTERLSGEVAQHTLRLPPQEGRLRSRFYQLQAIEKEWMEEDGSVSLQVRMPIVDWRRLCKQEPALIDYLI

SEQ ID NO: 9623 - DNA, 1260 bp, Escherichia coli
atggcgtggaatcagcccggtaataacggacaagaccgcgacccgtggggaagcagcaaacctggcggcaactctgagggaaatggaaacaaaggcggtcgcgatcaagggccacctgatttagatgatatcttccgcaaactgagcaaaaagctcggtggtctgggcggcggtaaaggcaccggatctggcggtggcagttcatcgcaaggcccgcgcccgcagcttggcggtcgcgtcgttaccatcgcagcggcagcgattgtcattatctgggcggccagtggtttctataccattaaagaagccgaacgcggcgtggtaacacgctttggtaaattcagccatctggttgagccgggtctgaactggaaaccgacgtttatcgacgaagtcaaaccggtgaacgtggaagccgtgcgtgaactggcagcttctggtgtgatgctgacgtcggacgagaacgtagtgcgcgttgagatgaacgtgcagtaccgcgtcaccgatccggaaaaatatctgtatagcgtgaccagcccggatgacagtctgcgtcaggctaccgacagcgccctgcgcggggttatcggtaaatacaccatggaccgcattctgacggaaggtcgtaccgtgattcgtagcgatactcagcgcgaactggaagagacgattcgtccgtatgacatgggcatcactctgctggacgtcaacttccaggctgctcgtccgccggaagaagtaaaagcggcgtttgacgatgcgattgccgcgcgtgaaaacgaacagcaatacattcgtgaagcagaagcgtataccaacgaagttcagccgcgtgcgaacggtcaggcgcaacgtatcctcgaagaggcgcgtgcgtacaaggcccagaccatcctggaagctcagggtgaagtggcgcgctttgctaaacttctgccggaatataaagccgcgccggaaattactcgcgagcgtctgtatatcgagacgatggaaaaagtgttgggcaacacccgcaaagtgctggttaacgataaaggtggaaacctgatggttctgccgttagaccagatgctgaaaagtggtaacgcccctgcggcgaagagcgataacggtgccagcaatctgctgcgtctgccgccagcctcttcctccacaaccagtggagcaagcaacacgtcgtccaccagtcagggcgatattatggaccaacgccgcgccaacgcgcagcgtaacgactaccagcgtcagggggaataa

SEQ ID NO: 9624 - protein, 419 aa, Escherichia coli
MAWNQPGNNGQDRDPWGSSKPGGNSEGNGNKGGRDQGPPDLDDIFRKLSKKLGGLGGGKGTGSGGGSSSQGPRPQLGGRVVTIAAAAIVIIWAASGFYTIKEAERGVVTRFGKFSHLVEPGLNWKPTFIDEVKPVNVEAVRELAASGVMLTSDENVVRVEMNVQYRVTDPEKYLYSVTSPDDSLRQATDSALRGVIGKYTMDRILTEGRTVIRSDTQRELEETIRPYDMGITLLDVNFQAARPPEEVKAAFDDAIAARENEQQYIREAEAYTNEVQPRANGQAQRILEEARAYKAQTILEAQGEVARFAKLLPEYKAAPEITRERLYIETMEKVLGNTRKVLVNDKGGNLMVLPLDQMLKSGNAPAAKSDNGASNLLRLPPASSSTTSGASNTSSTSQGDIMDQRRANAQRNDYQRQGE

SEQ ID NO: 9625 - DNA, 1005 bp, Escherichia coli
atgcgtaagtcagttatcgcgattatcatcatcgtgctggtagtgctttacatgtctgtctttgtcgtcaaagaaggtgagcgcggtattacgctgcgttttggtaaggtactgcgtgacgatgacaacaaacctctggtttatgagccgggtctgcatttcaagataccgttcattgaaacggtgaaaatgctcgacgcacgtattcagaccatggacaaccaggccgaccgctttgtgaccaaagagaagaaagacctgatcgtcgactcttacatcaaatggcgcatcagcgatttcagccgttactatctggcaacgggtggtggcgacatttcgcaagcggaagtgctgttgaaacgtaagttctctgaccgtctgcgttctgaaattggtcgcctggacgtgaaagacatcgtcaccgattctcgtggtcgtctgaccctcgaagtacgtgacgcgctgaactccggttctgcgggtacagaagatgaagttactacccctgcagcagataacgccattgccgaagcggcagagcgcgtaacggctgagacgaagggcaaagttccggtcatcaatccgaacagtatggcggcgctgggtattgaagttgtcgatgtgcgaattaagcagatcaacctgccgaccgaagtgtctgaagcgatctacaaccgtatgcgcgccgagcgtgaagcggtagcgcgtcgtcaccgttcacaaggtcaggaagaagcggaaaaactgcgtgcaactgccgactatgaagtgaccagaacgctggcagaagctgagcgtcagggccgcatcatgcgtggtgaaggcgatgcagaagcagccaaactgtttgctgatgcattcagtaaagatccggacttctacgcattcatccgtagcctgcgtgcttatgagaacagcttctctggcaatcaggacgtgatggtcatgagcccggacagcgatttcttccgctacatgaagacgccgacttccgcaacgcgttaa

SEQ ID NO: 9626 - protein, 334 aa, Escherichia coli
MRKSVIAIIIIVLVVLYMSVFVVKEGERGITLRFGKVLRDDDNKPLVYEPGLHFKIPFIETVKMLDARIQTMDNQADRFVTKEKKDLIVDSYIKWRISDFSRYYLATGGGDISQAEVLLKRKFSDRLRSEIGRLDVKDIVTDSRGRLTLEVRDALNSGSAGTEDEVTTPAADNAIAEAAERVTAETKGKVPVINPNSMAALGIEVVDVRIKQINLPTEVSEAIYNRMRAEREAVARRHRSQGQEEAEKLRATADYEVTRTLAEAERQGRIMRGEGDAEAAKLFADAFSKDPDFYAFIRSLRAYENSFSGNQDVMVMSPDSDFFRYMKTPTSATR

SEQ ID NO: 9627 - DNA, 105 bp, Escherichia coli
atggattctaccatcgctttttcagagttacagcactttttgcactcaaaaatgacctcgatcagtctgttttttgttcagccaatcgttttcctcaacatgtag

SEQ ID NO: 9628 - protein, 34 aa, Escherichia coli
MDSTIAFSELQHFLHSKMTSISLFFVQPIVFLNM

SEQ ID NO: 9629 - DNA, 198 bp, Escherichia coli
atgaattcgacaatctggctggcgcttgccctggttttggtactggaaggtttagggccgatgctttacccgaaggcatggaagaagatgatctctgcaatgaccaatttgcccgataatattttacgtcgttttggcggtggacttgtggttgcgggcgttgtggtctactacatgttgaggaaaacgattggctga

SEQ ID NO: 9630 - protein, 65 aa, Escherichia coli
MNSTIWLALALVLVLEGLGPMLYPKAWKKMISAMTNLPDNILRRFGGGLVVAGVVVYYMLRKTIG

SEQ ID NO: 9631 - DNA, 186 bp, Escherichia coli
atggagaacggttttttcaccgttgattacgagagtatggcctgcgttgtgaccgccctggtagcgtacaacatatttagcccgttcagtcagaagatcgacgatcttacctttaccttcgtcaccccattgggtgcccagtacgacgacgttgttacccatttttcaaaatcaccgtttgcttaa

SEQ ID NO: 9632 - protein, 61 aa, Escherichia coli
MENGFFTVDYESMACVVTALVAYNIFSPFSQKIDDLTFTFVTPLGAQYDDVVTHFSKSPFA

SEQ ID NO: 9633 - DNA, 1080 bp, Escherichia coli
gtgctgtctccggctgcgctgatgaaagagatgaaagaactggaagaccgtggcatccccgttcgtgagcgtctgctgctgtccgaagcatgtccgctgatccttgattatcacgttgcgctggataacgcgcgtgagaaagcgcgtggcgcgaaagcgatcggcaccaccggtcgtggtatcgggcctgcttatgaagataaagtggcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggttgttgacgtttctgatctgctcgaccaggcgcgtcagcgtggcgatttcgtcatgtttgaaggtgcgcagggtacgctgctggatatcgaccacggcacttatccgtacgtaacttcttccaacaccactgctggtggcgtggcgaccggttccggcctgggcccgcgttatgttgattacgttctgggtatcctcaaagcttactccactcgtgtgggtgcaggtccgttcccgaccgaactgtttgatgaaactggcgagttcctctgcaagcagggtaacgaattcggcgcaactacgggtcgtcgtcgtcgtaccggctggctggacaccgttgccgttcgtcgtgcggtacagctgaactctctgtctggcttctgcctgactaaactggacgttctggatggcctgaaagaggttaaactctgcgtggcttaccgtatgccggatggtcgtgaagtgactaccactccgctggcagctgacgactggaaaggtgtagagccgatttacgaaaccatgccgggctggtctgaatccaccttcggcgtgaaagatcgtagcggcctgccgcaggcggcactgaactacatcaagcgcattgaagagctgaccggtgtgccgatcgatatcatctctaccggtccggatcgtactgaaaccatgattctgcgcgacccgttcgacgcgtaa

SEQ ID NO: 9634 - protein, 359 aa, Escherichia coli
MLSPAALMKEMKELEDRGIPVRERLLLSEACPLILDYHVALDNAREKARGAKAIGTTGRGIGPAYEDKVARRGLRVGDLFDKETFAEKLKEVMEYHNFQLVNYYKAEAVDYQKVLDDTMAVADILTSMVVDVSDLLDQARQRGDFVMFEGAQGTLLDIDHGTYPYVTSSNTTAGGVATGSGLGPRYVDYVLGILKAYSTRVGAGPFPTELFDETGEFLCKQGNEFGATTGRRRRTGWLDTVAVRRAVQLNSLSGFCLTKLDVLDGLKEVKLCVAYRMPDGREVTTTPLAADDWKGVEPIYETMPGWSESTFGVKDRSGLPQAALNYIKRIEELTGVPIDIISTGPDRTETMILRDPFDA

SEQ ID NO: 9635 - DNA, 426 bp, Escherichia coli
gtgcagttaacgagtttcactgattacggattacgtgcgctgatctacatggcgtcattgccagaagggcggatgaccagtatttctgaagtgactgacgtctacggcgtctcccgtaatcatatggtcaaaataatcaatcaacttagtcgtgccggctacgtgactgctgttcgtggaaaaaatggcggcattcgcttgggtaaaccggcgagtgcaatacgtattggtgatgtggtgcgcgagctggagcccttatcgctggtgaattgcagcagtgagttttgccacattacacctgcctgtcggttgaaacaggcgctttctaaggccgtgcaaagttttcttacggaactggataactacacgcttgccgatttggttgaagagaatcaaccgctttataaattattgctggtggagtga

SEQ ID NO: 9636 - protein, 141 aa, Escherichia coli
MQLTSFTDYGLRALIYMASLPEGRMTSISEVTDVYGVSRNHMVKIINQLSRAGYVTAVRGKNGGIRLGKPASAIRIGDVVRELEPLSLVNCSSEFCHITPACRLKQALSKAVQSFLTELDNYTLADLVEENQPLYKLLLVE

SEQ ID NO: 9637 - DNA, 2442 bp, Escherichia coli
atgtcacaagatcctttccaggaacgcgaagctgaaaaatacgcgaatcccatccctagtcgggaatttatcctcgaacatttaaccaaacgtgaaaaaccggccagccgtgatgagctggcggtagaactgcacattgaaggcgaagagcagcttgaaggcctgcgtcgccgcctgcgcgcgatggagcgcgatggtcaactggtcttcactcgccgtcagtgctatgcgctgccggaacgcctcgacctggtgaaaggtaccgttattggccaccgtgatggctacggctttctgcgagttgaagggcgtaaagatgatttgtatctctccagcgagcagatgaaaacctgcattcatggcgatcaggtgctggctcagccgctgggcgctgaccgtaaaggtcgtcgtgaagcgcgtattgtccgcgtactggtgccaaaaaccagccagattgttggtcgctacttcaccgaagcgggcgtcggctttgtggttcctgacgatagccgtctgagcttcgatatcttaatcccgcccgatcagatcatgggcgcgcggatgggctttgtggtggtggttgaactgactcaacgcccgactcgccgtaccaaagcggtgggtaaaatcgtcgaagtgctgggcgacaatatgggcaccggcatggcggttgatatcgctctgcgtacccatgaaattccgtacatctggccgcaggctgttgagcaacaggttgccgggctgaaagaagaagtgccggaagaagcaaaagtgggccgtgtcgatctgcgcgatttaccgctggtcaccattgatggcgaagacgcccgtgactttgacgatgcagtttactgtgagaaaaaacgcggcggcggctggcgtttatgggtcgcgattgccgacgtcagctactatgtgcgtccgccaacgccgctggacagagaagcgcgtaatcgtggtacgtcggtgtacttcccttcgcaggttatcccgatgctgccggaagtgctctctaacggcctgtgctcgctcaacccgcaggtagaccgcctgtgtatggtgtgcgagatgacggtttcgtcgaaaggccgcctgactggctacaaattctacgaagcggtgatgagttctcacgcgcgtctgacctacaccaaagtctggcatatactgcaaggcgatcaggatctgcgcgagcagtatgcgccgctggttaagcatctcgaagagttacataacctctataaagtgctggataaagcccgtgaagaacgcggtgggatctcatttgagagcgaagaagcgaagttcattttcaacgctgaacgccgtattgaacgtatcgaacagactcagcgtaacgacgcccacaagttaattgaagagtgcatgattctggcgaatatctcggcggcgcgtttcgttgagaaagccaaagaaccggcactgttccgtattcacgacaagccgagcaccgaagcgattacctctttccgttcagtgctggcggagctggggctggaactgccgggcggtaacaagccggaaccgcgcgactatgcagagttactggaatcggttgccgatcgtcctgatgcagaaatgctgcaaaccatgcttttgcgctcgatgaaacaggcgatttacgatccggaaaaccgtggtcacttcggtctggcattgcagtcctatgcgcactttacttcgccgattcgtcgttatcctgacctgacgttgcaccgcgccattaaatatctgctggcgaaagagcaggggcatcagggcaacaccactgaaaccggcggctaccattattcgatggaagagatgctgcaactgggtcagcactgttcgatggcggaacgtcgtgccgatgaagcaacgcgcgatgtgtctgactggctgaagtgtgacttcatgctcgaccaggtaggtaacgtctttaaaggcgtaatttccagcgtcactggctttggcttcttcgtccgtctggacgacttgttcattgatggtctggtccatgtctcttcgctggacaatgactactatcgctttgatcaggtagggcaacgcctgatgggtgaatccagcggccagacttatcgcctgggcgatcgcgtggaagttcgcgttgaagcggttaatatggacgagcgcaaaatcgactttagcctgatctccagcgaacgcgcaccgcgcaacgtcggtaaaacggcgcgcgagaaagcgaaaaaaggcgatgcaggcaaaaaaggcggcaagcggcgtcaggtcggcaaaaaggtcaactttgagccagacagcgcctttcgcggcgagaaaaaaccgaagccgaaagcagcgaagaaagacgcgagaaaagcgaaaaagccatcggtgaaaacgcagaaaatagccgcagcgaccaaagcgaagcgtgcggcgaagaaaaaagtggcagagtga

SEQ ID NO: 9638 - protein, 813 aa, Escherichia coli
MSQDPFQEREAEKYANPIPSREFILEHLTKREKPASRDELAVELHIEGEEQLEGLRRRLRAMERDGQLVFTRRQCYALPERLDLVKGTVIGHRDGYGFLRVEGRKDDLYLSSEQMKTCIHGDQVLAQPLGADRKGRREARIVRVLVPKTSQIVGRYFTEAGVGFVVPDDSRLSFDILIPPDQIMGARMGFVVVVELTQRPTRRTKAVGKIVEVLGDNMGTGMAVDIALRTHEIPYIWPQAVEQQVAGLKEEVPEEAKVGRVDLRDLPLVTIDGEDARDFDDAVYCEKKRGGGWRLWVAIADVSYYVRPPTPLDREARNRGTSVYFPSQVIPMLPEVLSNGLCSLNPQVDRLCMVCEMTVSSKGRLTGYKFYEAVMSSHARLTYTKVWHILQGDQDLREQYAPLVKHLEELHNLYKVLDKAREERGGISFESEEAKFIFNAERRIERIEQTQRNDAHKLIEECMILANISAARFVEKAKEPALFRIHDKPSTEAITSFRSVLAELGLELPGGNKPEPRDYAELLESVADRPDAEMLQTMLLRSMKQAIYDPENRGHFGLALQSYAHFTSPIRRYPDLTLHRAIKYLLAKEQGHQGNTTETGGYHYSMEEMLQLGQHCSMAERRADEATRDVSDWLKCDFMLDQVGNVFKGVISSVTGFGFFVRLDDLFIDGLVHVSSLDNDYYRFDQVGQRLMGESSGQTYRLGDRVEVRVEAVNMDERKIDFSLISSERAPRNVGKTAREKAKKGDAGKKGGKRRQVGKKVNFEPDSAFRGEKKPKPKAAKKDARKAKKPSVKTQKIAAATKAKRAAKKKVAE

SEQ ID NO: 9639 - DNA, 732 bp, Escherichia coli
atgagcgaaatgatttacggcatccatgcagtgcaggccctgctggagcgcgcccctgaacgttttcaggaagtctttattttaaaaggccgtgaagataaacgtctgttaccgctgattcacgcccttgagtctcagggcgtggttatccagttggcaaaccgccaatatctcgatgagaaaagcgacggtgccgtgcatcagggcattatcgctcgtgtgaagccaggacggcagtatcaggaaaacgatctgccggatctgatcgcttcgctcgatcaaccgttcctgctgatcctcgacggcgtaaccgatccgcacaacctcggcgcgtgtctgcgtagcgcggacgccgctggtgttcatgcggtgattgtgccgaaagatcgctccgcacagctcaacgccacggcgaaaaaagtggcctgtggtgcggcagaaagcgttccgctgattcgggtgactaatctggcgcgcaccatgcgtatgttgcaggaagagaatatctggatcgtcggtacggcaggcgaggcggatcatacactctatcagagcaaaatgaccggacgcctggcgctggtgatgggcgcggaaggtgaaggtatgcgtcgcctgacccgtgaacattgcgatgagttgatcagcatcccaatggcaggaagtgtttcttccctgaacgtttcggttgcaaccggaatttgcttatttgaagcggttcgtcagcgcagctag

SEQ ID NO: 9640 - protein, 243 aa, Escherichia coli
MSEMIYGIHAVQALLERAPERFQEVFILKGREDKRLLPLIHALESQGVVIQLANRQYLDEKSDGAVHQGIIARVKPGRQYQENDLPDLIASLDQPFLLILDGVTDPHNLGACLRSADAAGVHAVIVPKDRSAQLNATAKKVACGAAESVPLIRVTNLARTMRMLQEENIWIVGTAGEADHTLYQSKMTGRLALVMGAEGEGMRRLTREHCDELISIPMAGSVSSLNVSVATGICLFEAVRQRS

SEQ ID NO: 9641 - DNA, 402 bp, Escherichia coli
atgacatggaatccgttggcgctggcgacggcgctgcaaactgtacctgaacaaaatattgatgtaacaaatagcgaaagcgcattaattattaaaatgaatgattatggcgatttgcaaatcaatattctttttacttcccgccaaatgatcatcgaaacctttatttgtccggtaagtagtatcagcaatccagatgaatttaataccttcttattaagaaatcagaagctgatgccattgtcatcggtagggatctccagcgtgcaacaggaagagtattacattgttttcggtgcgttatcgcttaaatcttctcttgaagatatcctgcttgagataacctcgctggtagataacgcattggatctggctgaaattacagaagaatattcacactaa

SEQ ID NO: 9642 - protein, 133 aa, Escherichia coli
MTWNPLALATALQTVPEQNIDVTNSESALIIKMNDYGDLQINILFTSRQMIIETFICPVSSISNPDEFNTFLLRNQKLMPLSSVGISSVQQEEYYIVFGALSLKSSLEDILLEITSLVDNALDLAEITEEYSH

SEQ ID NO: 9643 - DNA, 699 bp, Escherichia coli
atgggaattttaaaaagtttatttacgctggggaaatcgtttatctcccaggcggaagagtccattgaagaaacccagggcgtgcgcatgctggaacagcatattcgtgacgctaaagctgaactcgataaagccggaaaatctcgcgttgatctgctggcgcgagtgaaattaagtcacgataagctgaaagatttacgtgagcgcaaagccagtctggaagctcgtgcgctggaagcgttaagcaagaacgtgaatccgtcgttgattaacgaagttgctgaagaaatcgcgcgccttgagaatctcattaccgctgaagagcaagtgttgtcgaatctggaagtctctcgtgatggcgtggaaaaagcagttacagcgacagcgcagcgtatcgctcagtttgagcagcaaatggaagtcgttaaagccactgaagccatgcagcgtgcacaacaggctgtaacgacctctactgttggcgcatcttccagcgtttcgacagcggcagaatccttaaaacgcctgcaaacgcgtcaggccgaacgtcaggctcgcctggatgctgccgcacagttggaaaaagtcgcagacggtcgcgatctcgatgaaaagctggcggaagccggaattggcggtagcaataaaagtagcgcccaggatgtattagcaagactgcaacgccaacagggcgagtaa

SEQ ID NO: 9644 - protein, 232 aa, Escherichia coli
MGILKSLFTLGKSFISQAEESIEETQGVRMLEQHIRDAKAELDKAGKSRVDLLARVKLSHDKLKDLRERKASLEARALEALSKNVNPSLINEVAEEIARLENLITAEEQVLSNLEVSRDGVEKAVTATAQRIAQFEQQMEVVKATEAMQRAQQAVTTSTVGASSSVSTAAESLKRLQTRQAERQARLDAAAQLEKVADGRDLDEKLAEAGIGGSNKSSAQDVLARLQRQQGE

SEQ ID NO: 9645 - DNA, 660 bp, Escherichia coli
atgtctggttttttccagcgtctgtttggcaaggataataagcctgctatcgctcgcggtccgttgggtctgcatctcaatagtggttttacgctcgatacgttagcgtttcgtttgctggaagatgcattgctgatcgagctaccgggtgaagaatataccgtggccgccgtcagttgcatcgatctgggcgggggtagccagattttccgttactacacttcgggcgatgagttcctgcaaatcaataccactggcggcgaagatattgatgacattgatgatatcaagctctttgtctatgaagagagctacggtatcagtaaagagagtcactggcgcgaggcgatcaacgccaaagcgatgggggcaatgaccttaaactggcaggaaaaacgctggcagcgattttttaacagcgaagaaccgggaaatatcgaacccgtctacatgctggaaaaagtagaaaatcaaaaccatgctaaatgggaagtgcataattttagcatgggctaccaacggcaggtgaccgaagatacttacgaatatttgctgttaaatggtgaggaatcttttaacgatctcggcgagccggagtggttattttcgcgcgcgctgggtgtcgatatcccgataacatcacttcatattattggttaa

SEQ ID NO: 9646 - protein, 219 aa, Escherichia coli
MSGFFQRLFGKDNKPAIARGPLGLHLNSGFTLDTLAFRLLEDALLIELPGEEYTVAAVSCIDLGGGSQIFRYYTSGDEFLQINTTGGEDIDDIDDIKLFVYEESYGISKESHWREAINAKAMGAMTLNWQEKRWQRFFNSEEPGNIEPVYMLEKVENQNHAKWEVHNFSMGYQRQVTEDTYEYLLLNGEESFNDLGEPEWLFSRALGVDIPITSLHIIG

SEQ ID NO: 9647 - DNA, 399 bp, Escherichia coli
atgcatatactggattcacttcttgcctttagtgcctatttttttattggcgtggcgatggtgattattttcctgtttatctactccaaaattacaccgcacaacgaatggcagttaatcaaaaacaataacaccgcggcggcactggcgttcagcggaacattgttggggtacgtgatccccttatccagtgcggcaatcaatgcggtgagtattccagactatttcgcatggggcgggattgctctggtgattcaattactcgtttttgctggcgtcaggctttatatgcctgcattaagcgaaaaaattattaatcacaataccgcagcaggaatgtttatgggaaccgccgcgctggctggcggtatttttaacgcagcttgtatgacatggtaa

SEQ ID NO: 9648 - protein, 132 aa, Escherichia coli
MHILDSLLAFSAYFFIGVAMVIIFLFIYSKITPHNEWQLIKNNNTAAALAFSGTLLGYVIPLSSAAINAVSIPDYFAWGGIALVIQLLVFAGVRLYMPALSEKIINHNTAAGMFMGTAALAGGIFNAACMTW

SEQ ID NO: 9649 - DNA, 639 bp, Escherichia coli
atggccagaaaacgcaaatccagaaataacaaaaatatcggacatggggcaatcagtcgcattggtagaccgcataatccttttgagccgcgccgcaatcgctacgcacaaaaatacttaacgttggcactaatgggcggtgccgcttttttcgtattgaaaggttgtggcgatagtggcgatgtcgataacgacggcgacggaacgttttacgcgactgcgcaggattgtattgatgatggtaataattcagatatctgtgctcatggctggaacaacgccaaagcggcattttatgccgatgttccgaagaatatgactcagcataattgtcagtctaagtacgaaaattgctactacgacaatgttgaacagagttggatcccggtcgtttctggatttttgttaagccgggttattcgtaaagatcgcgatgagccgttcgtctataacagcggcggatcctcatttgcttcccgccccgtctggcgcaacacttccggtgattactcctggcgctccggttctggcaaaaaagagtcttactcttcgggcggctttaccaccaaaaaagcgtcaaccgtttctcgcggcggctatggtcgttcttccagcgcccgtgggcattggggaggctaa

SEQ ID NO: 9650 - protein, 212 aa, Escherichia coli
MARKRKSRNNKNIGHGAISRIGRPHNPFEPRRNRYAQKYLTLALMGGAAFFVLKGCGDSGDVDNDGDGTFYATAQDCIDDGNNSDICAHGWNNAKAAFYADVPKNMTQHNCQSKYENCYYDNVEQSWIPVVSGFLLSRVIRKDRDEPFVYNSGGSSFASRPVWRNTSGDYSWRSGSGKKESYSSGGFTTKKASTVSRGGYGRSSSARGHWGG

SEQ ID NO: 9651 - DNA, 1164 bp, Escherichia coli
atgctgagacacaacgttcctgtgcggcgggatctggaccggattgccgccgataacggatttgactttcatatcatcgacaatgaaatctattgggatgagagtcgggcttatcgctttactttgcgccagattgaagagcagatcgaaaaaccgaccgcggaactgcatcagatgtgcctggaggtggtggatcgcgcggttaaagatgaagagatcctgacgcaactggcgatcccgccgttgtactgggatgtgatcgccgaaagctggcgcgcacgcgatccttcgttgtatggccgtatggattttgcctggtgtggtaatgcaccggttaagttgctggagtacaacgccgatacgccaacttcattgtacgagtcggcttatttccagtggttgtggctggaagatgcccggcgcagcggcgttattccgcgtgatgccgatcagtacaatgccattcaggaacgcctgatttcacgttttagcgagctttacagtcgggaaccgttttatttttgctgctgtcaggacaccgacgaagacaggagtaccgtgctgtacttgcaggactgcgccgagcaggcagggcaggagtctcggtttatctacattgaagagctcggtttgggcgtcggcggcgtactgaccgatcttgatgataatgtcatccagcgtgcatttaagctgtatccgctggagtggatgatgcgtgacgataacggcccgctgctgcgcaagcgtcgtgagcaatgggtggagccgttatggaaaagtatcttgagtaataaagggctaatgccgctgctttggcgcttcttccctggtcatcctaaccttcttgcatcctggttcgatggtgaaaaaccgcagattgccgctggcgaaagctatgtgcgtaaaccgatttactcgcgcgaaggcggaaacgtcaccattttcgacggtcagaataacgttgttgaccacgctgatggtgattacgccgatgaaccgatgatctaccaggcgtttcaacctctgccgcgatttggcgatagctacacactcatcggtagctggattgtcgatgatgaagcgtgcggaatggggatccgtgaagataacacgttgatcaccaaagacacctcacgtttcgttccgcattacattgctggataa

SEQ ID NO: 9652 - protein, 387 aa, Escherichia coli
MLRHNVPVRRDLDRIAADNGFDFHIIDNEIYWDESRAYRFTLRQIEEQIEKPTAELHQMCLEVVDRAVKDEEILTQLAIPPLYWDVIAESWRARDPSLYGRMDFAWCGNAPVKLLEYNADTPTSLYESAYFQWLWLEDARRSGVIPRDADQYNAIQERLISRFSELYSREPFYFCCCQDTDEDRSTVLYLQDCAEQAGQESRFIYIEELGLGVGGVLTDLDDNVIQRAFKLYPLEWMMRDDNGPLLRKRREQWVEPLWKSILSNKGLMPLLWRFFPGHPNLLASWFDGEKPQIAAGESYVRKPIYSREGGNVTIFDGQNNVVDHADGDYADEPMIYQAFQPLPRFGDSYTLIGSWIVDDEACGMGIREDNTLITKDTSRFVPHYIAG

SEQ ID NO: 9653 - DNA, 1626 bp, Escherichia coli
gtgcactggcaaactcacaccgtttttaatcaacctataccattaaataacagcaacttatacctgtctgatggcgcgctttgcgaagcggtaacgcgtgaaggtgctggctgggatagcgattttctcgccagtattggtcagcagttaggaacggctgaatcccttgagctggggcggctggcgaatgtgaatccgcctgaattattgcgctacgatgcgcaaggacgccgtctggacgatgtgcgttttcaccccgcctggcacctgctgatgcaggcgctatgtaccaatcgggtgcacaatcttgcctgggaagaagacgctcgctccggcgcatttgtggcgcgcgcggcgcgttttatgttacatgcgcaggttgaggctgggtcgttatgtccgataacgatgacctttgccgccacgccattgttgttacagatgttacccgcgccgtttcaggactggaccacgccgctgctgagcgatcgctacgattctcacttattgccaggtgggcaaaaacgtggcttgttgatcggcatgggaatgacggaaaagcagggcggttccgatgtcatgagcaacaccacccgcgcagagcgtctggacgatggttcttatcggctggtggggcataaatggtttttctcggtgccgcaaagcgatgcgcatctggtgctggcacagaccgcgggcggtttgtcctgcttttttgtgccgcgctttttgcctgacgggcaacgcaacgcgattcgcctcgagcggctgaaagataagctgggtaatcgctctaacgccagctgcgaagtggagtttcaggatgccattggctggttgttggggcaggaaggggaaggaattcgtctgatcctgaaaatgggtgggatgacgcgttttgattgcgccctgggtagccatgccatgatgcgccgtgcattttcgctggcgatttaccatgcacatcaacgccatgtttttggtaatccattgatccaacagcctcttatgcgtcatgtcttaagtcgcatggcacttcagcttgaagggcaaacggcgttgctgtttcgtcttgcgcgagcgtgggaccggcgcgccgatgccaaagaagctctgtgggcgcgtttatttacgcctgcggcgaaatttgtgatctgcaaacgtggcattccgtttgtggccgaagcgatggaggtgctgggcggcattggttattgcgaggagagcgagctgccgcggctttaccgggagatgccggtaaacagtatttgggaaggttccggcaatattatgtgcctggatgtgctgcgcgttctcaataagcaagcgggcgtatacgacttattgtcggaagcatttgtggaagtgaaagggcaggatcgctattttgatcgcgcggttcgtcgtttacagcagcagctgcgtaagccagctgaagaattggggcgagagattactcatcagctattcctgctgggctgcggtgcgcaaatgttgaaatatgcctttccgccaatggcgcaggcgtggtgtaaggtgatgttagatacgcgcggcggcgtacggttgtcagagcagatccagaatgatttattgctgcgggcgacgggaggagtgtgtttgtaa

SEQ ID NO: 9654 - protein, 541 aa, Escherichia coli
MHWQTHTVFNQPIPLNNSNLYLSDGALCEAVTREGAGWDSDFLASIGQQLGTAESLELGRLANVNPPELLRYDAQGRRLDDVRFHPAWHLLMQALCTNRVHNLAWEEDARSGAFVARAARFMLHAQVEAGSLCPITMTFAATPLLLQMLPAPFQDWTTPLLSDRYDSHLLPGGQKRGLLIGMGMTEKQGGSDVMSNTTRAERLDDGSYRLVGHKWFFSVPQSDAHLVLAQTAGGLSCFFVPRFLPDGQRNAIRLERLKDKLGNRSNASCEVEFQDAIGWLLGQEGEGIRLILKMGGMTRFDCALGSHAMMRRAFSLAIYHAHQRHVFGNPLIQQPLMRHVLSRMALQLEGQTALLFRLARAWDRRADAKEALWARLFTPAAKFVICKRGIPFVAEAMEVLGGIGYCEESELPRLYREMPVNSIWEGSGNIMCLDVLRVLNKQAGVYDLLSEAFVEVKGQDRYFDRAVRRLQQQLRKPAEELGREITHQLFLLGCGAQMLKYAFPPMAQAWCKVMLDTRGGVRLSEQIQNDLLLRATGGVCL

SEQ ID NO: 9655 - DNA, 303 bp, Escherichia coli
gtggggaaacgaaaaatggagctgacgatgaaacaattacttgcctcaccctcgctgcaattagtgacttatcctgcgagcgccacggcacagtctgcagaattcgccagtgctgactgcgtgacgggcctgaatgaaataggtcagatctcagttagcaatatttcaggggatccgcaggacgtggaacgtatcgtggcgttaaaggccgatgaacaaggtgcgtcatggtaccgcattattaccatgtacgaagaccagcagcctgataactggcgcgtacaggcgatactgtatgcgtga

SEQ ID NO: 9656 - protein, 100 aa, Escherichia coli
MGKRKMELTMKQLLASPSLQLVTYPASATAQSAEFASADCVTGLNEIGQISVSNISGDPQDVERIVALKADEQGASWYRIITMYEDQQPDNWRVQAILYA

SEQ ID NO: 9657 - DNA, 429 bp, Escherichia coli
atgtgggttacgctttcgtcacgttttcattcgaaaatcgcgtaccaggtaacaattcgggaacattcccccaaagttaaattaataaggcactacactatggttagcaggaaacgtaatagcgttatttaccggtttgccagtttattattggtgttgatgttaagtgcctgtagcgcactgcaaggtacgccacagccagcaccgccagtaacggaccatccgcaagagattcgccgcgaccagacgcaagggttacagcgaataggtagcgtaagcacgatggttcggggttctccggatgacgcattagcagaaatcagagcgaaagctgtcgctgcaaaagctgattattacgttgtcgtcatggtggacgaaaccatcgtgacaggacagtggtattcacaagccattttgtaccgtaaataa

SEQ ID NO: 9658 - protein, 142 aa, Escherichia coli
MWVTLSSRFHSKIAYQVTIREHSPKVKLIRHYTMVSRKRNSVIYRFASLLLVLMLSACSALQGTPQPAPPVTDHPQEIRRDQTQGLQRIGSVSTMVRGSPDDALAEIRAKAVAAKADYYVVVMVDETIVTGQWYSQAILYRK

SEQ ID NO: 9659 - DNA, 750 bp, Escherichia coli
atgattgaaatagaatcacgcgagctggcagatattcccgttcttcatgcttatcctgtcgggcaaaaagataccccgttaccgtgtgtgattttttatcacggctttacttcgtccagtctggtgtatagctattttgccgttgcgctggcgcaggctggtttgcgggtgatcatgccggatgcgcccgatcacggtagccgttttagtggcgacgcagcgcggcggttaaatcaattctggcaaatcttgctacaaagtatgcaggaattcactaccttacgtgcggcaatagccgaagaaaactggctgcttgatgaccgtctggcagtcggtggcgcgtcgatgggcgcgatgacggcactgggaattaccgctcgccaccccacgataaaatgtatcgccagcatgatgggatcgggctattttacatcgctcgcccgttcactgtttcaaccgctgatacctgaaacggcagcacagcagaatgaattcaataacattgtcgcgccgctggcagagtgggaagcgacaaaccacctggaacagcttggtgacagacctctactgctgtggcatggccttgacgatgacgtcgtgcctgccgacgaatcactacgtttgcagcaggccttaagcgagacgggacgggataaactgctaacctgttcatggcagccaggtgtgcgtcaccgcattacgcctgaggcgttagatgctgccgtgacatttttccgccagcatctttaa

SEQ ID NO: 9660 - protein, 249 aa, Escherichia coli
MIEIESRELADIPVLHAYPVGQKDTPLPCVIFYHGFTSSSLVYSYFAVALAQAGLRVIMPDAPDHGSRFSGDAARRLNQFWQILLQSMQEFTTLRAAIAEENWLLDDRLAVGGASMGAMTALGITARHPTIKCIASMMGSGYFTSLARSLFQPLIPETAAQQNEFNNIVAPLAEWEATNHLEQLGDRPLLLWHGLDDDVVPADESLRLQQALSETGRDKLLTCSWQPGVRHRITPEALDAAVTFFRQHL

SEQ ID NO: 9661 - DNA, 756 bp, Escherichia coli
atgactgaagcacaaagacatcaaatcctcctggaaatgctcgcacaattgggctttgtgaccgttgagaaagtcgttgagcgtctgggaatttcgcctgccactgcacgacgcgatatcaataaacttgacgaaagcggcaaactgaaaaaagtgcgcaatggcgcagaagctattacccaacagcgcccgcgctggacgccgatgaatctgcatcaagcgcagaatcacgatgaaaaagtacgtattgctaaagcggcctcgcagctggttaatccgggcgaaagcgtagtcatcaactgcggctccaccgcgtttctgcttgggcgggaaatgtgtggcaagccagtgcaaatcatcactaattatctaccgctggcaaattacctgatcgatcaggagcatgacagcgtgatcattatgggcggacagtacaacaaaagtcagtccatcactttaagcccgcaaggcagcgaaaacagtctctatgccgggcactggatgtttaccagcggcaaaggactgacagcagaagggttgtataaaaccgatatgctgacggcaatggcagagcagaagatgctgagcgtggtagggaaactggtggtactggttgatagcagtaagattggcgaacgcgcgggaatgctttttagccgtgccgatcaaatcgatatgctgatcactggcaaaaatgctaacccggaaatcctgcaacaactggaagcgcaaggggtcagcattctgcgtgtttaa

SEQ ID NO: 9662 - protein, 251 aa, Escherichia coli
MTEAQRHQILLEMLAQLGFVTVEKVVERLGISPATARRDINKLDESGKLKKVRNGAEAITQQRPRWTPMNLHQAQNHDEKVRIAKAASQLVNPGESVVINCGSTAFLLGREMCGKPVQIITNYLPLANYLIDQEHDSVIIMGGQYNKSQSITLSPQGSENSLYAGHWMFTSGKGLTAEGLYKTDMLTAMAEQKMLSVVGKLVVLVDSSKIGERAGMLFSRADQIDMLITGKNANPEILQQLEAQGVSILRV

SEQ ID NO: 9663 - DNA, 1056 bp, Escherichia coli
gtgaaaagtatcacccgtgagtcctggatcctgagcactttcccggagtggggtagctggctgaatgaagaaattgagcaagagcaggtcgcacctggcactttcgcaatgtggtggctcggctgtaccgggatctggttgaaatcagaaggcggtgccaacgtttgtgttgatttttggtgcggtactggcaaacaaagccacggtaacccgttaatgaaacagggtcaccagatgcagcgcatggctggcgtgaaaaaactgcagccaaacctgcgcaccaccccgtttgttcttgatccgtttgcgattcgccagatcgacgcggtactggcgactcacgatcacaacgatcatatcgacgttaacgtcgctgctgccgtgatgcagaactgtgctgatgacgtaccgttcattggaccgaaaacttgcgttgatttgtggattggctggggcgtaccgaaagagcgttgcatcgtcgttaaaccgggcgacgtagtgaaggtaaaagacattgaaattcatgcacttgatgctttcgaccgtacggcactgatcaccctgcctgccgatcaaaaagcggctggcgtactgccggacggcatggacgatcgcgcggtgaactatctgttcaaaaccccaggcggtaccctgtatcacagcggcgactcccactactctaactactatgcaaaacatggtaatgagcatcagatcgacgtggctttaggttcatacggcgaaaacccacgcggtattaccgacaaaatgaccagtgctgatatcttgcgtatgggcgaagcgctgaatgcgaaagtagtgatcccgttccaccacgatatctggtcaaacttccaggccgatccgcaagagatccgcgtgctgtgggagatgaaaaaagatcgcctgaagtatggcttcaagccgtttatctggcaggtcggcggcaaatttacctggccgctggataaagacaacttcgagtaccactatccgcgtggtttcgatgattgcttcactattgaaccagatctgccgttcaagtcgttcctgtaa

SEQ ID NO: 9664 - protein, 351 aa, Escherichia coli
MKSITRESWILSTFPEWGSWLNEEIEQEQVAPGTFAMWWLGCTGIWLKSEGGANVCVDFWCGTGKQSHGNPLMKQGHQMQRMAGVKKLQPNLRTTPFVLDPFAIRQIDAVLATHDHNDHIDVNVAAAVMQNCADDVPFIGPKTCVDLWIGWGVPKERCIVVKPGDVVKVKDIEIHALDAFDRTALITLPADQKAAGVLPDGMDDRAVNYLFKTPGGTLYHSGDSHYSNYYAKHGNEHQIDVALGSYGENPRGITDKMTSADILRMGEALNAKVVIPFHHDIWSNFQADPQEIRVLWEMKKDRLKYGFKPFIWQVGGKFTWPLDKDNFEYHYPRGFDDCFTIEPDLPFKSFL

SEQ ID NO: 9665 - DNA, 1398 bp, Escherichia coli
atggagatcctctacaacatctttaccgtgttttttaaccaggtcatgaccaatgccccgttgttgctgggtattgtgacctgtctgggttacatcctactgcgcaaaagtgtcagcgttattattaaaggtacgattaaaaccataattggtttcatgttgttgcaggcagggtccggcatcctgaccagcaccttcaaaccggtggtggcgaaaatgtccgaagtctacggcattaacggcgcaatttccgatacttacgcgtcgatgatggcaaccattgaacgcatgggcgatgcctatagctgggtgggttacgcggtgttgttagcgctggcgctgaacatctgttacgtgctgctgcgccgaattaccggtattcgcaccatcatgctgactggtcacatcatgttccagcaggcggggctgattgccgttacgctgtttatcttcggctactccatgtggacgaccattatctgcaccgcgattctggtttcgctctactggggcattacctccaacatgatgtacaagccgacacaggaagtcaccgacggctgtggtttctccattggtcaccagcagcagttcgcatcatggattgcttataaagtcgcaccgttcctcggcaaaaaagaggaaagcgttgaagacctcaaactgcctggctggctgaatattttccacgacaacatcgtctccacggcgattgtcatgactatcttctttggtgccattctgctctcctttggtatcgacaccgtgcaggcgatggcaggcaaagtgaactggacggtgtacatcctgcaaaccggtttctcctttgcggtggcgattttcatcatcactcagggcgtgcgcatgtttgtggcggagctctctgaagcattcaacggtatctcccagcgcctgatcccgggtgcggttctggcgattgactgtgcggctatttatagcttcgcgccgaacgccgtggtctggggttttatgtggggcaccatcgggcaactgattgcggttggcatcctggtcgcctgtggctcttcaatcctgattattccaggctttatcccgatgttcttctccaacgccactatcggcgtgttcgctaaccacttcggcggctggcgcgcggcgctgaagatttgcctggtgatggggatgatcgaaatctttggttgcgtctgggcggtgaaactcaccggtatgagcgcctggatgggcatggcggactggtcgattctggcaccgccgatgatgcagggcttcttctccatcggtatcgcctttatggccgtcatcattgtcattgcactggcttatatgttcttcgctggccgcgcactgcgtgcagaagaagatgcagaaaaacaactggcagaacaatctgcttaa

SEQ ID NO: 9666 - protein, 465 aa, Escherichia coli
MEILYNIFTVFFNQVMTNAPLLLGIVTCLGYILLRKSVSVIIKGTIKTIIGFMLLQAGSGILTSTFKPVVAKMSEVYGINGAISDTYASMMATIERMGDAYSWVGYAVLLALALNICYVLLRRITGIRTIMLTGHIMFQQAGLIAVTLFIFGYSMWTTIICTAILVSLYWGITSNMMYKPTQEVTDGCGFSIGHQQQFASWIAYKVAPFLGKKEESVEDLKLPGWLNIFHDNIVSTAIVMTIFFGAILLSFGIDTVQAMAGKVNWTVYILQTGFSFAVAIFIITQGVRMFVAELSEAFNGISQRLIPGAVLAIDCAAIYSFAPNAVVWGFMWGTIGQLIAVGILVACGSSILIIPGFIPMFFSNATIGVFANHFGGWRAALKICLVMGMIEIFGCVWAVKLTGMSAWMGMADWSILAPPMMQGFFSIGIAFMAVIIVIALAYMFFAGRALRAEEDAEKQLAEQSA

SEQ ID NO: 9667 - DNA, 306 bp, Escherichia coli
atgaccgtacgtattctggctgtgtgtggtaacggacaaggcagttccatgatcatgaaaatgaaagtggaccagtttttaacccagtcgaacatcgaccacacggtaaacagctgcgcggttggcgaatacaaaagcgagttgagcggtgcggatatcatcatcgcttctacccatattgcgggcgaaatcaccgtgaccggcaacaaatatgtggttggcgtgcgcaacatgctctctcctgctgattttggcccgaaactgctggaagtgatcaaagagcatttcccgcaggacgtgaagtaa

SEQ ID NO: 9668 - protein, 101 aa, Escherichia coli
MTVRILAVCGNGQGSSMIMKMKVDQFLTQSNIDHTVNSCAVGEYKSELSGADIIIASTHIAGEITVTGNKYVVGVRNMLSPADFGPKLLEVIKEHFPQDVK

SEQ ID NO: 9669 - DNA, 465 bp, Escherichia coli
atgaaattacgtgattcgctggctgaaaataaatctatccgcctgcaagcggaagcagagacatggcaggacgcagtgaaaatcggcgttgatctgctggtagcggcagatgtggtagagccgcgttactaccaggcgattctggatgcggttgaacagcacggcccgtactttgtgctcgcacccggcctggcaatgccgcacggacgcccggaagagggggttaagaaaactggttttgcgctggtgacgctgaaaaagccgctggagttcaaccacgaagataacgatccggtggatatcctcatcaccatggcggcggttgatgccaacactcaccaggaagtgggcatcatgcagatcgtcaacctgtttgaagatgaagagaatttcgaccgtttacgtgcctgccgtaccgagcaggaagtactggatctcattgaccgcaccaacgcggcagcttaa

SEQ ID NO: 9670 - protein, 154 aa, Escherichia coli
MKLRDSLAENKSIRLQAEAETWQDAVKIGVDLLVAADVVEPRYYQAILDAVEQHGPYFVLAPGLAMPHGRPEEGVKKTGFALVTLKKPLEFNHEDNDPVDILITMAAVDANTHQEVGIMQIVNLFEDEENFDRLRACRTEQEVLDLIDRTNAAA

SEQ ID NO: 9671 - DNA, 651 bp, Escherichia coli
atgtcattaccgatgttgcaagtcgcgctggacaaccagactatggatagcgcctacgaaaccactcgcctgattgccgaagaagtcgacattatcgaagtgggcaccattctttgcgtaggcgaaggcgtgcgtgcggttcgtgacctgaaagcgctgtacccgcacaaaatcgtactggctgacgccaaaattgccgatgcaggcaaaatcctttctcgcatgtgcttcgaagccaacgctgactgggtgaccgtaatttgctgtgcggatatcaacaccgccaaaggcgcgctggacgtggcaaaagagtttaatggcgacgtgcagatcgaattgaccggctactggacctgggaacaggcgcagcagtggcgcgacgcaggcattgggcaggtggtttatcaccgcagccgtgacgcgcaggccgcaggcgtggcatggggcgaagcggacattaccgcgatcaaacgtctttccgatatgggcttcaaagtcaccgtcaccggtggtctggcgctggaagatctgccgttgtttaaaggcattccgattcatgtgtttatcgctggtcgcagcattcgtgatgccgcttctccggtggaggccgcacgtcagttcaaacgttccatcgctgaactgtggggctaa

SEQ ID NO: 9672 - protein, 216 aa, Escherichia coli
MSLPMLQVALDNQTMDSAYETTRLIAEEVDIIEVGTILCVGEGVRAVRDLKALYPHKIVLADAKIADAGKILSRMCFEANADWVTVICCADINTAKGALDVAKEFNGDVQIELTGYWTWEQAQQWRDAGIGQVVYHRSRDAQAAGVAWGEADITAIKRLSDMGFKVTVTGGLALEDLPLFKGIPIHVFIAGRSIRDAASPVEAARQFKRSIAELWG

SEQ ID NO: 9673 - DNA, 855 bp, Escherichia coli
atgttgtccaaacaaatcccgcttggcatctacgaaaaagcgctccccgctggggagtgctggctggaacgactgcaactggcaaaaacgttaggcttcgattttgtcgagatgtcagtagatgaaacggacgatcgcctttcgcgcctcgactggagccgcgagcagcgtctggcactggtgaatgcgattgttgaaaccggcgtgcgcgtaccgtccatgtgcctttctgctcatcgtcgtttcccgctgggaagcgaagatgacgcggtgcgggcccaggggctggagattatgcgtaaagctatccagttcgcccaggacgtcggtattcgcgtgatccaactggcgggctatgacgtttactatcaggaagccaataacgaaacgcgtcgtcgttttcgtgacggcctgaaagagagcgttgagatggcgagccgcgcgcaggtcacactggcgatggagatcatggattacccattgatgaactccatcagcaaggcgctgggctacgcacactatctcaacaatccgtggttccagctctacccggatatcggcaacctgtcggcgtgggacaacgacgtgcagatggagttgcaggccggaatcgggcatatcgtcgcggtacatgtgaaagacaccaaacctggcgtcttcaaaaacgtgccgtttggcgaaggcgtagtggatttcgaacgttgcttcgaaacgctcaaacagagtggctattgcgggccgtacctgattgagatgtggagcgaaacggcggaagacccggcggcagaagtagcgaaagcgcgtgattgggtgaaagcgcgcatggccaaagcaggcatggtggaggcggcataa

SEQ ID NO: 9674 - protein, 284 aa, Escherichia coli
MLSKQIPLGIYEKALPAGECWLERLQLAKTLGFDFVEMSVDETDDRLSRLDWSREQRLALVNAIVETGVRVPSMCLSAHRRFPLGSEDDAVRAQGLEIMRKAIQFAQDVGIRVIQLAGYDVYYQEANNETRRRFRDGLKESVEMASRAQVTLAMEIMDYPLMNSISKALGYAHYLNNPWFQLYPDIGNLSAWDNDVQMELQAGIGHIVAVHVKDTKPGVFKNVPFGEGVVDFERCFETLKQSGYCGPYLIEMWSETAEDPAAEVAKARDWVKARMAKAGMVEAA

SEQ ID NO: 9675 - DNA, 687 bp, Escherichia coli
atgcaaaagctgaaacagcaggtgtttgaggccaacatggagctgccgcgttacgggttggtgacctttacctggggcaacgtcagcgctattgaccgtgaacgcgggctggtggtgatcaagcccagcggtgtcgcctacgaaaccatgaaagcggacgatatggtagtggtcgatatgagcggcaacgtggtggaaggggagtatcgtccgtcttccgacactgcgacgcatctcgaactctaccgtcgttatccgtcgcttggcggcattgtccatacccactccactcatgccaccgcgtgggcgcaggcggggctggcgatcccagcgttaggcaccacgcacgccgattacttctttggcgatatcccgtgtacgcgtggattaagcaaagaagaggtgcagggtgagtacgaactgaataccggcaaagtgattatcgaaacgctgggtgacgccgagccgctgcatacgccgggaattgtggtgtatcagcacggaccgttcgcctgggggaaagatgcccacgatgcggtgcataacgcggtggtgatggaagaagtggcgaaaatggcgtggattgcgcgtagtattaacccacaactgaatcacatcgacagcttcctgatgaataaacacttcatgcgtaagcacggtcccaacgcttattacgggcagaagtaa

SEQ ID NO: 9676 - protein, 228 aa, Escherichia coli
MQKLKQQVFEANMELPRYGLVTFTWGNVSAIDRERGLVVIKPSGVAYETMKADDMVVVDMSGNVVEGEYRPSSDTATHLELYRRYPSLGGIVHTHSTHATAWAQAGLAIPALGTTHADYFFGDIPCTRGLSKEEVQGEYELNTGKVIIETLGDAEPLHTPGIVVYQHGPFAWGKDAHDAVHNAVVMEEVAKMAWIARSINPQLNHIDSFLMNKHFMRKHGPNAYYGQK

SEQ ID NO: 9677 - DNA, 276 bp, Escherichia coli
atgttcagtcgcgttttagcccttctggctgtgcttttgctaagtgcaaatacatgggcagccattgaaattaataaccaccaggccagaaatatggacgatgtgcaaagcttaggcgtgatttatatcaatcataacttcgccactgagagtgaagcacgtcaggcattaaatgaagagacagatgcgcaaggcgcaacgtactaccatgtgattctgatgcgggaaccggggagtaacggcaatatgcacgccagcgcggatatttatcgctag

SEQ ID NO: 9678 - protein, 91 aa, Escherichia coli
MFSRVLALLAVLLLSANTWAAIEINNHQARNMDDVQSLGVIYINHNFATESEARQALNEETDAQGATYYHVILMREPGSNGNMHASADIYR

SEQ ID NO: 9679 - DNA, 396 bp, Escherichia coli
atgcgtcattacgaaatcgtttttatggtccatcctgaccagagcgaacaggttccgggcatgatcgagcgctacactgctgccatcactggtgcagaaggcaagatccaccgtctggaagactggggccgccgtcagctggcttacccgatcaacaaactgcacaaagcacactacgttctgatgaacgttgaagctccgcaggaagtgatcgatgagctggaaactaccttccgcttcaacgatgccgttatccgcagcatggttatgcgtaccaagcacgctgttaccgaagcatctccgatggttaaagcgaaagacgagcgccgtgagcgtcgcgatgatttcgcaaacgaaaccgctgatgatgctgaagctggggattctgaagagtaa

SEQ ID NO: 9680 - protein, 131 aa, Escherichia coli
MRHYEIVFMVHPDQSEQVPGMIERYTAAITGAEGKIHRLEDWGRRQLAYPINKLHKAHYVLMNVEAPQEVIDELETTFRFNDAVIRSMVMRTKHAVTEASPMVKAKDERRERRDDFANETADDAEAGDSEE

SEQ ID NO: 9681 - DNA, 312 bp, Escherichia coli
accaaccgtctggtgttgtccggcaccgtgtgcaggactccccttcgaaaggtcagtccatcaggaattcctcactgccagttcgtgcttgagcatcgttctgtgcaggaggaagccggctttcaccggcaggcgtggtgccaaatgcccgttattgttagcggacacgaaaaccaggccattactcacagtataacggtcggcagtcgcataaccgttcaggggttcatttcatgccataaggcaaagaacggactgagcaaaatggttttgcatgccgagcagattgaattgatagattctggagactag

SEQ ID NO: 9682 - protein, 103 aa, Escherichia coli
TNRLVLSGTVCRTPLRKVSPSGIPHCQFVLEHRSVQEEAGFHRQAWCQMPVIVSGHENQAITHSITVGSRITVQGFISCHKAKNGLSKMVLHAEQIELIDSGD

SEQ ID NO: 9683 - DNA, 228 bp, Escherichia coli
atggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtccctgctgccgtacactgatcgccatcagtaa

SEQ ID NO: 9684 - protein, 75 aa, Escherichia coli
MARYFRRRKFCRFTAEGVQEIDYKDIATLKNYITESGKIVPSRITGTRAKYQRQLARAIKRARYLSLLPYTDRHQ

SEQ ID NO: 9685 - DNA, 450 bp, Escherichia coli
atgcaagttattctgcttgataaagtagcaaacctgggtagcctgggtgatcaggtaaacgttaaagcgggctatgctcgtaacttcctggtaccgcagggtaaagctgttccagctaccaagaaaaacattgaattcttcgaagcacgtcgcgctgaactggaagctaaactggctgaagttctggcagcagctaatgctcgcgctgagaaaatcaatgcactggaaactgttaccatcgcgtctaaagctggcgacgaaggtaaactgttcggttccatcggtactcgcgacatcgctgacgctgtaactgcagctggcgttgaagtggctaagagcgaagttcgtctgccgaacggcgttctgcgtaccactggcgaacacgaagtgagcttccaggttcacagcgaagtattcgcgaaagtgatcgtaaacgtagtagctgaataa

SEQ ID NO: 9686 - protein, 149 aa, Escherichia coli [sequence omitted]

SEQ ID NO: 9687 - DNA, 1269 bp, Escherichia coli
atggcattaatcggagtgtatgcggattgggaaggcctggatggtccggagcggattggttatttacacagtcgccgcactcggacgcgtgagatatttgagtttgagtacgataaaaaggcgcttgcagatccttcacttaatttcattcagttagatcctgaaataatgttgtatgagggagcacagtacccaattcctccaaaggataaatttggtgcatttagtgattcctgcccggatcgttgggggcgtatgctaatgaagcgtcgttttgagagggatattcgagacgggttatgtgataaagactcccacctttatgagtctgattatctactaggtgttcatgatctttatcgggttggggctcttcgatacaaacgtgaagacgctggagagtttcttgataatcgcattgatgttgcagccccaccatttaccgaaatagcgagtctggaaagggctagccgggcaattgaagaagatcctgataataaagagctaatggggcaaaaatggttaagaatgctaatcgctccggggggatcattagggggggcacgtccgaaagccagtgttgttgatgaagctgggcatctctacatcgctaaatttcccagtgtaaaagatgagtatgatgttggtggatgggaaatggtcgttaatgcacttgctgttggctgtggactgaatgttgcacctgctcaggcgcataaatttgccagcaattaccattgttttatggttcgtcgttttgaccgcactaatgcgggaaggcgtctgcattttgcttcggctatgacactaaccaggcatcaggatggtgaagatgcctctacaggtgtgagttatctggaattagcagatgttcttatcaggcatggcgcgcagactaatactgatcttaaggaactctggtccaggattgtttttaatattcttgtttctaataccgatgaccatttacgtaatcatggatatatcttgataccgggaaaaggttggcggctttctgaggcatatgatttgaatcctgttgccaggtctgacggtctaaaactcaatattacagaaaatgataatgcacttgatttggaattagctcgagaagttgcggagtattttcgacttggtttgacagaagcagatgacattattgctaattttagagggattgtcagtcagtggcgaatcattgccgagcgtcttcgattacctggtcgtgagcaagagttaatggcagaggcgttcaggggggcaatttag

SEQ ID NO: 9688 - protein, 422 aa, Escherichia coli
MALIGVYADWEGLDGPERIGYLHSRRTRTREIFEFEYDKKALADPSLNFIQLDPEIMLYEGAQYPIPPKDKFGAFSDSCPDRWGRMLMKRRFERDIRDGLCDKDSHLYESDYLLGVHDLYRVGALRYKREDAGEFLDNRIDVAAPPFTEIASLERASRAIEEDPDNKELMGQKWLRMLIAPGGSLGGARPKASVVDEAGHLYIAKFPSVKDEYDVGGWEMVVNALAVGCGLNVAPAQAHKFASNYHCFMVRRFDRTNAGRRLHFASAMTLTRHQDGEDASTGVSYLELADVLIRHGAQTNTDLKELWSRIVFNILVSNTDDHLRNHGYILIPGKGWRLSEAYDLNPVARSDGLKLNITENDNALDLELAREVAEYFRLGLTEADDIIANFRGIVSQWRIIAERLRLPGREQELMAEAFRGAI

SEQ ID NO: 9689 - DNA, 1278 bp, Escherichia coli
atgaataaaataaagaattatcgatggcatatgattgccctcgtatgctttatcactgtaatcaattatctggacagaacggcgttaggtattgcggctccaacgattatggagacaacaggaataaccaaagaacaatattcatggattgtcagtgcattccagttggcctatacattggggcaaccgataatgggcttctttattgataccgtgggtctgaagttaagttttgcgatatgtgccgcaatctggggcctggcgacaatggggcatgccttgacaggaacatggtcaggtctggcatttatgcgcgccctgatgggtttcagcgaagcatcggcaattcctgcgggtgtaaaaaccgcatcaacatggttcccggcaaaagagcgtggcgtggcgacaggtgttttcaatatgggcacctcactcggcgcgatgcttgctccaccgttgattgcctggtgcattatgtttcatagctggcaatttgcgtttattgtctcaggtagccttgctttactcgcggctttattttggttcttttgttataaagatccaaaagatgctaaacgcctttctgatgaagagcgccactatattgaatctgggcaagaacagcatcttaaaacagataagaaagaaaaaacgtcaatcaagcatatcctcagccaacgtaatttctgggggattggcatcgcgcgttttctcgctgacccggcatggggaaccattaacttctgggtaccgattttcttcgtcgaaacgctgcattttagcctgaaagaaattgccatgttcgtctggctgcctttcctgctgggcgatctcggctgtttagccagtggttttgtcgcgaagttcttccacgatcgcggcgtgagtttaattaactcacgaagaattaccttcactattgcagccgtcattatgatgacgattggtctggtgagtattgtcgaaaatccctacatcgccgtattactgattagcattggcgcattctcgcatcaatgtctttctactgttgcagcaactctgggcggtgacctattcaaaaaagacgaagtagctaccgctgtgggtatggcaggagcctgtgcatggagcggtcagttgattttcaacctgtttatcggggcattcgttcacattattggcttcgcgccgttctttattgccctggctttctttgacattattggcgccattgcgctgtggatgcttatcaaagttaaagacgaagaaccacaagtacagttagcgacaagctaa

SEQ ID NO: 9690 - protein, 425 aa, Escherichia coli
MNKIKNYRWHMIALVCFITVINYLDRTALGIAAPTIMETTGITKEQYSWIVSAFQLAYTLGQPIMGFFIDTVGLKLSFAICAAIWGLATMGHALTGTWSGLAFMRALMGFSEASAIPAGVKTASTWFPAKERGVATGVFNMGTSLGAMLAPPLIAWCIMFHSWQFAFIVSGSLALLAALFWFFCYKDPKDAKRLSDEERHYIESGQEQHLKTDKKEKTSIKHILSQRNFWGIGIARFLADPAWGTINFWVPIFFVETLHFSLKEIAMFVWLPFLLGDLGCLASGFVAKFFHDRGVSLINSRRITFTIAAVIMMTIGLVSIVENPYIAVLLISIGAFSHQCLSTVAATLGGDLFKKDEVATAVGMAGACAWSGQLIFNLFIGAFVHIIGFAPFFIALAFFDIIGAIALWMLIKVKDEEPQVQLATS

SEQ ID NO: 9691 - DNA, 2073 bp, Escherichia coli
atgagccagcttgatgaggccatccttgatgcactgacacacgttactttcccaaagggttttgcacaggcagaacccgcatgggttgtcacggtagacggtgttgattacccactctggaaaacagatgccctggtagtcggcagtggtgcagcagggctacgtgcagctgtagaacttaaacgccgccagcaaaatgtgttaatcgccaccgccgggttatatatggggacgtcggcatgttctggctctgataaacaaacactgtttaccgccgctaccgcgggcaacggcgacaacttcgccaaactggcagaggcactggcgagcggtggggcgatggatcacgacaccgcttatgttgaagcggtaggttctctgcacactcttggcgggttgcaatatcttggtctggaattaccggaagatcgctatggcgcgattcttcgttatcaaaccgaccacgacgaagccgggcgtgcaacctcgtgtgggccgcgtacctcaaggttaatggtgaaagtgctgctggaagaagtacagcgtcttgctatcccaatgttgaccagtgcaacagtgattaaactgctgcatcagcgtgacgaaaacggtgaagaccgtgtggcgggggcaatcatcgcgaccggtcatcgcgcccataacccatgggggctggcaattgtgactgcgcccaatgtggtactggcaacaggagggcctggcgagctttatcgcgacagtgtgtacccacacaaatgttttggctcgctggggctggcgctggaggaaggcctgacgctaaccaatctgaccgaaagccagtttggtataggcacgccgcgcagcacgtttccgtggaatttgtccggcacctatgtacaggtgatcccatatatctattccgtggatgccgggggcaacgagtataacttcctcgcggattactatcgcaccacccaggagctggcttcaaacattttccgtaaaggctatcagtggccgttccacgccacgcgggtaatggattttggctccagcttgttagatatggcagtagcgcaagagcagcaatcagggcgtctggtatttatggatttcaatcgtaatccagaacctgtgccgggtgacctgccgttctcattagatcgactggacgacgacgttcgcgcgtatctggaaaataacgacgctctggcaccatcgcccatcgaacgcctgcaacaaatgaatcctctgtctatctcgctgtataagatgcacggttacgatctcatcacgcagccattgcagtttgccatgaataatcagcacatgaatggcggcattgaagtcgatatctggggacaaacatctctgcccggttgttttgcggtgggggaagttgctggcacacacggcgtcacccgacctggcggcgcggcattgaatgccgggcaggtttttgctgttcgtctggcgcgctttattggttgcacgcaaaagcggaatattgatggagatattgcacagctggcagctccggcactggcttctataagagagatcattactcaggcgcacgataacgggtccgggatgccgttgtcggttgtgagagaaaaaattcaggcacgaatgtctgactatgcgggatttatttgccatgccgataaagtccgacgtgccactcgtgatgccctgctattgaacgaatttgtccaacggcatggattggcaatcaaacatgtgggtgaagttgccgagctgtttatgtggcggcatatggcactgacttctgccgccgtattaacgcaattaacgcattatattgacgcaggtggcggcagtcgtggggcgcggatggttattgatccacaaggcaaatgcctaccacaaactcgtcgcggcgtaaaagaagaatggcgttttcgctctgaactcgctgaagacaaaaatcacaaattaacaattcaatattcgcaaggttcttttattaccgaagtaaagtctttacgtatgcaaccgtgtattaacggtatttactttgaaaaaaactggccagactttttaaagggagacatttacacacaataa

SEQ ID NO: 9692 - protein, 690 aa, Escherichia coli
MSQLDEAILDALTHVTFPKGFAQAEPAWVVTVDGVDYPLWKTDALVVGSGAAGLRAAVELKRRQQNVLIATAGLYMGTSACSGSDKQTLFTAATAGNGDNFAKLAEALASGGAMDHDTAYVEAVGSLHTLGGLQYLGLELPEDRYGAILRYQTDHDEAGRATSCGPRTSRLMVKVLLEEVQRLAIPMLTSATVIKLLHQRDENGEDRVAGAIIATGHRAHNPWGLAIVTAPNVVLATGGPGELYRDSVYPHKCFGSLGLALEEGLTLTNLTESQFGIGTPRSTFPWNLSGTYVQVIPYIYSVDAGGNEYNFLADYYRTTQELASNIFRKGYQWPFHATRVMDFGSSLLDMAVAQEQQSGRLVFMDFNRNPEPVPGDLPFSLDRLDDDVRAYLENNDALAPSPIERLQQMNPLSISLYKMHGYDLITQPLQFAMNNQHMNGGIEVDIWGQTSLPGCFAVGEVAGTHGVTRPGGAALNAGQVFAVRLARFIGCTQKRNIDGDIAQLAAPALASIREIITQAHDNGSGMPLSVVREKIQARMSDYAGFICHADKVRRATRDALLLNEFVQRHGLAIKHVGEVAELFMWRHMALTSAAVLTQLTHYIDAGGGSRGARMVIDPQGKCLPQTRRGVKEEWRFRSELAEDKNHKLTIQYSQGSFITEVKSLRMQPCINGIYFEKNWPDFLKGDIYTQ

SEQ ID NO: 9693 - DNA, 1542 bp, Escherichia coli
atgcgtaagttatcaaccgccgagacactggcggcgcaaattcaggacggcgcaaccattgccattagcggtaacggcggcggtatggtggaagctgaccatattatggccgccattgaagagcgtttcctgcaaaccggacacccgcgcgatctgacattaatccactcgctgggtattggcgatcgcgacagcaaaggcactaaccgttttgctcacgccgaaatgctcaaacgcattattgccggacattttacctggtcgcccaagatgcaggaactggtgaaaagcaatgctattgaagcctactgtttccctggtggcgtaattcaggcactgctgcgggagatcggtgccggacgtccgggactttttacccacgttgggctgggatcgtttgttgatccacgcaatggcggcggtaagtcgaacgaatgcactaccgaggatttggtagaactgattgaaatcgacggtgaaaccaaactccgctatcgccctttcaaagtggactacgcgattttgcgcggcacctatgccgatccgcgtggcaacgttagcctcgaagaagaagcgattgatatggatagctattcgatggcgctggcagcacacaacagtggcggcaaagtgtttgtacaggtgcgcgatgtactggaagctggcaccattgaacctcgcaaggtcaagctaccggggattctggtcgatggtatcgttgagcaccgcgaacaaccgcaaacctatcttggtggttacgacctgaccattagcggtcaacatcgccgtctaagttctaacgacgctattgaactggttagtcatccggtgcgtcgcctgattgcccgtcgggcagcgcgggaactggcggcaggcgcttcaaccaactttggctttggtattcccggtggtattcctggggttgcgctgcgcgaaggcgtgccttatcaaagtttgtggctgagtgtagaacagggtgtacataacggcatgatgctggatgatgctctgttcggctgcgcccgtaacgccgatgccattattccatcactcgatcaatttgaattctacagtggcggcggcatcgatatcaccttcctcggcatgggagagatggatcaatacggtaacgtcaacgtctcccatcttaatggcaatctcattggccccggcggcttcctcgaaattgcacaaaacgcccgtaaagtggtgttttgcggtacgtttgacgccaaaggcagcaagattgatgtaacgccagatggtttgcatatcgcccagtcaggtcaaatccctaaactggttacccaggtggaaaaaatcacttttagcgccgcctacgcacagcaaagtggtcaggaagtgttgtatatcactgaacgcgcagtattccagttaacggcagaaggcgttgaattaattgagatcgcccctggcgtagagattgagcgcgacattctgccattcatggccttccgtccaattatcaagcacccacgcctgatggaaagtagcctgtttacgccgatggaggatgcatga

SEQ ID NO: 9694 - protein, 513 aa, Escherichia coli
MRKLSTAETLAAQIQDGATIAISGNGGGMVEADHIMAAIEERFLQTGHPRDLTLIHSLGIGDRDSKGTNRFAHAEMLKRIIAGHFTWSPKMQELVKSNAIEAYCFPGGVIQALLREIGAGRPGLFTHVGLGSFVDPRNGGGKSNECTTEDLVELIEIDGETKLRYRPFKVDYAILRGTYADPRGNVSLEEEAIDMDSYSMALAAHNSGGKVFVQVRDVLEAGTIEPRKVKLPGILVDGIVEHREQPQTYLGGYDLTISGQHRRLSSNDAIELVSHPVRRLIARRAARELAAGASTNFGFGIPGGIPGVALREGVPYQSLWLSVEQGVHNGMMLDDALFGCARNADAIIPSLDQFEFYSGGGIDITFLGMGEMDQYGNVNVSHLNGNLIGPGGFLEIAQNARKVVFCGTFDAKGSKIDVTPDGLHIAQSGQIPKLVTQVEKITFSAAYAQQSGQEVLYITERAVFQLTAEGVELIEIAPGVEIERDILPFMAFRPIIKHPRLMESSLFTPMEDA

SEQ ID NO: 9695 - DNA, 777 bp, Escherichia coli
atgagtgaccaacccgttctgttcagcagagcggcggcttcttgccgcctgacattgaaccgtgaagataaatgtcatgctattaatgaagaaatgatcgaatctctcgaccattatttaaatgaaattgaaaatgacacggcattacgcttagtcgaattaacggcaaccggcgataaattcttttgtgcgggcggcgatattaaatcgtggtcggcctattcgccattagatatgggcagaaaatggattaaacgcggtaatgacgtttttaatcgcctgcgcaacttaccccaattaaccgttgcgaatctcaacggtcataccatcggtggcggtattgaacttgccttgtgctgcgatattcgtatcgctcgccccggcgcgaaattctctaacccggaagtgatgctcggcatggtgccaggctggatgggcattgagcgagtgcttaatcaggttggtcctgtggtcggtcgccagatgctgatgctgggtaaacgcctgacggcgcaggaagcccaggtggcgaatttaattgatgaagtggtagaaaaagaacaggtggaaagctggatggcgaaccagttagcgcagctggaaaaatgtggtccggtggcactggcacatattaagcaactgattctggcgctggaaaataaacacgccgattactcccaccagttactggctggattaatgtccgccactcaggattgccaacaggcgacgcacgcatttgccgaaaaagccggcgtgagcttccacaatcaataa

SEQ ID NO: 9696 - protein, 258 aa, Escherichia coli
MSDQPVLFSRAAASCRLTLNREDKCHAINEEMIESLDHYLNEIENDTALRLVELTATGDKFFCAGGDIKSWSAYSPLDMGRKWIKRGNDVFNRLRNLPQLTVANLNGHTIGGGIELALCCDIRIARPGAKFSNPEVMLGMVPGWMGIERVLNQVGPVVGRQMLMLGKRLTAQEAQVANLIDEVVEKEQVESWMANQLAQLEKCGPVALAHIKQLILALENKHADYSHQLLAGLMSATQDCQQATHAFAEKAGVSFHNQ

SEQ ID NO: 9697 - DNA, 849 bp, Escherichia coli
atgagagatctgttacaacgcccggatttattcagtatcaataccgcgacactgggctataaaacgccgctacccgccattattgatgcctgcgccgcacgcggtattggcgcgattgccccctggcgcagggagttgcagagtgaagatctccagcaaatcgcccgccagcttgctgccagtaacatgaacgtttccggtttgtgccgtagcacctactacaccgcaccgacgctggcggagcgcaaactggcgattgacgataaccgccgggcgctggacgacgccgctgtactgaacgccgcctgttatatgcaggtggttggcggtctgccaatgggaacaaaagatctgtacgaagcacgggaacaggtgaaacaagggattcgccagttgctgccacattcgaaagaggtcggcgtgccaattgcactggagccactgcacccgatgactgctgccgatcgttcttgtctgtgcacgttacgtcaggcgctggactggtgtgatgaactcgatcccgatggcgaatttggcctcggcgtggcggtagatgtctaccatgtctggtgggacccggatctcgccagtcagatcctgcgtgccggaaaacgcatcctcgcgtttcatgtttccgactggttagtgccgaccaccgatctggtcaatgaccgtgaatgccgggagatggtgtcatcaatattccgtcaattcgtcggctggttgaaaacgccggatttaatggcgctattgaactggaaatattctcaccgtactggtggcagaaagatattaacagcacgctggatattagcgtcgatcgcatcgcacattattgttaaggaataa

SEQ ID NO: 9698 - protein, 282 aa, Escherichia coli
MRDLLQRPDLFSINTATLGYKTPLPAIIDACAARGIGAIAPWRRELQSEDLQQIARQLAASNMNVSGLCRSTYYTAPTLAERKLAIDDNRRALDDAAVLNAACYMQVVGGLPMGTKDLYEAREQVKQGIRQLLPHSKEVGVPIALEPLHPMTAADRSCLCTLRQALDWCDELDPDGEFGLGVAVDVYHVWWDPDLASQILRAGKRILAFHVSDWLVPTTDLVNDRECREMVSSIFRQFVGWLKTPDLMALLNWKYSHRTGGRKILTARWILASIASHIIVKE

SEQ ID NO: 9699 - DNA, 165 bp, Escherichia coli
atgccgggagatggtgtcatcaatattccgtcaattcgtcggctggttgaaaacgccggatttaatggcgctattgaactggaaatattctcaccgtactggtggcagaaagatattaacagcacgctggatattagcgtcgatcgcatcgcacattattgttaa

SEQ ID NO: 9700 - protein, 54 aa, Escherichia coli
MPGDGVINIPSIRRLVENAGFNGAIELEIFSPYWWQKDINSTLDISVDRIAHYC

SEQ ID NO: 9701 - DNA, 927 bp, Escherichia coli
ttgtactttcatcaggttatcaaatgtcctgtgatcgccatcgcatatcaaccaactagatggttgatctttttatcctccagtcgcaagctaatcatcactaaggaaacaaaattcaaaaaagagagctattgtatgaaatccactcgtcctgttgccgtgattaccggagccgctcgtggtattggaaagggctgtgcgctggagcttgcgcgtggcggatttaatctgctgattaatgatcgtccggatgccgatagcgtagaaaaattacatgccacacaacaagaatgtctggcggaaggcgtggaagtgatttgcttccctgctgatgtgggcgatctctccctgcatgaagagatgctcgacgcagcgcaaaaccagtggggacgtctggactgcctgctcaacaacgcaggcatttcagtgaaaaaacgcggtgaccttctcgacctcgaaccagacagcttcgaccaaaatattgccattaacacccgcgcaccgttcttccttgctcaggcattcagtaagcgcttactggcacagccgaaaccggaagcagaactgccgcaccgctcgattattttcgtcagttccatcaacgccatcatgctggcgatgaatcgcggcgaatataccattgccaaaactgccgtctctgccgctgctcgtctgtttgctgctcgcctttgtaatgaacaaattggcgtatatgaagtgcgtcctggtctcatcaaaaccgatatgactattccggcaacggcctattacgacgaactgattgccaaaggtctggtgccgtggggacgttggggttatccggcggatattgcttccactgtccgcgcgatggcggaaggtaaacttatttacacctgtggtcaggcggtcgccattgacggtggcttaagtatgccgcgcttctga

SEQ ID NO: 9702 - protein, 308 aa, Escherichia coli
MYFHQVIKCPVIAIAYQPTRWLIFLSSSRKLIITKETKFKKESYCMKSTRPVAVITGAARGIGKGCALELARGGFNLLINDRPDADSVEKLHATQQECLAEGVEVICFPADVGDLSLHEEMLDAAQNQWGRLDCLLNNAGISVKKRGDLLDLEPDSFDQNIAINTRAPFFLAQAFSKRLLAQPKPEAELPHRSIIFVSSINAIMLAMNRGEYTIAKTAVSAAARLFAARLCNEQIGVYEVRPGLIKTDMTIPATAYYDELIAKGLVPWGRWGYPADIASTVRAMAEGKLIYTCGQAVAIDGGLSMPRF

SEQ ID NO: 9703 - DNA, 639 bp, Escherichia coli
atgcccgggcgctttgaactaaaaccaaccctggagaaagtctggcacgcgccggacaattttcgcttcatggacccgctgccgccgatgcatcgtcgggggatcattattgccgccattgtattggtggtcggatttctgcttccatctgatgatacgcccaacgcgccggtggtgacgcgtgaagcacagttagatattcagtcgcaatcacaaccaccgacagaagaacagctgcgggcgcaattagtcacgccacaaaatgatcctgatcaggtggctccggtcgctccagaaccaatacaggaaggccaaccagaagagcagccgcaaaccacccatacgcaaccattccagccagatagcggaattgataatcaatggcgctcctatcgtgtcgaacccggtaaaacgatggcgcagctgttccgcgaccacggactgcccgctaccgatgtctatgccatggcgcaggtagaaggcgcggataagccactgagtaatttgcaaaacgggcagatggtgaaaatccgccagaacgccagcggcgtggtgacgggcttaaccattgatacggggaataatcaacaggtcctgtttacccgccagccggatggcagttttattcgcgcgcggtag

SEQ ID NO: 9704 - protein, 212 aa, Escherichia coli
MPGRFELKPTLEKVWHAPDNFRFMDPLPPMHRRGIIIAAIVLVVGFLLPSDDTPNAPVVTREAQLDIQSQSQPPTEEQLRAQLVTPQNDPDQVAPVAPEPIQEGQPEEQPQTTHTQPFQPDSGIDNQWRSYRVEPGKTMAQLFRDHGLPATDVYAMAQVEGADKPLSNLQNGQMVKIRQNASGVVTGLTIDTGNNQQVLFTRQPDGSFIRAR

SEQ ID NO: 9705 - DNA, 720 bp, Escherichia coli
ttgcccttttttctgaagctgaaatcaaatcaggttatgatagtcaccacgaagaggtcgtggggaagcgttatgtatcttgataccagcaacgtacagagcctgaaagaaaagctgctgttatgcgcggttaatgaatttgccgaatatggttacgaaggggccagagtcgataatatcgtcaaggccgcggggtgcagtaaacagacggtttatcaccactttggtaataaagaaaatttatttatcgaagtactggaatatacctggaacgatattcgacaaaaagaaaaggcccttgatttctcagatcttccgccacagaaagccattgagaaaataatcgattttacatgggattattatatttctaatccctggtttttaaaaattgtgcatagtgaaaatcaaagtaagggtgtgcattatgcaaaatcacagcgtcttttagaaattaaccatgcgcacttgcagttaatggaatccttattggatgaagggaagaaacaaaatatttttaagccagatatcgacccattgcaggtgaatattaatattgctgcgcttgggggatattatttgatcaaccagcatacgcttggcctggtttatcacatcagtatggtttcaccgcaggcactggaagccagacgtaaggtcatcaaagagacgatccttagctggcttttggttgacccttcatctaccgcgcgcgaataa

SEQ ID NO: 9706 - protein, 239 aa, Escherichia coli
MPFFLKLKSNQVMIVTTKRSWGSVMYLDTSNVQSLKEKLLLCAVNEFAEYGYEGARVDNIVKAAGCSKQTVYHHFGNKENLFIEVLEYTWNDIRQKEKALDFSDLPPQKAIEKIIDFTWDYYISNPWFLKIVHSENQSKGVHYAKSQRLLEINHAHLQLMESLLDEGKKQNIFKPDIDPLQVNINIAALGGYYLINQHTLGLVYHISMVSPQALEARRKVIKETILSWLLVDPSSTARE

SEQ ID NO: 9707 - DNA, 780 bp, Escherichia coli
atgatgtccgtggtaaacccgcctttattatattcatacgggatattgctattgtttctttttccccgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggcattgccgatgcgctggaaggcaaacatccggctgttccggttgatgtggtgcaccgcgcgctgcgtgaaatccacgaacgcgccgatgccgttcgtcgtcagcgtttccaggcgatggctgctgaaggtgtgaaatacctggaagaaaacgccaaaaaagaaggtgtaaatagcaccgaatctggcctgcaattccgcgtgatcaaccagggtgaaggcgcaattccggcacgtaccgaccgcgttcgtgttcattacaccggaaaactgatcgacggcaccgtgtttgacagctccgttgctcgcggcgagccagctgaattcccggttaatggtgtgatccctggctggattgaagcactgactctgatgccggtaggttctaaatgggaactgactatcccgcaggaactggcatatggcgagcgtggcgcaggcgcgtccatccctccgttcagcaccctggtgtttgaagtcgaactgctggaaatcctctaa

SEQ ID NO: 9708 - protein, 259 aa, Escherichia coli
MMSVVNPPLLYSYGILLLFLFPRDLSSFPRQSFTQRSVADMLPATLYPKKGNTMTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 9709 - DNA, 1413 bp, Escherichia coli
atggtagatcaggtaaaagtcgttgccgatgatcaggctccggctgaacagtcgctacggcgcaatctcacaaaccgacatattcagcttattgccattggcggtgccattggtacagggctgtttatggggtccggcaaaacgattagccttgccgggccgtcgatcattttcgtttatatgatcatcggttttatgctctttttcgtgatgcgggcaatgggggrattgctgctttcgaatctggaatacaaatcttttagtgacttcgcttccgatttactcgggccgtgggcaggatatttcaccggctggacttactggttctgctgggttgtaaccggtatggcagacgtggttgccattaccgcctatgcgcaattctggttccctgggctttctgactgggttgcttcgttatccgtgatcattctgttactggttctaaacctcgccacggtaaaaatgttcggtgagatggagttctggtttgcgatgatcaaaatcgtcgccatcgtgtcgctgattgttgtcggcctggtcatggtggcgatgcactttcagtcaccgaccggtgtggaagcatcatttgcacatttgtggaatgacggcggctggttcccgaaaggcttaagcggcttctttgccggattccagatagcggtttttgctttcgtggggattgagctggtaggtacaacagctgcggaaaccaaagatccggagaaatcactgccacgcgcgattaactccattccgatccgtatcattatgttctacgtcttctcgctgattgtgattatgtccgtgacgccgtggagttcggtagtcccggagaaaagcccgttcgttgaactgtttgtgttggtaggtttgcctgcggctgccagcgtgatcaactttgtggtgctgacctctgcggcgtcttccgctaacagcggtgtcttctctaccagccgtatgctgtttggcctggcccaggaaggtgtggcaccgaaagcgttcgctaaactctctaagcgcgcagtacccgcgaaagggctgaccttctcttgtatctgtctgctcggcggcgtggtgatgttgtatgtgaatcccagcgtgattggcgcgttcacgatgattacaaccgtttccgcgattctgtttatgtttgtctggacgattatcctttgctcgtacctggtgtatcgcaaacagcgtcctcatctgcatgagaagtcgatctacaagatgccactcggcaagctgatgtgctgggtatgtatggcgttctttgtgtttgttctggtgttgttgacactggaagatgacacccgccaggcgctgctggttaccccgctgtggtttatcgcgctggggctgggctggctgtttattggtaagaagcgggctgctgaactgcggaaataa

SEQ ID NO: 9710 - protein, 470 aa, Escherichia coli
  Xaa 76: Xaa is any amino acid
MVDQVKVVADDQAPAEQSLRRNLTNRHIQLIAIGGAIGTGLFMGSGKTISLAGPSIIFVYMIIGFMLFFVMRAMGXLLLSNLEYKSFSDFASDLLGPWAGYFTGWTYWFCWVVTGMADVVAITAYAQFWFPGLSDWVASLSVIILLLVLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFSLIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVLVLLTLEDDTRQALLVTPLWFIALGLGWLFIGKKRAAELRK

SEQ ID NO: 9711 - DNA, 663 bp, Escherichia coli
atggcttatcgcgaccaacctttaggtgaactggcgctctctattcctcgcgcttcggctctgtttcgtaaatatgatatggattactgctgtggcggtaagcagacgctggcgcgcgcggcggcacgtaaagaactggatgttgacgtcattgaagccgaactggcaaagcttgctgaacaaccgattgaaaaagactggcgtagcgcgccgctggcggaaatcatcgaccacattattgtgcgctatcacgatcgccatcgcgagcagctgccggagctgatcctgcaagcgactaaagtcgagcgcgttcacgccgacaaaccgagcgtgccaaaagggctgacaaaatacctgactatgctgcatgaagagctttccagccacatgatgaaagaagagcaaattctcttcccgatgattaaacaaggcatgggcagccaggcaatggggccaatcagcgtaatggaaagcgagcacgatgaagcgggcgaactgctggaagtgatcaaacacaccaccaataacgtcacaccgccgccggaagcctgcaccacctggaaagcgatgtataacggcattaatgaactgattgatgacctgatggagcacatcagtctggaaaacaatgtactattcccgcgcgcgctggcgggtgagtga

SEQ ID NO: 9712 - protein, 220 aa, Escherichia coli
MAYRDQPLGELALSIPRASALFRKYDMDYCCGGKQTLARAAARKELDVDVIEAELAKLAEQPIEKDWRSAPLAEIIDHIIVRYHDRHREQLPELILQATKVERVHADKPSVPKGLTKYLTMLHEELSSHMMKEEQILFPMIKQGMGSQAMGPISVMESEHDEAGELLEVIKHTTNNVTPPPEACTTWKAMYNGINELIDDLMEHISLENNVLFPRALAGE

SEQ ID NO: 9713 - DNA, 927 bp, Escherichia coli
atgtgggggcttatttttgtcgggccgttgatcgtaccggaatacccggcgatgttgcagtcgatggggcgttacctggcgctagggttaattgcgctgcccattgcctggctgggacgcgtgcgtctgcgtcagttggcacgtcgcgactggcttaccgccttgatgctcaccatgatgggcaaccttatctattacttctgccttgccagtgccattcaacgtactggcgcgcctgtttccacgatgattatcggcaccctgccggtggtgattcccgtttttgccaatctgctttatagccagcgcgacggcaaactcgcgtggggaaaactcgccccggcactggtttgtattggcatcggcctggcgtgtgtgaatattgctgagttaaaccacggactccccgattttgactgggcacgttatacctcaggcatcgtgctggcgttagtttccgtggtctgctgggcatggtatgccctgcgcaacgcccgctggctgcgggaaaatcccgacaaacatccgatgatgtgggcgacggcgcaggcgctggtcacgctgccggtttctctcatcggctatctcgtcgcctgttactggctgaatatgcaaacgccggacttctccttaccctttggcccccgtccgctggtgtttattagtctgatggttgcgatagccgtgctttgctcatggattggcgcactctgctggaacgtcgccagccagcgattaccgacagtgattctcgggccgctgattgttttcgaaacgctggcaggtttgctgtacacctttttactccgccagcaaatgccgccgctaatgacgctgagcggtatcgcgctgttagtgattggcgtggtcattgcggtcagagcaaaaccagaaaaacctttaactgaatctgtctcagaaagttga

SEQ ID NO: 9714 - protein, 308 aa, Escherichia coli
MWGLIFVGPLIVPEYPAMLQSMGRYLALGLIALPIAWLGRVRLRQLARRDWLTALMLTMMGNLIYYFCLASAIQRTGAPVSTMIIGTLPVVIPVFANLLYSQRDGKLAWGKLAPALVCIGIGLACVNIAELNHGLPDFDWARYTSGIVLALVSVVCWAWYALRNARWLRENPDKHPMMWATAQALVTLPVSLIGYLVACYWLNMQTPDFSLPFGPRPLVFISLMVAIAVLCSWIGALCWNVASQRLPTVILGPLIVFETLAGLLYTFLLRQQMPPLMTLSGIALLVIGVVIAVRAKPEKPLTESVSES

SEQ ID NO: 9715 - DNA, 861 bp, Escherichia coli
atgatcgctattactggtgccactggccaacttggtcactatgttattgaatccttgatgaaaacggttcctgccagccaaatagtggctatcgttcgtaatccggcaaaagcacaggtactgacagcacaaggcattaccgtgcgtcaggctgattacggcgatgaagccgcactgacatctgcgcttcagggagtggaaaaactactgctgatctcttccagcgaagtgggtcaacgtgccccgcagcatcgtaatgttattaatgccgcaaaggcggccgacgtgaaatttatcgcttataccagcctgctacatgccgattcctccccgctcggcctcgccgatgagcacatcgagacggagaaaatgctggctgattctggcatcgtttacactctgctgcgcaacggctggtacaccgaaaactacctcgccagcgccccggcagcactggaacacggcgtatttatcggtgccgcgggcgatggcaagattgcctcagcaacgcgggctgattatgcggtagctgcggcgcgcgtaattagcgaagccggtcatgaaggcaaggtttacgaactggcgggcgatagtgcctggacactgacacagttagcggcagaactcaccaaacagagcggcaaaccgattacctatcaaaacctgagcgaagccgatttcgctgcggcactgaaaagcgtcggactgcctgatggactggcggatatgctggcggattctgacgttggcgcatcgaaaggcggtctgtttgatgacagcaaaacgcttagcaaattgattggccgcccaacgacaacgttagccgaaagcgtaagccatctttttaatgttaataactag

SEQ ID NO: 9716 - protein, 286 aa, Escherichia coli
MIAITGATGQLGHYVIESLMKTVPASQIVAIVRNPAKAQVLTAQGITVRQADYGDEAALTSALQGVEKLLLISSSEVGQRAPQHRNVINAAKAADVKFIAYTSLLHADSSPLGLADEHIETEKMLADSGIVYTLLRNGWYTENYLASAPAALEHGVFIGAAGDGKIASATRADYAVAAARVISEAGHEGKVYELAGDSAWTLTQLAAELTKQSGKPITYQNLSEADFAAALKSVGLPDGLADMLADSDVGASKGGLFDDSKTLSKLIGRPTTTLAESVSHLFNVNN

SEQ ID NO: 9717 - DNA, 492 bp, Escherichia coli
gtggcaccagtaatagcgatcatgggaagtctccatcgttttgtcttgtgtttaaatacgctaacacttaaacttacttttagtaagtacgtacaaaaaggtaagtatgaaatgagtcaggttagcctgtcgcaacaactcaaagagggaaatctcttcgctgaacagtgtccgtcgcgcgaggttttgaaacacgtcaccagccgttggggggtgttgattctggtggcgctacgcgaaggtactcatcgctttagcgacctgcggcgcaaaatcggcggggtgagtgaaaagatgcttgcgcagtcgttacaggcgctagagcaggatggttttcttaaccgtatcgcgtatccggtggtgccgccgcatgtggaatatagcctcacgccgctgggcgagcaggtgagcgaaaaggttgctgcactggcggactggattgagttgaatttgcccgaggtgttagcggtgcgggatgaacgtgcggcataa

SEQ ID NO: 9718 - protein, 163 aa, Escherichia coli
MAPVIAIMGSLHRFVLCLNTLTLKLTFSKYVQKGKYEMSQVSLSQQLKEGNLFAEQCPSREVLKHVTSRWGVLILVALREGTHRFSDLRRKIGGVSEKMLAQSLQALEQDGFLNRIAYPVVPPHVEYSLTPLGEQVSEKVAALADWIELNLPEVLAVRDERAA

SEQ ID NO: 9719 - DNA, 1944 bp, Escherichia coli
atgattaagtttagcgcaacgctcctggccacgctgattgccgccagtgtgaatgcagcgacggtcgatctgcgtatcatggaaaccactgatctgcatagcaacatgatggatttcgattattacaaagacaccgccacggaaaaattcggactggtacgtacggcaagcctgattaacgatgcccgcaatgaagtgaaaaacagcgtactggtcgataacggcgatttgattcaggggagtccgctggcagattacatgtcggcgaaaggattaaaagcaggtgatattcacccggtctataaggcattaaatacgctggactataccgtcggcacgcttggcaaccacgagtttaactacggtctggattatctgaaaaatgcgctggcgggagcgaaattcccttatgtaaatgccaacgtcattgacgccagaaccaaacagccaatgtttacaccgtatttaattaaagacaccgaagtggtcgataaagacggaaaaaaacagacgctgaagattggttatattggcgtcgtcccgccacaaatcatgggctgggataaagctaatttatccgggaaagtgacggtgaatgatattaccgaaaccgtgcgcaaatacgtgcctgaaatgcgcgagaaaggtgccgatgtcgttgtcgttctggcgcattccgggctgtctgccgatccgtataaagtgatggcggaaaactcagtttattacctcagtgaaattccgggcgttaacgccattatgtttggccatgctcacgccgttttcccaggtaaagattttgctgatatcgaaggggctgatatcgcgaaaggcacgctgaatggtgttccggcggtaatgccaggcatgtggggcgatcatcttggtgtggtcgacttacaactcagtaatgacagcggtaaatggcaggtgacgcaggcgaaagcggaagcacggccgatttacgacatcgcgaataaaaaatccctcgcggcggaagacagcaagctggtagaaacactcaaagccgatcacgatgccacacgccagttcgtcagcaagccaatcggtaaatctgccgacaatatgtatagctatctggcgcttgtgcaggacgatccgaccgtgcaggtggtgaacaacgcgcaaaaagcgtatgtcgagcattacattcagggcgatccggatctggcaaaactgccagtgctttcagctgccgcaccgtttaaagttggtggtcgcaaaaatgaccccgcaagctatgtggaggtggaaaaaggccagttgaccttccgtaatgccgccgatctttatctctaccccaatacgctgattgtggtgaaagccagcggtaaagaggtgaaagagtggctggagtgctccgccggacagtttaaccagattgatcctaacagcacgaaaccacagtcactcatcaactgggatggtttccgcacctataactttgatgttattgatggtgtgaattatcagattgatgttacccagcccgcccgttatgacggcgagtgccagatgattaatgccaatgcggaaaggattaagaacctgacctttaacggcaagccgattgatccgaacgccatgttcctcgttgccaccaataactatcgcgcttacggcggcaaatttgccggtacgggcgacagccatatcgcttttgcttcaccggatgagaaccgctcggtgctggcagcgtggattgctgatgagtcgaaacgtgcgggggaaattcacccggcggcagataacaactggcgtttagcaccgatagctggcgataagaaactggatatccgtttcgaaacctctccgtcagataaagccgcagcgtttattaaagagaaagggcagtatccgatgaataaagtcgcgaccgatgatatcgggtttgcgatttatcaggtggatctgagtaagtaa

SEQ ID NO: 9720 - protein, 647 aa, Escherichia coli
MIKFSATLLATLIAASVNAATVDLRIMETTDLHSNMMDFDYYKDTATEKFGLVRTASLINDARNEVKNSVLVDNGDLIQGSPLADYMSAKGLKAGDIHPVYKALNTLDYTVGTLGNHEFNYGLDYLKNALAGAKFPYVNANVIDARTKQPMFTPYLIKDTEVVDKDGKKQTLKIGYIGVVPPQIMGWDKANLSGKVTVNDITETVRKYVPEMREKGADVVVVLAHSGLSADPYKVMAENSVYYLSEIPGVNAIMFGHAHAVFPGKDFADIEGADIAKGTLNGVPAVMPGMWGDHLGVVDLQLSNDSGKWQVTQAKAEARPIYDIANKKSLAAEDSKLVETLKADHDATRQFVSKPIGKSADNMYSYLALVQDDPTVQVVNNAQKAYVEHYIQGDPDLAKLPVLSAAAPFKVGGRKNDPASYVEVEKGQLTFRNAADLYLYPNTLIVVKASGKEVKEWLECSAGQFNQIDPNSTKPQSLINWDGFRTYNFDVIDGVNYQIDVTQPARYDGECQMINANAERIKNLTFNGKPIDPNAMFLVATNNYRAYGGKFAGTGDSHIAFASPDENRSVLAAWIADESKRAGEIHPAADNNWRLAPIAGDKKLDIRFETSPSDKAAAFIKEKGQYPMNKVATDDIGFAIYQVDLSK

SEQ ID NO: 9721 - DNA, 558 bp, Escherichia coli
atgaccctacgcaagattctggcactcacctgcctgctgttgccgatgatggcttccgcacatcagttcgaaaccggtcagcgagtgccgccgattggcatcaccgatcgtggcgagttggtgcttgataaagatcagtttagctacaaaacctggaacagcgcgcagttagtgggaaaagtgcgagtactgcaacatattgctggtcgcacctctgcaaaagagaaaaacgcgacgctgattgaagcgattaaatcagcgaagttaccgcacgatcgttaccagaccaccaccattgttaacaccgacgacgcgattccgggttcagggatgtttgtgcgcagcagtctggagagtaataaaaagctttatccctggtcgcagtttattgttgatagcaatggcgtcgcacgcggtgcctggcagctggatgaaaaaagttccgctgtagtggtgctggataaagacggtcgcgtgcaatgggccaaagacggggcgcttactcaggaagaggtgcagcaagtgatggacctgctgcataaattaattaataaatag

SEQ ID NO: 9722 - protein, 185 aa, Escherichia coli
MTLRKILALTCLLLPMMASAHQFETGQRVPPIGITDRGELVLDKDQFSYKTWNSAQLVGKVRVLQHIAGRTSAKEKNATLIEAIKSAKLPHDRYQTTTIVNTDDAIPGSGMFVRSSLESNKKLYPWSQFIVDSNGVARGAWQLDEKSSAVVVLDKDGRVQWAKDGALTQEEVQQVMDLLHKLINK

SEQ ID NO: 9723 - DNA, 693 bp, Escherichia coli
atgcaggtctacgacgggacgaaaccgatggacgtcgtcagcaaagcggacaattctccggtaacggcagcggatattgccgctcacaccgttatcatggacggtttacgtacgctgacaccggatattccggtcctttctgaagaagatcctcccggttgggaagtccgtcagcactggcagcgttactggctggtagacccgctggatggtactaaagagtttattaaacgtaatggcgaattcaccgttaacattgcgctcatcgaccacggcaaaccgattttaggtgtggtgtatgcgccggtaatgaacgtaatgtacagcgcggcagaaggcaaagcctggaaagaagagtgcggtgtgcgcaagcagattcaggtccgcgatgcgcgcccgccgctggtggtgatcagccgttcccatgcagatgcggagctgaaagagtatctgcaacagcttggcgaacatcagaccacgtccatcggctcttcgctgaaattctgcctggtggcggaaggacaggcgcagctgtacccgcgtttcgggccaacgaatatttgggataccgccgctggtcatgctgtggctgcagctgccggagcgcacgttcacgactggcagggtaaaccgctggattacactccgcgcgagtcgttcctgaatccggggttcagagtgtctatttattaa

SEQ ID NO: 9724 - protein, 230 aa, Escherichia coli
MQVYDGTKPMDVVSKADNSPVTAADIAAHTVIMDGLRTLTPDIPVLSEEDPPGWEVRQHWQRYWLVDPLDGTKEFIKRNGEFTVNIALIDHGKPILGVVYAPVMNVMYSAAEGKAWKEECGVRKQIQVRDARPPLVVISRSHADAELKEYLQQLGEHQTTSIGSSLKFCLVAEGQAQLYPRFGPTNIWDTAAGHAVAAAAGAHVHDWQGKPLDYTPRESFLNPGFRVSIY

SEQ ID NO: 9725 - DNA, 207 bp, Escherichia coli
atgaaaattttccaacggtacaacccacttcaggtggcgaagtacgtaaagatcctgttccgtggacggttatacatcaaggacgttggcgcttttgaatttgataagggtaagattcttatcccaaaagtgaaggataagctgcatttgtcagtgatgtccgaagttaaccgtcaggttatgcgtctgcaaacagagatggcttaa

SEQ ID NO: 9726 - protein, 68 aa, Escherichia coli
MKIFQRYNPLQVAKYVKILFRGRLYIKDVGAFEFDKGKILIPKVKDKLHLSVMSEVNRQVMRLQTEMA

SEQ ID NO: 9727 - DNA, 1344 bp, Escherichia coli
atgttaaacagtattttagtcatactctgtttgatcgctgtaagtgcgttcttctcgatgtccgagatctcgcttgccgcctcacgcaaaatcaaacttaaactgctggctgatgaaggcaatataaatgcccaacgcgttttgaatatgcaggaaaatcccggcatgttctttaccgtggtccagatcggtctgaacgcagtggcgattctcggcggtatcgtcggtgatgcggcattttctccagcttttcacagcctgttctcccgctatatgtcggcagaactctctgagcaactgagctttattctctctttctcgttagtgactggcatgtttatcctgtttgcggatttaaccccgaaacgcatcggtatgattgcgccagaagctgtggctttgcgtatcatcaacccgatgcgcttctgcctgtacgtttgcaccccgctggtgtggttcttcaacggactggcgaacataatcttccgtattttcaaactgccaatggtacgtaaagatgacatcacttctgatgatatctacgcggtagtggaagccggtgcgctggcgggcgtgttacgtaaacaggaacacgagctgattgaaaacgtctttgagctggaatcccgtaccgttccgtcttcaatgacaccgcgtgaaaacgtgatttggtttgatctccacgaagatgagcaaagtctgaagaataaggttgcggaacatccgcactctaagtttctcgtctgtaatgaagatattgaccacatcatcggctatgtcgattctaaagacctgctgaaccgcgtgctggctaaccaaagcctggcactgaacagcggcgtacaaattcgcaacacgctgattgtgccggatacgttaaccctttcagaggcgttggaaagttttaaaaccgcaggtgaagacttcgcggtgatcatgaacgagtacgcgctggtagtggggatcatcaccctcaacgacgtgatgaccacactgatgggcgatctggtcggccaggggctggaagagcaaattgtcgcccgtgatgagaactcatggctgatagacggcggcacgcctattgacgacgtcatgcgcgtgctggatattgacgagttcccgcagtcgggcaactacgaaaccatcggcggctttatgatgtttatgctgcgtaagatcccgaaacgcaccgattcggtgaaattcgccggctacaaatttgaagtggtggatatcgataactaccgcatcgaccagctgctggtgacccgaatcgacagcaaagccaccgccctttcgccaaaactgcctgacgctaaagataaagaagaaagcgtcgcataa

SEQ ID NO: 9728 - protein, 447 aa, Escherichia coli
MLNSILVILCLIAVSAFFSMSEISLAASRKIKLKLLADEGNINAQRVLNMQENPGMFFTVVQIGLNAVAILGGIVGDAAFSPAFHSLFSRYMSAELSEQLSFILSFSLVTGMFILFADLTPKRIGMIAPEAVALRIINPMRFCLYVCTPLVWFFNGLANIIFRIFKLPMVRKDDITSDDIYAVVEAGALAGVLRKQEHELIENVFELESRTVPSSMTPRENVIWFDLHEDEQSLKNKVAEHPHSKFLVCNEDIDHIIGYVDSKDLLNRVLANQSLALNSGVQIRNTLIVPDTLTLSEALESFKTAGEDFAVIMNEYALVVGIITLNDVMTTLMGDLVGQGLEEQIVARDENSWLIDGGTPIDDVMRVLDIDEFPQSGNYETIGGFMMFMLRKIPKRTDSVKFAGYKFEVVDIDNYRIDQLLVTRIDSKATALSPKLPDAKDKEESVA

SEQ ID NO: 9729 - DNA, 639 bp, Escherichia coli
atgagtttatttgataaaaagcatctggtttcccccgccgatgccctgcctggacgtaacaccccgatgcccgtagccacactgcatgcggtcaacggccactcaatgaccaatgtacctgacggaatggagattgccatttttgcgatgggttgtttctggggtgtggagcgtctgttctggcagttacccggcgtttacagcaccgccgcaggctataccggcggctatacgccaaatccgacttatcgggaagtgtgctccggcgatactggccatgccgaagcggtgcgcattgtttacgatccatccgtcatcagctatgagcagttgctacaagtattttgggagaatcacgatcccgcccagggaatgcgtcagggcaatgaccacggcacgcagtatcgttcagcgatttatccgctgaccccagaacaggatgccgccgctcgcgccagtctggaacgttttcaggcggcgatgcttgccgccgatgacgatcgtcgcatcaccacggaaatcgctaacgccacaccgttttattatgccgaagatgaccaccagcaatatctgcataaaaacccgtatggttactgtggaattggcggaattggcgtctgtctgccgccggaagcatag

SEQ ID NO: 9730 - protein, 212 aa, Escherichia coli
MSLFDKKHLVSPADALPGRNTPMPVATLHAVNGHSMTNVPDGMEIAIFAMGCFWGVERLFWQLPGVYSTAAGYTGGYTPNPTYREVCSGDTGHAEAVRIVYDPSVISYEQLLQVFWENHDPAQGMRQGNDHGTQYRSAIYPLTPEQDAAARASLERFQAAMLAADDDRRITTEIANATPFYYAEDDHQQYLHKNPYGYCGIGGIGVCLPPEA

SEQ ID NO: 9731 - DNA, 1734 bp, Escherichia coli
gtgcgctatatccgacagttatgctgtgtaagcttactctgcttaagcggatctgccgtcgccgcgaacgtccgtctacaggtcgaggggttatcgggacagctggaaaagaacgttcgcgcgcagctttctacgattgaaagtgatgaagtgacgccagaccgtcgctttcgcgcacgcgtcgatgatgccatccgcgaaggtctgaaagcgctgggctattaccagccgaccattgaatttgatctccgtccaccgccaaagaaagggcggcaggtattgatcgccaaagtcacgccaggcgtgccggtgttaattggcggcaccgatgtggtattgcgcggcggcgcgcggaccgataaagactatttgaaattgctcgatactcgcccggctattggtacggtactgaaccagggcgattatgaaaatttcaaaaagtccttaaccagcattgcgttgcgtaaaggttatttcgatagcgaatttaccaaagcgcagctgggcattgcgctcggcctgcataaagccttctgggatattgattataacagtggcgaacgttaccgctttgggcatgtgacctttgaaggatcacaaatccgcgatgaatacctgcaaaatctggtgccgtttaaagagggcgatgagtacgaatcgaaagatctggcagaactgaaccgtcgactttctgctaccggctggtttaactcggtggtggtggctccacaatttgataaagcgcgcgaaacgaaagtattaccattgacgggcgtggtttcgccgcgaacagaaaacaccatcgaaaccggcgtcggttactctacggacgtgggaccgcgcgtgaaagcgacgtggaaaaagccgtggatgaactcttacggtcacagtttgaccaccagtaccagtatttccgcgccggaacagatcctcgacttcagctataaaatgccgctgctgaagaatccgctggaacaatattatttggtgcagggcggttttaagcgcactgacctgaacgataccgagtctgactccactacgctggtggcttctcgctactgggatctctccagcggctggcagcgtgccattaacctgcgctggagtttcgaccactttacccagggtgaaattaccaacaccacgatgctgttttatcctggggtgatgattagccgcacgcgttctcgtggtggcctgatgccaacctggggcgactcgcaacgctactctatcgactactccaacacggcctggggctcggatgttgatttctccgttttccaggcgcagaacgtctggatccgcacactgtacgatcgccatcgttttgtgacacgcggcacgctgggctggattgaaaccggtgatttcgacaaagtaccgccggatctgcgtttcttcgccgggggcgatcgcagtattcgcggctacaaatacaaatctatcgccccgaaatacgccaacggtgacctgaaaggggcctcgaagctgataaccggatcgctggaataccagtacaacgtgaccggaaaatggtggggcgcggtgtttgtcgatagcggcgaagcggtaagcgatattcgccgcagcgactttaaaaccggtaccggtgtcggcgtgcgctgggaatcgccggtcgggccaatcaaactcgattttgccgtgccggtcgcggataaagacgaacacgggttacagttttacatcggtctggggccagaattatga

SEQ ID NO: 9732 - protein, 577 aa, Escherichia coli
MRYIRQLCCVSLLCLSGSAVAANVRLQVEGLSGQLEKNVRAQLSTIESDEVTPDRRFRARVDDAIREGLKALGYYQPTIEFDLRPPPKKGRQVLIAKVTPGVPVLIGGTDVVLRGGARTDKDYLKLLDTRPAIGTVLNQGDYENFKKSLTSIALRKGYFDSEFTKAQLGIALGLHKAFWDIDYNSGERYRFGHVTFEGSQIRDEYLQNLVPFKEGDEYESKDLAELNRRLSATGWFNSVVVAPQFDKARETKVLPLTGVVSPRTENTIETGVGYSTDVGPRVKATWKKPWMNSYGHSLTTSTSISAPEQILDFSYKMPLLKNPLEQYYLVQGGFKRTDLNDTESDSTTLVASRYWDLSSGWQRAINLRWSFDHFTQGEITNTTMLFYPGVMISRTRSRGGLMPTWGDSQRYSIDYSNTAWGSDVDFSVFQAQNVWIRTLYDRHRFVTRGTLGWIETGDFDKVPPDLRFFAGGDRSIRGYKYKSIAPKYANGDLKGASKLITGSLEYQYNVTGKWWGAVFVDSGEAVSDIRRSDFKTGTGVGVRWESPVGPIKLDFAVPVADKDEHGLQFYIGLGPEL

SEQ ID NO: 9733 - DNA, 3780 bp, Escherichia coli
atgagtttatggaaaaaaatcagcctcggcgtggttatcgttatcttactgttgctgggatcggtggcgtttctggtgggcaccaccagcggcctgcatctggtatttaaagcggcggatcgctgggtgccaggactggatattggcaaggtcaccggcggctggcgcgatctcaccttgtctgacgttcgttatgagcagccaggcgtggcggtaaaagcgggcaatctgcatctggcggtcgggcttgagtgcctgtggaacagtagcgtttgtattaatgatctggcgctgaaagacattcaggtcaacatcgacagtaaaaaaatgcctccttctgaacaggttgaagaagaggaagatagcggtccgctggatctctccacgccgtatcccattaccctgacacgggtggcgctggacaacgtcaacatcaagattgatgacaccacggtatcggtgatggacttcacctccggcctcaactggcaggagaaaaccctgaccctgaaaccgacatcgctgaaaggcctgttgattgctttgccgaaagtggcggaagcggcgcaggaagaagtggtcgaaccgaaaattgaaaatccacagccggaggaaaagccgctcggcgaaacgctgaaagatctcttttctcgcccggtattgccggaaatgaccgacgtgcatttgccgcttaacctgaacattgaagagtttaagggcgagcagctgcgcgtgacgggcgacacggacatcaccgtgagcaccatgctgctgaaagtgagcagcattgacggcaatactaaactggacgccctggatatcgactccagtcaagggatcgtcaacgccagcggcacggcgcagctgtcagacaactggccggtggatatcaccctcaacagcacactgaacgtggagccgttgaaaggtgaaaaggtgaagctgaaagtgggcggtgcgctgcgcgaacagctggagataggcgttaacctttccggtccggtggatatggatttacgcgcccagacgcgactggcggaagccggattgccgctcaacgtggaagtgaacagcaaacagctttactggccgttcactggtgagaagcagtatcaggcggatgatctgaaactgaaacttaccggcaaaatgaccgattacacgctctctatgcgcacggctgttaagggccaggagatcccgccagccaccattacccttgatgccaaaggtaatgaacagcaggtcaatctcgacaaacttaccgtcgcggcgctggaagggaaaacggaacttaaggcgttgctcgactggcagcaggccattagttggcgcggtgagctaacgcttaacggcattaacaccgccaaagagatcccggagtggccgtcgaaactcaatggcttgattaaaacccgcggtagcctgtacggcggcacctggcagatggaggtgccagaactgaagctgaccggtaacgtcaaacagaacaaagtgaacgttgacggcacgctgaaaggcaacagttatatgcagtggatgatcccagggctgcatctggaactggggccaaacagtgccgaagtgaaaggcgagctgggggtaaaagatctcaatcttgatgccaccatcaacgcgccggggctggataacgcgctgccggggcttggcggtacagcgaaagggctggtgaaagtacgcggcacggtggaagcgccacaactactggcagatatcaccgcgcgcggcctgcgctggcaggaactttccgtggcgcaggttcgcgtggaaggcgacattaaatccaccgatcagatcgccgggaaactcgacgtacgcgttgagcaaatttcgcaaccggatgtaaatatcaacctcgtcaccctgaatgccaaaggcagtgaaaagcagcacgagctacagttgcggattcagggcgagcctgtctccgggcagcttaatctggcaggaagttttgatcgcaaagaagaacgctggaagggaactcttagcaatacccgcttccagacgccggtcggcccgtggtcgctgacccgcgatattgcgctggattaccgcaataaggagcaaaaaatcagcatcgggccacactgctggcttaacccgaatgcggaactgtgcgtgccgcaaactatcgatgcgggtgccgaagggcgtgtggtggtgaatctcaaccgcttcgacctggccatgctgaaaccatttatgccagaaaccactcaggccagcggtatcttcacgggtaaagcggacgttgcctgggacaccacgaaagaggggctgccgcagggcagtatcaccctttcggggcgtaatgtgcaggtgacgcaaaccgtcaacgatgcggcgctgcccgtggcgtttcagacgctgaatctgacggcggagttgcgtaacaaccgtgccgaattgggctggaccatccgcctgaccaataacggccagtttgatggtcaggtgcaggtgaccgatccgcaaggccgccgtaatcttggtggcaacgtcaatatccgtaacttcaaccttgcgatgataaaccccatctttacccgtggggaaaaagccgcggggatggtgagtgccaacttgcgtctgggtggtgatgtgcaaagcccgcagttgtttggtcagcttcaggttacgggggtggatatcgacggcaactttatgccgtttgatatgcaaccgagccagcttgcggtcaactttaacggtatgcgctcgacgcttgcaggtaccgtgcggacccagcagggtgaaatctacctgaacggtgatgccgactggagccagattgaaaactggcgggcgcgggtaacagcgaagggcagtaaagtgcgtatcaccgtgccgccgatggtacgaatggatgtatcgccagatgttgtattcgaggctacaccaaacctgtttaccctcgatggtcgcgtggatgttccgtgggcgcgcatcgtggtgcacgatctgccggaaagcgcagtaggcgtttccagcgatgtggtgatgcttaacgataacctgcaaccggaagagccgaaaacggcgtcgattccgattaacagtaacctgactgtccacgttggcaacaatgtgcgcattgacgcctttggcctgaaagcgcggctgacgggcgatctcaacgtcgttcaggacaaacaagggctgggcctgaacgggcagatcaacatccctgaagggcgcttccatgcctatggtcaggatctgattgtgcgtgagggtgagctactgttctctggtccgccagatcaaccgtatcttaatatcgaagctattcgtaacccggatgctacagaagacgacgtcatcgccggagttcgcgtcactggtctggcggacgaaccgaaagcggagatcttctctgacccggcgatgtcgcaacaagctgcattgtcttatttgctacgtggacaagggctggagagtgatcagagtgacagtgcggcgatgacctcgatgctgattggcctgggggttgcgcaaagtggccagattgtgggtaaaatcggcgagacgtttggcgtaagcaatttagcgctcgacaccgagggagttggcgactcctcccaggtggtggtcagcggctatgtattgccaggtctgcaagtgaaatacggcgtgggtatatttgactctatagcaacactcacgttacgttatcgcctgatgcctaagctatatctggaagcagtgtctggtgtagaccaggcactggatttgctctatcagttcgagttttag

SEQ ID NO: 9734 - protein, 1259 aa, Escherichia coli
MSLWKKISLGVVIVILLLLGSVAFLVGTTSGLHLVFKAADRWVPGLDIGKVTGGWRDLTLSDVRYEQPGVAVKAGNLHLAVGLECLWNSSVCINDLALKDIQVNIDSKKMPPSEQVEEEEDSGPLDLSTPYPITLTRVALDNVNIKIDDTTVSVMDFTSGLNWQEKTLTLKPTSLKGLLIALPKVAEAAQEEVVEPKIENPQPEEKPLGETLKDLFSRPVLPEMTDVHLPLNLNIEEFKGEQLRVTGDTDITVSTMLLKVSSIDGNTKLDALDIDSSQGIVNASGTAQLSDNWPVDITLNSTLNVEPLKGEKVKLKVGGALREQLEIGVNLSGPVDMDLRAQTRLAEAGLPLNVEVNSKQLYWPFTGEKQYQADDLKLKLTGKMTDYTLSMRTAVKGQEIPPATITLDAKGNEQQVNLDKLTVAALEGKTELKALLDWQQAISWRGELTLNGINTAKEIPEWPSKLNGLIKTRGSLYGGTWQMEVPELKLTGNVKQNKVNVDGTLKGNSYMQWMIPGLHLELGPNSAEVKGELGVKDLNLDATINAPGLDNALPGLGGTAKGLVKVRGTVEAPQLLADITARGLRWQELSVAQVRVEGDIKSTDQIAGKLDVRVEQISQPDVNINLVTLNAKGSEKQHELQLRIQGEPVSGQLNLAGSFDRKEERWKGTLSNTRFQTPVGPWSLTRDIALDYRNKEQKISIGPHCWLNPNAELCVPQTIDAGAEGRVVVNLNRFDLAMLKPFMPETTQASGIFTGKADVAWDTTKEGLPQGSITLSGRNVQVTQTVNDAALPVAFQTLNLTAELRNNRAELGWTIRLTNNGQFDGQVQVTDPQGRRNLGGNVNIRNFNLAMINPIFTRGEKAAGMVSANLRLGGDVQSPQLFGQLQVTGVDIDGNFMPFDMQPSQLAVNFNGMRSTLAGTVRTQQGEIYLNGDADWSQIENWRARVTAKGSKVRITVPPMVRMDVSPDVVFEATPNLFTLDGRVDVPWARIVVHDLPESAVGVSSDVVMLNDNLQPEEPKTASIPINSNLTVHVGNNVRIDAFGLKARLTGDLNVVQDKQGLGLNGQINIPEGRFHAYGQDLIVREGELLFSGPPDQPYLNIEAIRNPDATEDDVIAGVRVTGLADEPKAEIFSDPAMSQQAALSYLLRGQGLESDQSDSAAMTSMLIGLGVAQSGQIVGKIGETFGVSNLALDTEGVGDSSQVVVSGYVLPGLQVKYGVGIFDSIATLTLRYRLMPKLYLEAVSGVDQALDLLYQFEF

SEQ ID NO: 9735 - DNA, 342 bp, Escherichia coli
atgcgaatatttgtctacggcagtttacgccacaaacaaggcaacagtcactggatgaccaatgcccagttactgggcgatttcagtatcgataactaccagttgtatagcctgggccactatccaggcgcagttccggggaacggaacagtacacggtgaagtttatcgtattgataacgccacgctggccgaacttgatgccttgcgcaccaggggcggtgaatacgcgcgccagttgattcagacgccgtacgggagtgcatggatgtacgtttatcaacgacccgtcgatggattaaagctaattgaaagcggcgactggttagacagggataagtaa

SEQ ID NO: 9736 - protein, 113 aa, Escherichia coli
MRIFVYGSLRHKQGNSHWMTNAQLLGDFSIDNYQLYSLGHYPGAVPGNGTVHGEVYRIDNATLAELDALRTRGGEYARQLIQTPYGSAWMYVYQRPVDGLKLIESGDWLDRDK

SEQ ID NO: 9737 - DNA, 531 bp, Escherichia coli
atgagcttactcaacgtccctgcgggtaaagatctgccggaagacatctacgttgttattgagatcccggctaacgcagatccgatcaaatacgaaatcgacaaagagagcggcgcactgttcgttgaccgcttcatgtccaccgcgatgttctatccgtgcaactacggttacatcaaccacactctgtctctggacggtgacccggttgacgtactggtcccgactccgtacccgctgcagccgggttctgtgatccgctgccgtccggttggcgtactgaaaatgaccgacgaagccggtgaagatgcgaaactgattgctgttccgcacaccaagctgagcaaagaatacgatcacattaaagacgttaacgatctgccagagctgctgaaagcgcaaatcgctcacttcttcgagcactacaaagacctcgaaaaaggcaagtgggttaaagttgaaggttgggaaaacgcagaagccgctaaagctgaaatcgttgcttccttcgagcgcgccaagaataaataa

SEQ ID NO: 9738 - protein, 176 aa, Escherichia coli
MSLLNVPAGKDLPEDIYVVIEIPANADPIKYEIDKESGALFVDRFMSTAMFYPCNYGYINHTLSLDGDPVDVLVPTPYPLQPGSVIRCRPVGVLKMTDEAGEDAKLIAVPHTKLSKEYDHIKDVNDLPELLKAQIAHFFEHYKDLEKGKWVKVEGWENAEAAKAEIVASFERAKNK

SEQ ID NO: 9739 - DNA, 957 bp, Escherichia coli
atgtggaaacgcttacttgtagtctctgcagtctcggcagccatgtcgtctatggcgttggccgctccattaacagtaggattttcgcaggtcggatcggaatccggctggcgcgccgcagaaaccaatgtggcgaaaagtgaagccgaaaaacgcggtatcacactgaaaattgccgatggtcagcaaaagcaggaaaaccagattaaagcggtacgttccttcgtcgcacaaggggtggatgcgatctttatcgctccggtggtggcgacgggttgggaaccggtattaaaagaggcgaaagatgccgaaatcccggtcttcttgcttgaccgttccatcgatgtgaaagacaaatctctctatatgaccaccgttactgccgacaacatcctcgaaggcaagttgattggtgactggctggtaaaagaggtcaatggcaaaccgtgtaacgtggttgagttgcagggcaccgttggggccagcgtcgccattgaccgtaagaaagcctttgccgaagccattaagaatgcgccaaatatcaaaattatccgctcgcagtcaggtgacttcacccgcagcaaaggcaaagaagtgatggagagctttatcaaagcggaaaacaacggcaaaaacatctgcatggtttacgcccataacgatgacatggtgattggtgcaattcaggcaattaaagaagcgggcctgaaaccgggcaaagatatcctgacaggctctatcgacggcgtgccggacatctacaaagcgatgattgatggcgaagcgaacgccagcgttgaactgacgccgaacatggcaggtcctgctttcgatgcgctggagaaatacaaaaaagacggcaccatgcctgaaaagctgacgttaaccaaatccaccctttatctgcctgataccgcaaaagaagagttagagaagaagaaaaatatggggtattga

SEQ ID NO: 9740 - protein, 318 aa, Escherichia coli
MWKRLLVVSAVSAAMSSMALAAPLTVGFSQVGSESGWRAAETNVAKSEAEKRGITLKIADGQQKQENQIKAVRSFVAQGVDAIFIAPVVATGWEPVLKEAKDAEIPVFLLDRSIDVKDKSLYMTTVTADNILEGKLIGDWLVKEVNGKPCNVVELQGTVGASVAIDRKKAFAEAIKNAPNIKIIRSQSGDFTRSKGKEVMESFIKAENNGKNICMVYAHNDDMVIGAIQAIKEAGLKPGKDILTGSIDGVPDIYKAMIDGEANASVELTPNMAGPAFDALEKYKKDGTMPEKLTLTKSTLYLPDTAKEELEKKKNMGY

SEQ ID NO: 9741 - DNA, 1503 bp, Escherichia coli
atgacgaccgaccaacaccaggaaatcctccgcaccgaaggattaagtaaatttttccccggtgtcaaagcgttagacaacgttgatttcagcctgcgccgtggcgaaatcatggcgctgctcggtgaaaacggggcgggaaaatcgacgctaatcaaagcattaaccggtgtataccacgtcgatcgcggcactatctggctggaaggccaggctatctcaccgaaaaacaccgcccacgcacaacaactcggcatcggcaccgtctatcaggaagtcaacctgctacccaatatgtcggtcgctgataatctattcataggtcgcgaacccaaacgtttcggccttctacgccgtaaagagatggaaaagcgcgccaccgaactgatggcatcttacggtttctccctcgacgtgcgcgaaccgctcaaccgcttttcagtcgcgatgcagcaaatcgtcgccatttgccgggctatcgatctctccgccaaagtgctgatcctcgatgaacccaccgccagtctcgacactcaggaagtagagttactgtttggcctgatgcgtcagcttcgcgatcgcggcgtcagcctgatcttcgtcactcattttctcgatcaggtttatcaggttagcgatcggatcaccgtcttacgtaacggcagttttgtgggctgtcgggaaacccgcgagctaccgcagatcgaactggtaaaaatgatgccggggcgtgaactggacacccacgcgcttcagcgtgccgggagaacattgctgagcgacaaacctgttgccgcgttcaaaaattacggcaaaaaaggaacgatcgcgccgtttgatctcgaagtacgccccggcgagatcgtcggtctggcaggcttgctgggatcaggacgtaccgaaaccgccgaagtgatcttcggtatcaaacctgctgatagcggcacggcgttgatcaaaggcaaactgcaaacgctacgctcgccacatcaggcttcggttcttggcattggcttctgcccggaagacaggaaaaccgatggcatcatcgctgccgcctcggtgcgggaaaatatcatccttgctctccaggcccagcgcggctggttacgacctatttcccgcaaagagcagcaagagattgccgaacgctttatccgccagcttggcattcgcacaccttccaccgaacaaccgattgaatttctctccggcggcaatcagcaaaaagtgttgctttcacgttggctactgacccgaccgcaatttctgattctcgacgagccaacgcgcggaattgatgttggtgcccacgccgagatcatccgcctgattgaaacgctgtgcgccgatgggctggcgctgctggtgatctcctccgagctggaagagctggtgggctatgccgaccgggtgattatcatgcgcgatcgcaaacaggtagcggagatcccgctggcagagctttccgttccggcgatcatgaacgccattgcggcgtaa

SEQ ID NO: 9742 - protein, 500 aa, Escherichia coli
MTTDQHQEILRTEGLSKFFPGVKALDNVDFSLRRGEIMALLGENGAGKSTLIKALTGVYHVDRGTIWLEGQAISPKNTAHAQQLGIGTVYQEVNLLPNMSVADNLFIGREPKRFGLLRRKEMEKRATELMASYGFSLDVREPLNRFSVAMQQIVAICRAIDLSAKVLILDEPTASLDTQEVELLFGLMRQLRDRGVSLIFVTHFLDQVYQVSDRITVLRNGSFVGCRETRELPQIELVKMMPGRELDTHALQRAGRTLLSDKPVAAFKNYGKKGTIAPFDLEVRPGEIVGLAGLLGSGRTETAEVIFGIKPADSGTALIKGKLQTLRSPHQASVLGIGFCPEDRKTDGIIAAASVRENIILALQAQRGWLRPISRKEQQEIAERFIRQLGIRTPSTEQPIEFLSGGNQQKVLLSRWLLTRPQFLILDEPTRGIDVGAHAEIIRLIETLCADGLALLVISSELEELVGYADRVIIMRDRKQVAEIPLAELSVPAIMNAIAA

SEQ ID NO: 9743 - DNA, 1023 bp, Escherichia coli
atgcctcaatctctcccggacactacgccgccgaaaaggcgttttcgctggccaacaggaatgccgcagctggcggcactgttgctggtgctgctggttgatagcctggtggccccgcatttctggcaggtggtgcttcaggatgggcgtttgttcggtagccctatcgacattcttaaccgtgcggcccccgttgcgctactggcgattggcatgacgctggttatcgccactggtgggattgatctctccgtaggggcggtgatggctatcgccggagccacaacggctgcgatgacggtcgcgggattcagcctgccaattgttttgttaagcgccctgggcactggcatcctggcaggattgtggaacggcatactggtagcgatcctcaaaattcagccgtttgtcgccaccctgatcctgatggtcgccgggcgcggcgtggcgcaactgatcacctccggacagatcgtcacatttaactcaccggatctctcctggttcggcagtggatcgctgttgttcctgccaacgccagtcattattgcggtgctgacgcttctcctgttctggctgttgacccgcaaaacggcactggggatgtttatcgaagccgttggtatcaacattcgggcggcaaaaaatgccggggtaaacacgcggatcatcgtcatgctcacctacgtgttgagcgggctatgtgcggcgattgcgggcattattgtggcggcggatattcgcggtgccgatgccaacaatgccggattatggctggagctggacgccattcttgcagtggtgattggcggcggatcgctgatgggcgggcgctttaacctgctgctttcggtggtgggggcgctgattattcagggaatgaacaccggaattttgctttctggctttccgccggagatgaaccaggtggtgaaagcggtggtggtgctttgcgtgctgattgtccagtcgcaacgctttatcagtctgattaaaggggtacgtaaccgtgataaaacgtaa

SEQ ID NO: 9744 - protein, 340 aa, Escherichia coli
MPQSLPDTTPPKRRFRWPTGMPQLAALLLVLLVDSLVAPHFWQVVLQDGRLFGSPIDILNRAAPVALLAIGMTLVIATGGIDLSVGAVMAIAGATTAAMTVAGFSLPIVLLSALGTGILAGLWNGILVAILKIQPFVATLILMVAGRGVAQLITSGQIVTFNSPDLSWFGSGSLLFLPTPVIIAVLTLLLFWLLTRKTALGMFIEAVGINIRAAKNAGVNTRIIVMLTYVLSGLCAAIAGIIVAADIRGADANNAGLWLELDAILAVVIGGGSLMGGRFNLLLSVVGALIIQGMNTGILLSGFPPEMNQVVKAVVVLCVLIVQSQRFISLIKGVRNRDKT

SEQ ID NO: 9745 - DNA, 972 bp, Escherichia coli
atgatcaccatcggcgtctttgtgttgggttatatctactgtctgacccagtttcccggttttgcttccacaagagtgatctgcaatatcctgaccgataatgcctttcttgggataatcgccgttggcatgacctttgtgatcctctccggtgggatcgatctctccgtcggttcggtgatcgcctttaccggcgtgtttctggcaaaagtgattggcgatttcggcctctcgccgctgctggcgtttccgctggtgttggtgatgggctgtgccttcggcgcatttatggggcttctgattgatgccctgaagatcccggcgtttatcattacccttgcgggaatgttctttttgcgtggcgtcagctatctcgtttcggaagagtcgatcccgataaaccatcctgtttatgacacgctctcaagccttgcgtggaaaatccctggcggtggtcgcttaagtgcgatgggactactgatgctggcggtggtggttatcggcatattactcgcgcatcgtacccgttttggtaatcaggtatacgccattggcggcaacgcaacgtcggcaaacctgatggggatttccactcgcagcaccactattcgcatttatatgctctccaccggactggcaacgctggcggggattgtcttctcgatttatacccaggccggatatgcactggcgggcgtaggtgtggaactggatgctatcgcctcagtggtaattggcggtacgcttttgagtggtggcgttggaacggtattagggacgctttttggcgtggcgattcagggactgattcagacttacataaactttgatggcacgctgagttcctggtggacgaaaatcgccatcggtattttgttgtttatttttatagcattacagcgtggattaacggtgctgtgggagaatcgtcagagttcgccagtgacaagagtcaacattgcgcagcgataa

SEQ ID NO: 9746 - protein, 323 aa, Escherichia coli
MITIGVFVLGYIYCLTQFPGFASTRVICNILTDNAFLGIIAVGMTFVILSGGIDLSVGSVIAFTGVFLAKVIGDFGLSPLLAFPLVLVMGCAFGAFMGLLIDALKIPAFIITLAGMFFLRGVSYLVSEESIPINHPVYDTLSSLAWKIPGGGRLSAMGLLMLAVVVIGILLAHRTRFGNQVYAIGGNATSANLMGISTRSTTIRIYMLSTGLATLAGIVFSIYTQAGYALAGVGVELDAIASVVIGGTLLSGGVGTVLGTLFGVAIQGLIQTYINFDGTLSSWWTKIAIGILLFIFIALQRGLTVLWENRQSSPVTRVNIAQR

SEQ ID NO: 9747 - DNA, 1062 bp, Escherichia coli
ttgggattatttgttaagattgttgcggtcgctttactccataaacattgcagggaaagttttatgaaaacgttaggtgaatttattgtcgaaaagcagcacgagttttctcatgctaccggtgagctcactgctttgctgtcggcaataaaactgggcgccaagattatccatcgcgatatcaacaaagcaggactggttgatatcctgggtgccagcggtgctgagaacgtgcagggcgaggttcagcagaaactcgacctgttcgctaatgagaaactgaaagccgcactgaaagcacgcgatatcgttgcgggcattgcctctgaagaagaagatgagattgtcgtctttgaaggctgtgaacacgcaaaatacgtggtgctgatggacccactggatggctcgtccaacatcgatgttaacgtctctgtcggtaccattttctctatctaccgccgcgttacgcctgttggcacgccggtaacggaagaagatttcctccagcctggtaacaaacaggttgcggcaggttacgtggtatacggctcctctactatgctggtttacaccaccggatgcggtgttcacgcctttacttatgatccttcgctgggtgttttctgcctgtgccaggaacggatgcgcttcccggagaaaggcaaaacctactccatcaacgaaggaaactacattaagtttccgaacggggtgaagaagtacattaaattctgccaggaagaagataaatccaccaaccgcccgtatacctcacgttatatcggttcactggtcgcggatttccaccgtaacctgctgaaaggcggtatttatctctacccaagcaccgccagccacccggacggtaaactacgtttactgtatgagtgcaacccgatggcattcctggcggaacaagcgggcggtaaagcgagcgatggcaaagagcgtattctggatattatcccggaaaccctgcaccagcgccgttcgttctttgtcggcaacgaccatatggttgaagatgtcgaacgctttatccgtgagttcccggacgcgtaa

SEQ ID NO: 9748 - protein, 353 aa, Escherichia coli
MGLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 9749 - DNA, 132 bp, Escherichia coli
atgttgcgctcaggtgaatcgcgccagcaaattacggattatcctgaaatgcgtttctcacttgcccgacatatgcgtaaaatgagcgccagattaaaaaaggatagtgacgtatgcgcattcatattttag

SEQ ID NO: 9750 - protein, 43 aa, Escherichia coli
MLRSGESRQQITDYPEMRFSLARHMRKMSARLKKDSDVCAFIF

SEQ ID NO: 9751 - DNA, 1323 bp, Escherichia coli
atgctggcgcgccagttaggccatgaagtaacgggttcggacgccaatgtgtatccgccgatgagcaccttacttgagaagcaaggcattgaactgattcagggttacgatgccagccagctcgatccacagccggatctggtgattattggtaacgccatgacccgtggaaatccgtgtgtggaagcggtactggaaaaaaacatcccttatatgtcaggtccgcagtggctgcacgattttgtgctgcgcgaccgctgggtgctggccgttgccggtacacacggcaaaaccaccacggcgggaatggcgacctggattctggaacagtgtggttacaaaccgggatttgtgatcggtggtgtgccggggaactttgaggtttcggcgcgtctgggcgaaagcgacttctttgttatcgaagcggatgagtacgactgcgccttcttcgacaaacgctctaaatttgtccattactgcccgcgtacgctgatcctcaacaaccttgagttcgatcacgccgatatctttgacgacctgaaagcgatccagaaacagttccaccatctggtgcgtatcgttccggggcaggggcgtattatctggccggaaaacgacatcaacctgaaacaaaccatggcgatgggctgctggagcgagcaggagctggtgggcgagcaggggcactggcaggcgaaaaagctgaccaccgatgcttccgaatgggaagtcttgctggatggcgaaaaagtgggcgaagtgaaatggtcgctggtaggcgaacataatatgcacaatggcctgatggcgattgcagcggctcgccatgttggtgtagcgccggcagatgccgctaacgcgctgggttcgtttattaacgctcgtcgccgtctggagttgcgtggtgaagcgaatggcgtcacggtatatgacgattttgcccatcacccgacggcgattctggcaacgcttgcggcgctgcgtggcaaagttggtggtacggcgcgcattattgccgtgctggaacctcgctcgaataccatgaaaatggggatctgcaaagacgatctggcaccttcattaggtcgtgccgatgaagtcttcctgctgcaaccggcacatattccgtggcaggtggcagaagtggcagaagcctgcgttcagcctgcacactggagcggcgatgtggatacgctggcagatatggtggtgaaaaccgctcagcctggcgaccatattctggtgatgagcaacggcggttttggtggtattcatcagaaactgctggatggtctggcgaagaaagcggaagctgcgcagtaa

SEQ ID NO: 9752 - protein, 440 aa, Escherichia coli
MLARQLGHEVTGSDANVYPPMSTLLEKQGIELIQGYDASQLDPQPDLVIIGNAMTRGNPCVEAVLEKNIPYMSGPQWLHDFVLRDRWVLAVAGTHGKTTTAGMATWILEQCGYKPGFVIGGVPGNFEVSARLGESDFFVIEADEYDCAFFDKRSKFVHYCPRTLILNNLEFDHADIFDDLKAIQKQFHHLVRIVPGQGRIIWPENDINLKQTMAMGCWSEQELVGEQGHWQAKKLTTDASEWEVLLDGEKVGEVKWSLVGEHNMHNGLMAIAAARHVGVAPADAANALGSFINARRRLELRGEANGVTVYDDFAHHPTAILATLAALRGKVGGTARIIAVLEPRSNTMKMGICKDDLAPSLGRADEVFLLQPAHIPWQVAEVAEACVQPAHWSGDVDTLADMVVKTAQPGDHILVMSNGGFGGIHQKLLDGLAKKAEAAQ

SEQ ID NO: 9753 - DNA, 552 bp, Escherichia coli
atgactaagcagcccgaagactggctcgacgacgttcccggtgatgacatcgaagacgaagacgatgaaattatctgggtcagtaaaagtgaaattaaacgtgatgccgaggagctaaaacgccttggcgcggaaattgttgatctggggaaaaacgcgctggataagatcccgttagatgcggatctgcgcgcggctattgagctcgcccagcgtattaagatggaaggtcgccgccgccagttgcagctcatcggtaagatgctgcgccagcgcgacgtagaaccgatccgtcaggcgctggataagctgaaaaaccgccacaaccagcaagtggtgttgttccataaactggaaaacctgcgcgatcgtctgatcgaccagggtgatgacgccatcgctgaagtattgaatctgtggcccgatgccgatcgtcagcaactgcgtactctgatccgtaacgcgaagaaagagaaagaagggaataagccgccgaaatccgcgcgccagattttccagtatctgcgtgagttagcggaaaacgaagggtaa

SEQ ID NO: 9754 - protein, 183 aa, Escherichia coli
MTKQPEDWLDDVPGDDIEDEDDEIIWVSKSEIKRDAEELKRLGAEIVDLGKNALDKIPLDADLRAAIELAQRIKMEGRRRQLQLIGKMLRQRDVEPIRQALDKLKNRHNQQVVLFHKLENLRDRLIDQGDDAIAEVLNLWPDADRQQLRTLIRNAKKEKEGNKPPKSARQIFQYLRELAENEG

SEQ ID NO: 9755 - DNA, 1353 bp, Escherichia coli
atggcacttgcaatgaaagtaatctctcaagttgaagcgcagcgcaagattctggaagaagcagtttcgactgcgctggagttggcctcaggcaaatcggacggtgcggaagttgccgtcagcaagaccaccggcattagcgtaagcacgcgttatggtgaagtggagaatgttgaattcaatagcgatggcgcgctggggatcaccgtttatcaccagaaccgtaaaggtagcgcatcgtctaccgatttaagcccgcaggccattgcccgcaccgtacaggcggcgctggatattgcccgttacacttcgccagatccgtatgcaggcgtggcagacaaagaactgctggcctttgacgcaccggatctcgacttgttccaccctgcggacgtttctccggatgaagccattgaactggcggcccgcgcggaacaggcggcattgcaggcggacaaacgcatcaccaataccgaaggcggtagctttaacagccactacggtgtcaaagtttttggcaacagccacggcatgttgcagggttactgctcaacgcgtcattcgctctccagttgtgtaatcgccgaagaaaatggcgatatggagcgcgattatgcctacaccattgggcgtgcgatgagcgatctgcaaacgccagagtgggttggggccgactgtgcgcgccgtactttatcgcgcctgtcaccgcgtaaactttctaccatgaaagcgccggtgatttttgccaatgaagtggcaacagggttgtttggtcatttggtgggggcgatagcgggtggtgcggtctaccgtaaatcgaccttcttgctcgactcgctcggtacacaaattctgccggactggctgacaattgaagaacatccgcatctgctgaaagggctggcatctacaccattcgacagcgaaggtgtgcgcaccgagcgccgcgatatcgtcaaagatggcatcctgactcagtggctgctgaccagctattcggcgcggaaactggggctgaaaagcaccggacatgcgggcggtattcacaactggcggattgccggacaagggctaagcttcgaacaaatgctcaaagagatgggcaccgggctggtggtgacggagctgatgggccagggcgtgagtgccattaccggtgattattcccgtggtgcagcgggcttctgggtagagaacggcgaaattcagtatccggtgagcgaaatcaccatcgctggtaatttaaaagatatgtggcgcaatattgtcaccgtcggtaacgatattgaaacacgcagtaatatacagtgtggttctgtgctgttgccggagatgaaaatcgccgggcagtaa

SEQ ID NO: 9756 - protein, 450 aa, Escherichia coli
MALAMKVISQVEAQRKILEEAVSTALELASGKSDGAEVAVSKTTGISVSTRYGEVENVEFNSDGALGITVYHQNRKGSASSTDLSPQAIARTVQAALDIARYTSPDPYAGVADKELLAFDAPDLDLFHPADVSPDEAIELAARAEQAALQADKRITNTEGGSFNSHYGVKVFGNSHGMLQGYCSTRHSLSSCVIAEENGDMERDYAYTIGRAMSDLQTPEWVGADCARRTLSRLSPRKLSTMKAPVIFANEVATGLFGHLVGAIAGGAVYRKSTFLLDSLGTQILPDWLTIEEHPHLLKGLASTPFDSEGVRTERRDIVKDGILTQWLLTSYSARKLGLKSTGHAGGIHNWRIAGQGLSFEQMLKEMGTGLVVTELMGQGVSAITGDYSRGAAGFWVENGEIQYPVSEITIAGNLKDMWRNIVTVGNDIETRSNIQCGSVLLPEMKIAGQ

SEQ ID NO: 9757 - DNA, 387 bp, Escherichia coli
atgcgtaaaagcctgttagctattcttgcagtctcctcattggtattcagttcggcgtcgtttgccgctgatctggaagacaatatggaaaccctcaacgacaatttaaaagtggttgaaaaagccgataacgcggcgcaagtcaaagacgcgttaacgaagatgcgcgctgcggcgctggatgcgcaaaaagcgacgccgccgaagcttgaaggcaaatcaccggacagcccggaaatgaaagacttccgccacggtttcgatattctggtcggtcagattgacgacgcgctgaagctggctaatgaaggtaaagtaaaagaagcgcaggccgccgcagagcaactgaaaacgacccgcaacgcctatcaccagaagtatcgttaa

SEQ ID NO: 9758 - protein, 128 aa, Escherichia coli
MRKSLLAILAVSSLVFSSASFAADLEDNMETLNDNLKVVEKADNAAQVKDALTKMRAAALDAQKATPPKLEGKSPDSPEMKDFRHGFDILVGQIDDALKLANEGKVKEAQAAAEQLKTTRNAYHQKYR

SEQ ID NO: 9759 - DNA, 465 bp, Escherichia coli
atgaactatcatcagtactatcctgtcgacatcgtcaacggccccggcactcgctgcaccctgtttgtctccgggtgtgttcatgaatgccccggttgctataacaaaagcacctggcgggtaaattccggtcagccatttaccaaagcaatggaagaccagatcattaacgatctgaatgacactcgtatcaaacgccagggtatttccctctccggcggcgatccgctacatccgcaaaacgtgccggatattctgaaactggtacaacgcatccgcgccgagtgtccgggtaaagacatctgggtgtggacaggctataaactcgacgaactcaacgctgcgcaaatgcaggttgttgatttgattaacgtgctggtcgacggcaaatttgtgcaggatttaaaagacccttccctgatctggcgcggcagcagcaatcaggtggtgcatcatttgcgatga

SEQ ID NO: 9760 - protein, 154 aa, Escherichia coli
MNYHQYYPVDIVNGPGTRCTLFVSGCVHECPGCYNKSTWRVNSGQPFTKAMEDQIINDLNDTRIKRQGISLSGGDPLHPQNVPDILKLVQRIRAECPGKDIWVWTGYKLDELNAAQMQVVDLINVLVDGKFVQDLKDPSLIWRGSSNQVVHHLR

SEQ ID NO: 9761 - DNA, 2139 bp, Escherichia coli
atgacaccgcatgtgatgaaacgagacggctgcaaagtgccgtttaaatcagagcgcatcaaagaagcgattctgcgtgcagctaaagcagcggaagtcgatgatgccgattattgcgccactgttgctgcggttgtcagcgagcagatgcagggccgcaaccaagtggatatcaatgagatccagaccgcagttgaaaaccagctgatgtcggggccatacaaacaactggctcgtgcctacatcgagtaccgtcacgatcgcgacattgaacgtgaaaaacgcggtcgcctgaaccaggagatccgtggtctggtcgagcagaccaactcctcgttactcaacgaaaacgccaacaaagacagcaaggtgattccaacccagcgcgacctgctggccgggatcgtggctaaacactatgcacgccagcacctgctgccgcgtgacgtggtgcaggcacatgagcgtggcgatattcactatcacgatctcgattactcgccgttcttcccgatgttcaactgcatgttgatcgacctgaaaggcatgctgacccagggctttaaaatggggaacgccgagattgaaccgccgaagtcgatctctacggcaaccgcggtaactgcgcagattattgctcaggtcgccagccatatttatggcggcaccaccattaaccgtatcgatgaagtgctggcaccgtttgtcaccgccagctacaacaaacatcgcaagaccgcagaagagtggaacatcccggacgccgaaggctacgctaactctcgtaccatcaaagagtgctacgatgccttccagtcgctggagtacgaagtaaacaccctgcataccgccaacggtcaaacgccgtttgtaacctttggttttggtctgggcaccagctgggaatcgcgcctgattcaggaatcgatcctgcgtaaccgtatcgcaggcctcggtaaaaaccgtaaaacggcggtgttcccgaaactggtgtttgcgattcgcgatggcctgaaccataaaaaaggcgatccgaactacgacatcaaacagctggcgctggagtgcgcaagcaagcgcatgtatccggatatcctgaactacgatcaggtagtgaaagtcaccggttcgtttaaaaccccgatgggctgccgcagcttcctcggcgtgtgggaaaatgaaaacggcgagcagatccacgatggtcgtaacaacctcggcgtgatcagcctgaacctgccgcgtattgctctggaagcaaaaggcgatgaagccaccttctggaagctgctggatgaacgtctggtgttggcacgtaaggcgctgatgacccgtatcgctcgtctcgaaggcgtgaaagcgcgcgtagccccgatcctctatatggaaggcgcttgtggcgtgcgtctgaatgctgacgacgacgtttctgaaatcttcaaaaacggtcgtgcgtctatttcgctgggttacatcggcatccacgaaaccattaacgcgctgttcggcggcgagcatgtttacgacaacgagcagctgcgcgcgaaaggtattgcgattgttgagcgtctgcgtcaggcggtggatcagtggaaagaagaaactggctacggtttcagcctctacagtacgccgagtgagaacctgtgtgaccgcttctgccgtctcgataccgctgagtttggcgtggtgccgggcgtgaccgataaaggttactacaccaacagtttccacctcgatgtggagaagaaggtgaacccgtacgacaagatcgactttgaagcgccttacccgccactggcgaacggtggcttcatttgctatggcgagtatccaaacattcagcacaacctgaaggcgctggaagatgtctgggattacagctatcagcatgtaccgtattacggcaccaacacaccgatcgatgaatgctacgagtgtggctttaccggcgaatttgagtgcaccagcaaaggcttcacttgtccgaaatgtggtaaccatgacacctcccgtgtgtcggtgactcgccgcgtgtgcggatatttaggtagcccggatgcacgtccgtttaacgctggtaagcaggaagaagttaagcgccgcgttaaacatttgggaaatgggcagataggttaa

SEQ ID NO: 9762 - protein, 712 aa, Escherichia coli
MTPHVMKRDGCKVPFKSERIKEAILRAAKAAEVDDADYCATVAAVVSEQMQGRNQVDINEIQTAVENQLMSGPYKQLARAYIEYRHDRDIEREKRGRLNQEIRGLVEQTNSSLLNENANKDSKVIPTQRDLLAGIVAKHYARQHLLPRDVVQAHERGDIHYHDLDYSPFFPMFNCMLIDLKGMLTQGFKMGNAEIEPPKSISTATAVTAQIIAQVASHIYGGTTINRIDEVLAPFVTASYNKHRKTAEEWNIPDAEGYANSRTIKECYDAFQSLEYEVNTLHTANGQTPFVTFGFGLGTSWESRLIQESILRNRIAGLGKNRKTAVFPKLVFAIRDGLNHKKGDPNYDIKQLALECASKRMYPDILNYDQVVKVTGSFKTPMGCRSFLGVWENENGEQIHDGRNNLGVISLNLPRIALEAKGDEATFWKLLDERLVLARKALMTRIARLEGVKARVAPILYMEGACGVRLNADDDVSEIFKNGRASISLGYIGIHETINALFGGEHVYDNEQLRAKGIAIVERLRQAVDQWKEETGYGFSLYSTPSENLCDRFCRLDTAEFGVVPGVTDKGYYTNSFHLDVEKKVNPYDKIDFEAPYPPLANGGFICYGEYPNIQHNLKALEDVWDYSYQHVPYYGTNTPIDECYECGFTGEFECTSKGFTCPKCGNHDTSRVSVTRRVCGYLGSPDARPFNAGKQEEVKRRVKHLGNGQIG

SEQ ID NO: 9763 - DNA, 96 bp, Escherichia coli
atgacgggcgctacagcgatatgtaaattttttaatgaattttttgattataaaatcaacaaaaacaacatgctgacaggcaaaaccccggaatga

SEQ ID NO: 9764 - protein, 31 aa, Escherichia coli
MTGATAICKFFNEFFDYKINKNNMLTGKTPE

SEQ ID NO: 9765 - DNA, 1803 bp, Escherichia coli
ttgcgctggcaatggctatcgccatcatcatcccgattgtactcacctcgtttatctatcagcggaaataccgcctgggcacgctggacattgtttaattttcttcggggcgcaattgcgccccctcgcatttgcaggaataacgtaatgactcatcttccccactggtggcaaaacggcgttatctaccagatttatccaaagagttttcaggacaccacgggtagcggcaccggcgatttacgtggcgttatccagcgtctggactatctgcataaactgggcgttgatgccatctggctaacccccttttatgtctctccccaggtcgataacggttacgacgtagcgaattatacggcgattgatcccacctatggcacgctggacgattttgacgaactggtgacacaggcaaaatcgcgtgggattcgtatcattctcgatatggtgtttaaccatacctctacccaacatgcctggtttcgcgaggcgctgaacaaagaaagcccttaccgccagttttatatctggcgcgatggagaaccagaaacgccaccgaacaactggcgttcaaaattcggtggtagtgcgtggcgctggcatgcggaaagcgaacagtactatttgcatctctttgcaccagaacaggcggatctcaactgggagaatccagcggtacgcgcagagctgaaaaaagtctgtgagttctgggccaatcgtggggtcgacgggttgcgcctggatgtggtgaatctgatctccaaagacccgcgttaccctgaagacctggatggcgacgggcgtcgcttctacaccgacgggccacgagcacacgaatttttgcacgagatgaaccgcgatgtgtttacgccacgcgggttaatgaccgtaggtgaaatgtcctccaccagccttgagcattgccagcgatacgcggcactgacaggcagtgaattgtcgatgacctttaattttcatcacctgaaggtcgattatcccggtggtgaaaaatggacgctggctaaacctgactttgtggcgttgaaaacattgttccgccactggcaacaaggaatgcacaacgtggcatggaatgccttgttctggtgtaaccacgatcagccgcgcattgtttctcgctttggtgatgaaggtgaataccgtgtgcctgcggcaaaaatgctggcgatggtgctgcatggcatgcagggaacgccgtatatctaccagggcgaagagattggcatgaccaacccacatttcacgcgcattactgactatcgcgacgtggagagcctcaatatgtttgccgagctgcgcaacgatgggcgtgatgccgacgagttattggcaatcctcgccagtaaatcccgtgacaacagtcgcacccccatgcaatggaccaacggcgataatgccgggtttacggctggcgaaccgtggattggcctgggcgataactatcaggaaatcaacgtagaagcagcgctggccgatgagtcctcggtgttttacacctaccaaaagttaatcgcactgcgtaagcaagaagccgtcctgacatggggcgattaccaggatctgctgccaaacagccctgtattgtggtgctatcgccgtgagtggaaggggcaaaccttgctggtcattgccaaccttagccgtgagacccaaccctggcagccagggaaaatgctcggcaactggcagcttgtgatgcataactacgaagaagcctcaccacaaccctgtgccatgactttacggccttttgaggctgtctggtggttacagaagtaa

SEQ ID NO: 9766 - protein, 600 aa, Escherichia coli
MRWQWLSPSSSRLYSPRLSISGNTAWARWTLFNFLRGAIAPPRICRNNVMTHLPHWWQNGVIYQIYPKSFQDTTGSGTGDLRGVIQRLDYLHKLGVDAIWLTPFYVSPQVDNGYDVANYTAIDPTYGTLDDFDELVTQAKSRGIRIILDMVFNHTSTQHAWFREALNKESPYRQFYIWRDGEPETPPNNWRSKFGGSAWRWHAESEQYYLHLFAPEQADLNWENPAVRAELKKVCEFWANRGVDGLRLDVVNLISKDPRYPEDLDGDGRRFYTDGPRAHEFLHEMNRDVFTPRGLMTVGEMSSTSLEHCQRYAALTGSELSMTFNFHHLKVDYPGGEKWTLAKPDFVALKTLFRHWQQGMHNVAWNALFWCNHDQPRIVSRFGDEGEYRVPAAKMLAMVLHGMQGTPYIYQGEEIGMTNPHFTRITDYRDVESLNMFAELRNDGRDADELLAILASKSRDNSRTPMQWTNGDNAGFTAGEPWIGLGDNYQEINVEAALADESSVFYTYQKLIALRKQEAVLTWGDYQDLLPNSPVLWCYRREWKGQTLLVIANLSRETQPWQPGKMLGNWQLVMHNYEEASPQPCAMTLRPFEAVWWLQK

SEQ ID NO: 9767 - DNA, 1419 bp, Escherichia coli
atgagcaaaataaaccaaacggatatcgatcggttgattgaactggtcggcgggcgcggcaatattgcgacggtgagccactgtattactcgtctgcgctttgtcctcaaccaaccggccaatgccagaccgaaagaaattgagcaactccccatggtgaaaggctgtttcaccaatgccgggcaatttcaggtggtgattggcaccaacgtgggtgattactatcaagcactgatagcgtcaaccggacaggcgcaggttgataaagagcaggtaaaaaaagccgcccggcagaatatgaaatggcatgagcagttgatctctcatttcgcggagattttcttcccgttgctgcccgcgttgattagcggcggtttgatcctcggttttcgcaatgtgatcggcgatttgcccatgagcaacggtcaaacgctggcgcaaatgtacccttccctgcaaacgatctacgattttctgtggttgatcggtgaagcgatcttcttctacctgccggtcgggatttgctggtcagcggtgaaaaaaatgggcggtacaccgatcctcggtatcgtgcttggcgtgacgctggtttccccacagttgatgaacgcttatctgctcgggcagcagctgccggaagtatggaactttggcatgttcagcatcgccaaagtgggctatcaggcacaggttattccggcactgttagccgggctggcgctgggcgttattgaaactcgtcttaagcgcatcgtgccggattacctctacctggtggtggtgcccgtctgttcgctgatcctcgcggtgttcctcgcccatgcgctgattggtccgtttggtcgcatgattggcgatggcgttgcctttgcggtacgtcacctgatgaccggcagctttgctccgattggcgcggcattgtttggcttcctgtacgccccgctggtgatcaccggcgtacaccagaccacgcttgctattgatttgcagatgattcaaagcatgggtggcacgccagtgtggccgctgattgcgctgtcgaatatcgctcagggctccgctgtgataggtattatcatttccagccgcaagcacaatgaacgcgagatctccgtgcctgcggcgatctccgcctggcttggggtcactgagcctgcaatgtacggcatcaacctgaaatatcgcttcccgatgctgtgcgcgatgattggttctggtctggcaggattgctatgcggcctgaacggcgttatggcgaatggcatcggcgtaggcggcctgccgggaattctctcgattcaaccgagctactggcaggtgtttgcgctggcaatggctatcgccatcatcatcccgattgtactcacctcgtttatctatcagcggaaataccgcctgggcacgctggacattgtttaa

SEQ ID NO: 9768 - protein, 472 aa, Escherichia coli
MSKINQTDIDRLIELVGGRGNIATVSHCITRLRFVLNQPANARPKEIEQLPMVKGCFTNAGQFQVVIGTNVGDYYQALIASTGQAQVDKEQVKKAARQNMKWHEQLISHFAEIFFPLLPALISGGLILGFRNVIGDLPMSNGQTLAQMYPSLQTIYDFLWLIGEAIFFYLPVGICWSAVKKMGGTPILGIVLGVTLVSPQLMNAYLLGQQLPEVWNFGMFSIAKVGYQAQVIPALLAGLALGVIETRLKRIVPDYLYLVVVPVCSLILAVFLAHALIGPFGRMIGDGVAFAVRHLMTGSFAPIGAALFGFLYAPLVITGVHQTTLAIDLQMIQSMGGTPVWPLIALSNIAQGSAVIGIIISSRKHNEREISVPAAISAWLGVTEPAMYGINLKYRFPMLCAMIGSGLAGLLCGLNGVMANGIGVGGLPGILSIQPSYWQVFALAMAIAIIIPIVLTSFIYQRKYRLGTLDIV

SEQ ID NO: 9769 - DNA, 948 bp, Escherichia coli
atgcaaaatcggctgaccatcaaagacatcgcgcgcttaagcggcgtggggaaatctacggtttcccgggtgctgaataacgaaagcggcgtgagccagcgcacgcgcgagcgtgttgaagcagtgatgaatcagcatggattttccccttcccgctctgcgcgcgctatgcgtgggcaaagcgataaagtggtcgccatcattgttacccgtctggattcgttgtcagaaaatctcgccgttcaaaccatgctgccagcgttctatgaacaaggttacgatccaatcatgatggaaagtcagttttccccacaattagttgccgaacatttgggggtcctgaaacggcgtaatatcgacggcgtagtgctgttcggttttaccggcataacagaagaaatgttagcccactggcagtcatcgctggttctgctggcgcgtgacgcaaaaggctttgcttcggtctgttatgacgacgaaggggcaatcaagatcctgatgcaacggctgtatgaccaggggcatcgtaatatcagttatctcggcgtgccgcatagtgacgtgacgaccggtaagcgacgtcacgaagcctacctggcgttctgcaaagcgcataaattgcatcccgttgccgctctgccagggcttgctatgaagcaaggctatgagaacgtagcaaaagtgattacgcctgaaactaccgcgttactgtgcgcaaccgacacgctggcacttggcgcaagtaaatacctgcaagagcaacgcatcgacaccttgcaactggcgagcgtcggtaatacaccgttaatgaaattcctccatccggagatcgtcaccgtagatcccggttacgccgaagctggacgccaggcggcctgccagttgatcgcgcaggtcaccgggcgcagcgaaccgcaacaaatcatcatccccgccaccctgtcctga

SEQ ID NO: 9770 - protein, 315 aa, Escherichia coli
MQNRLTIKDIARLSGVGKSTVSRVLNNESGVSQRTRERVEAVMNQHGFSPSRSARAMRGQSDKVVAIIVTRLDSLSENLAVQTMLPAFYEQGYDPIMMESQFSPQLVAEHLGVLKRRNIDGVVLFGFTGITEEMLAHWQSSLVLLARDAKGFASVCYDDEGAIKILMQRLYDQGHRNISYLGVPHSDVTTGKRRHEAYLAFCKAHKLHPVAALPGLAMKQGYENVAKVITPETTALLCATDTLALGASKYLQEQRIDTLQLASVGNTPLMKFLHPEIVTVDPGYAEAGRQAACQLIAQVTGRSEPQQIIIPATLS

SEQ ID NO: 9771 - DNA, 2697 bp, Escherichia coli
atgtttaaagaaatttttacccggctcattcgccatttaccttcccgtctggttcatcgtgatccattgcctggcgcgcagcagacagtgaatgcggcggtcccgccttctttaagtgcgcattgcctgaaaatggcggtgatgcccgaagaagaattgtggaaaacgttcgacacccatccggaagggttaaatctggcggaagtggaatctgcccgcgaacaacatggtgaaaataaattacccgcacaacaaccgtcgccgtggtgggtacatttatgggtctgctatcgcaacccctttaatattttgctcaccattcttggtgctatttcttacgccacggaagatttatttgccgcaggtgttatcgcgctaatggtcgctatttctacgttgctgaactttattcaggaagctcgttccaccaaagcggcagatgccctgaaagcgatggtcagtaataccgcgacggtactgcgagtaattaacgacaaaggcgaaaatggctggctggagatcccgatcgaccagctggtgcccggcgatattataaaactggcggcaggggatatgatcccggcagatttacgtatcttgcaggcgcgggatctgttcgtcgctcaggcgtcgttaaccggtgagtctctgcccgtggaaaaagccgctactactcgccagccggagcacagcaatccgctggagtgcgacaccctgtgttttatgggcaccaccgtggtgagcggcacggcacaagcaatggtgattgctacaggagccaacacctggtttggtcaactggcggggcgtgttagtgagcaggaaagcgagccgaatgcctttcagcaagggatcagccgcgtcagtatgctgctgattcgctttatgctggtgatggctccggtggtgttgcttatcaacggttacaccaaaggcgactggtgggaagcggcactgttcgcactttcggtcgcggtaggcttaacgccagaaatgttgccgatgattgttacctcgacgctggcgcgtggcgcagtcaagttgtcgaaacagaaagtgatcgtcaaacatctggatgccattcagaactttggcgcaatggatattctgtgcactgataaaaccggcaccctgacacaggataaaattgtgctggagaatcataccgatatctccggtaaaactagcgaacgcgtgctgcatagcgcgtggttgaacagccattaccagaccgggcttaaaaacctgcttgatacagcggtgctcgaaggtacggatgaagagtcagcgcgctcgctggccagccgttggcaaaaaattgatgagattccatttgatttcgagcgtcgtcggatgtcggtggttgtggcagaaaataccgaacaccatcagttggtttgcaaaggcgcattgcaggaaatcctcaatgtgtgttcgcaagtgcgtcacaatggcgagattgtaccgctcgatgacaccatgctgcgtaagattaagcgggttactgatacgctgaatcgtcaggggctgcgcgtggttgcggtggcgacgaaatacctgccagcgcgtgaaggagattaccagcgggcggatgaatccgacctgatcctcgaaggatatattgctttccttgatccgccaaaagagacaacagctccggcactgaaggcattaaaagcgagtggaattaccgtaaaaatccttactggcgacagtgagttggttgcagcgaaagtgtgccatgaagtggggctggacgcgggagaggtggtcattggtagtgatattgaaacgctatctgacgacgaactggcaaatctcgcacagcgcaccacgctgtttgctcgtctgacgccgatgcataaagaacgcatcgtaacgttgctgaagcgcgaagggcatgtggttggctttatgggcgatggtattaatgatgcgcccgccttgcgcgctgcggatatcggcatttctgtggacggcgcggtagatattgcccgtgaagcggctgatatcatcctgctggaaaaaagcctgatggtgctggaagagggggttattgagggacgtcgcactttcgccaacatgctgaaatacatcaaaatgacggcgagctctaacttcggtaatgtgttcagcgtgctggtggcgagtgctttcttgcccttcctgccgatgttgccgctacacttgcttattcaaaatctgctgtacgatgtgtcacaggtggcgatcccatttgataacgtcgacgacgagcaaattcaaaagccgcagcgttggaatccggcggatctggggcgctttatggtcttcttcggaccgatcagctcgattttcgatattctgacgttttgcctgatgtggtgggtattccatgccaacacgccggaaacgcaaacgctgttccagtcgggctggtttgtggtgggcttactgtcgcaaacgctgattgtgcatatgatccgcacccgtcgtgtaccgtttattcagagctgtgcatcgtggccgttaatgattatgaccgtgatcgtgatgattgtcgggatcgcattgccgttttcaccgctggccagttatctgcagctgcaggcgctgccgttaagctatttcccgtggctggttgcgattctggcagggtatatgacgttaacccagttggtgaaagggttctatagccgtcgttacggttggcagtaa

SEQ ID NO: 9772 - protein, 898 aa, Escherichia coli
MFKEIFTRLIRHLPSRLVHRDPLPGAQQTVNAAVPPSLSAHCLKMAVMPEEELWKTFDTHPEGLNLAEVESAREQHGENKLPAQQPSPWWVHLWVCYRNPFNILLTILGAISYATEDLFAAGVIALMVAISTLLNFIQEARSTKAADALKAMVSNTATVLRVINDKGENGWLEIPIDQLVPGDIIKLAAGDMIPADLRILQARDLFVAQASLTGESLPVEKAATTRQPEHSNPLECDTLCFMGTTVVSGTAQAMVIATGANTWFGQLAGRVSEQESEPNAFQQGISRVSMLLIRFMLVMAPVVLLINGYTKGDWWEAALFALSVAVGLTPEMLPMIVTSTLARGAVKLSKQKVIVKHLDAIQNFGAMDILCTDKTGTLTQDKIVLENHTDISGKTSERVLHSAWLNSHYQTGLKNLLDTAVLEGTDEESARSLASRWQKIDEIPFDFERRRMSVVVAENTEHHQLVCKGALQEILNVCSQVRHNGEIVPLDDTMLRKIKRVTDTLNRQGLRVVAVATKYLPAREGDYQRADESDLILEGYIAFLDPPKETTAPALKALKASGITVKILTGDSELVAAKVCHEVGLDAGEVVIGSDIETLSDDELANLAQRTTLFARLTPMHKERIVTLLKREGHVVGFMGDGINDAPALRAADIGISVDGAVDIAREAADIILLEKSLMVLEEGVIEGRRTFANMLKYIKMTASSNFGNVFSVLVASAFLPFLPMLPLHLLIQNLLYDVSQVAIPFDNVDDEQIQKPQRWNPADLGRFMVFFGPISSIFDILTFCLMWWVFHANTPETQTLFQSGWFVVGLLSQTLIVHMIRTRRVPFIQSCASWPLMIMTVIVMIVGIALPFSPLASYLQLQALPLSYFPWLVAILAGYMTLTQLVKGFYSRRYGWQ

SEQ ID NO: 9773 - DNA, 387 bp, Escherichia coli
atgagcaaaactatcgcgacggaaaatgcaccggcagctatcggtccttacgtgcagggcgttgatctgggcaatatgattatcacttccggtcagatcccggtaaacccgaaaacgggcgaagtcccggcagatgtcgctgcacaggcacgtcagtcgctggataacgtaaaagcgatcgtcgaagccgctggcctgaaagtgggcgatatcgttaaaaccaccgtgtttgtgaaagatctgaacgacttcgcaaccgttaatgctacctacgaagcctttttcaccgaacacaacgccaccttcccggcacgttcttgcgttgaagttgctcgtctgccgaaagacgtgaagattgagatcgaagcgatcgctgttcgtcgctaa

SEQ ID NO: 9774 - protein, 128 aa, Escherichia coli
MSKTIATENAPAAIGPYVQGVDLGNMIITSGQIPVNPKTGEVPADVAAQARQSLDNVKAIVEAAGLKVGDIVKTTVFVKDLNDFATVNATYEAFFTEHNATFPARSCVEVARLPKDVKIEIEAIAVRR

SEQ ID NO: 9775 - DNA, 462 bp, Escherichia coli
atgacacacgataataaattgcaggttgaagctattaaacgcggcacggtaattgaccatatccccgcccagatcggttttaaactgttgagtctgttcaagttgaccgaaacagatcagcgcatcaccattggtctgaacctgccttctggcgagatggggcgcaaggatctgatcaaaatcgaaaatacctttttaagtgaggatcaggttgatcagctggcgttatatgcaccgcaagccacggttaaccgtatcgacaactatgaagtggttggcaaatcgcgccccagtctgccagagcgcatcgacaatgtgctggtctgcccgaacagcaactgtatcagccatgccgaaccggtttcatccagctttgccgtgcgaaaacgcgccaatgatatcgcgctcaaatgcaaatactgtgaaaaagagttttcccataatgtggtgctggccaattaa

SEQ ID NO: 9776 - protein, 153 aa, Escherichia coli
MTHDNKLQVEAIKRGTVIDHIPAQIGFKLLSLFKLTETDQRITIGLNLPSGEMGRKDLIKIENTFLSEDQVDQLALYAPQATVNRIDNYEVVGKSRPSLPERIDNVLVCPNSNCISHAEPVSSSFAVRKRANDIALKCKYCEKEFSHNVVLAN

SEQ ID NO: 9777 - DNA, 936 bp, Escherichia coli
atggctaatccgctatatcagaaacatatcatttccataaacgaccttagtcgcgatgaccttaatctggtgctggcgacagcggcgaaactgaaagcgaacccgcaaccagagctgttgaagcacaaagttattgccagctgtttcttcgaagcctctacccgcacccgcctctctttcgaaacttccatgcaccgcctgggtgccagcgtggtgggcttctccgacagcgccaatacatcactgggtaaaaagggcgaaacgctggccgataccatttcggttatcagcacttacgtcgatgcgatagtgatgcgtcatccgcaggaaggtgcagcgcgcctggccaccgagttttccggcaatgtaccggtactgaatgccggtgatggctccaaccaacatccgacgcaaaccttgctggacttattcaccattcaggaaacccaggggcgtctggacaatctccacgtcgcaatggttggtgacctgaaatatggccgcaccgttcactccctgacccaggcgctagcgaagttcgacggcaaccgtttttactttatcgcgccggatgcgctggcaatgccgcaatacattctggatatgctcgatgaaaaagggatcgcctggagtctgcacagctctattgaagaagtgatggcggaagtagacatcctgtacatgacccgcgtgcaaaaagagcgtctggacccgtccgagtacgccaacgtgaaagcgcagtttgttcttcgcgccagcgatctccacaacgccaaagccaatatgaaagtgctgcatccgctgccgcgtgttgatgagattgcgacggatgtggataaaacgcctcacgcctggtacttccagcaagcaggcaacgggattttcgctcgccaggcgttactggcactggttctgaatcgcgatctggtactgtaa

SEQ ID NO: 9778 - protein, 311 aa, Escherichia coli
MANPLYQKHIISINDLSRDDLNLVLATAAKLKANPQPELLKHKVIASCFFEASTRTRLSFETSMHRLGASVVGFSDSANTSLGKKGETLADTISVISTYVDAIVMRHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVL

SEQ ID NO: 9779 - DNA, 555 bp, Escherichia coli
atgaaccactctcacattataaaatgtgaaaaatatcatcaggtaataataaataaaaggtgcattatgaaggaatacgatgattactccgccaaagaaaagaagcaactggcggtctgtcagcgcctgattaccgaaaaaagttatctttcacaggaggaaatccgccgcgatttgcaaaaccatggctttgacagtatcagtcagtcaaccgtttcacgactactgaaattgctgggagtcataaaaattagaaatacaaaaggacaaaaaatttattcggtgaatcctcaattacttcccacacctgacgcaggtcgatccgtcgctgaaatggtcctgagtgtcgagcataatggtgaatttatccttatccataccgtcgccggatatggtcgggcagtagcacgaatccttgatttccatgctttgccagaaattcttggcgtgattgctggcagcaatatcgtttgggtcgcaccacgtgtggtaaagcgtacagccctggtgcacaagcaaattaattacttattaaaattgaatatatattcatga

SEQ ID NO: 9780 - protein, 184 aa, Escherichia coli
MNHSHIIKCEKYHQVIINKRCIMKEYDDYSAKEKKQLAVCQRLITEKSYLSQEEIRRDLQNHGFDSISQSTVSRLLKLLGVIKIRNTKGQKIYSVNPQLLPTPDAGRSVAEMVLSVEHNGEFILIHTVAGYGRAVARILDFHALPEILGVIAGSNIVWVAPRVVKRTALVHKQINYLLKLNIYS

SEQ ID NO: 9781 - DNA, 1404 bp, Escherichia coli
atgggtaaattcaaatttcccaccgcttataccatcttgttcgtgctgattgcgttagttgcggcaatgacctggattgtacctgcgggaaaatatcagatggcgacaaatgccgcactgggaaaggaagttcctgttgcaggcacttacgcacctgttgaggcgcaaccacagggtattacggctgtcctgttagcgcccatcgacggcttgtacaaccatcaaacctacactgcgggagcgattgatgtcgcgctgtttgtcctgatcatcggtggatttttgggagtagtaaataaaaccggagcaatagatgccggtatcgaacgagtgacaactcgccttaatggtcgggaagagtggatgattccgatcctgatggcgctcttcgctgctggcggtactatttatgggatggcggaagaatcactccccttctacacgttgctggtgcccgtcatgatggctgcccgctttgatcctctggtcgctgccgccacagtgttattgggatcgggcattggcacgctgggctcaaccattaacccatttgctaccgtcattgctgccaacgccgcagggatcccctttactcagggcattttgctgcgtgttattttgctgttagtaggctacgtgatttgtgtttactgggttatgcgttatgcccgcaaagttcgcaacagtccggaaagctctatcgtggcggataagatggctgaaaaccaggcgcattttctgggaaatcgttcagaaacgatgctggaatttacccccacgcgcaaagcgatcctgatactttttgctgcatcctttgcctttatgatttacggcgtagcggtactgggttggtggatggcggaaatctctgctgtctttctggcagctgcggtcatcgtgggtgtcattgcccgcatgggcgaagaaaccttcaccagtacctttattgacggcgcgcgggatctccttggtgtggcactgattatcggcatcgcccgcggtattgtggtcgtgatggataacggcatgattacgcacacaattctgcacagtgctgagaatctggtttcagggctttccaccactgttttcatcaacgtgacctattggctggaagtattgctctcttttctggttccctcatcttccggccttgcagtgttaacgatgccaataatggctccactcgctgattttgctcatgtacaacgcgatctggtggtgaccgcttatcagtctgcttccggggtggttaatttgattacgccaacctctgcggtagtgatgggcggtctggcgattgcccgtgtaccctgggtccgttatctgagatgggtagcaccgctactgctgattctcacgatgttgaatatgattgtgctgagtatcgccgcgatgatttaa

SEQ ID NO: 9782 - protein, 467 aa, Escherichia coli
MGKFKFPTAYTILFVLIALVAAMTWIVPAGKYQMATNAALGKEVPVAGTYAPVEAQPQGITAVLLAPIDGLYNHQTYTAGAIDVALFVLIIGGFLGVVNKTGAIDAGIERVTTRLNGREEWMIPILMALFAAGGTIYGMAEESLPFYTLLVPVMMAARFDPLVAAATVLLGSGIGTLGSTINPFATVIAANAAGIPFTQGILLRVILLLVGYVICVYWVMRYARKVRNSPESSIVADKMAENQAHFLGNRSETMLEFTPTRKAILILFAASFAFMIYGVAVLGWWMAEISAVFLAAAVIVGVIARMGEETFTSTFIDGARDLLGVALIIGIARGIVVVMDNGMITHTILHSAENLVSGLSTTVFINVTYWLEVLLSFLVPSSSGLAVLTMPIMAPLADFAHVQRDLVVTAYQSASGVVNLITPTSAVVMGGLAIARVPWVRYLRWVAPLLLILTMLNMIVLSIAAMI

SEQ ID NO: 9783 - DNA, 1005 bp, Escherichia coli
atggctacttcactgaaaaaccgtaattttcttaagctgcttgattacaccccagcagagattcaatacctgattgatttggctatcaatcttaaagccgccaagaaatctggaaacgaaaaacaaacgctggtcggtaaaaacattgcgttgatttttgaaaaatcctctacccgtacccgctgtgcctttgaagtcgcggcctttgatcaaggtgcgcaggtgacttacatcggccccagcggctcacaaatcggccataaagaatcaatgaaagataccgctcgcgtactcggacgcatgtatgacggtattgagtatcgcggttatggtcagaatatcgttgaagaattaggtgagttcgctggtgttccggtatggaacggactgaccaatgaatttcacccgacacagatcctcgcggatttaatgaccatgctggaacatgcgccaggcaaaacgctgccagagctgagctttgcgtatcttggtgatgcccgaaataacatggggaactcgctgatggttggtgctgcaaaaatggggatggatatccgtctggtggcaccaaaatctttctggccagatgaagcgctggtaacacaatgccgtgagatcgccagcgtgactggggcgagaatcaccctgacagaggatgtggaagaaggcgtatacgacgttgattttctctatacggatgtttgggtttcgatgggagagccaaaagaagcctgggcagaacgagtgagtcttatgacaccttatcagatcaatcaacaggtgattactgccacgcgtaaccctgaagtcaaatttatgcactgcctgcccgccttccataatgagcacaccacagtaggacgcgagatcgagatggcctacggcctcaaaggactggaagtaactgatgaggtttttgaatctgcccactccattgttttcgatgaagcagaaaaccggatgcacaccattaaagcggtgatggtagcaactctcggcgactaa

SEQ ID NO: 9784 - protein, 334 aa, Escherichia coli
MATSLKNRNFLKLLDYTPAEIQYLIDLAINLKAAKKSGNEKQTLVGKNIALIFEKSSTRTRCAFEVAAFDQGAQVTYIGPSGSQIGHKESMKDTARVLGRMYDGIEYRGYGQNIVEELGEFAGVPVWNGLTNEFHPTQILADLMTMLEHAPGKTLPELSFAYLGDARNNMGNSLMVGAAKMGMDIRLVAPKSFWPDEALVTQCREIASVTGARITLTEDVEEGVYDVDFLYTDVWVSMGEPKEAWAERVSLMTPYQINQQVITATRNPEVKFMHCLPAFHNEHTTVGREIEMAYGLKGLEVTDEVFESAHSIVFDEAENRMHTIKAVMVATLGD

SEQ ID NO: 9785 - DNA, 945 bp, Escherichia coli
atggaaaacaaaccaacactggttatcgctctcggcggtaatgccctgcttaaacgaggcgaaccactcgaagcagaaatccaacgtaaaaatatcgatcttgcggctaaaactatcgcccaactgactcaacactggcgggttgtactggttcacgggaatggtccacaagttggacttctggcacttcaaaatagcgcctatgcccatgtcgctccctatccactcgacattctgggggccgaaagccaggggatgatcggctacatgctacaacaggcgctgaaaaatcaactaccacaacgtgaaatcagcgttctgctgacgcaggttgaagtggatgccaacgatcccgccttcagtaacccaactaagtacatcggcccaatttatgaccacgctcagactcaggtactacaggcagaaaaaggctgggttttcaaagcagatggtcactctttccgccgggtcgtaccttctccacaacctaaacgcatcgtcgagcgggatgccatccagacactgatcgcccacgatcatctggtgatctgtaatggtggcggtggtgttccggtggttgaaaaagccgatggataccatgggattgaagcggttatcgacaaagatctttcagccgcgctactggcaagtcagatccatgctgacgccttgttgatcctcactgatgcggacgcagtatatctcgactggggcaagccaacccaacgcccgctggcccaggtcacgccggaattactcaacgaaatgcagtttgatgccgggtctatggggccgaaagtcaccgcctgcgcaaagtttgttagtcagtgccggggcattgcagggatcggctctcttgcagatggtccggaaattctcgccggagacaaaggcactcttattcgccttgatacccccataaccacgcttgatccatttttataa

SEQ ID NO: 9786 - protein, 314 aa, Escherichia coli
MENKPTLVIALGGNALLKRGEPLEAEIQRKNIDLAAKTIAQLTQHWRVVLVHGNGPQVGLLALQNSAYAHVAPYPLDILGAESQGMIGYMLQQALKNQLPQREISVLLTQVEVDANDPAFSNPTKYIGPIYDHAQTQVLQAEKGWVFKADGHSFRRVVPSPQPKRIVERDAIQTLIAHDHLVICNGGGGVPVVEKADGYHGIEAVIDKDLSAALLASQIHADALLILTDADAVYLDWGKPTQRPLAQVTPELLNEMQFDAGSMGPKVTACAKFVSQCRGIAGIGSLADGPEILAGDKGTLIRLDTPITTLDPFL

SEQ ID NO: 9787 - DNA, 1221 bp, Escherichia coli
atggaaaagcattatgttggttctgaaattggacaactacgcagcgttatgttgcatcgcccaaatctcagtctgaaacgtctaacaccatccaattgccaggagttgttatttgacgatgtattgtccgttgagcgggcaggtgaagagcatgatattttcgccaatacgctgcgccagcaagggatagaagttctgttactcactgatttactaacacaaacattggatatcccggaagccaaaagctggttactggaaacacaaatatcagattaccgactcggccctacgtttgctactgacgttcgcacctggcttgcagagatgtcacaccgggaccttgctcgtcatttaagtggtgggctgacttatagtgaaattcccgcctcaattaaaaatatggtggttgatacccacgatattaatgatttcattatgaagccgttaccgaatcatttatttacgcgtgatacctcatgctggatttataacggtgtatcgattaatccaatggcaaaacctgctcgccaacgtgaaaccaataatctacgcgctatttatcgctggcatccacaatttgctggcggcgaatttattaaatatttcggcgacgagaatattaattatgaccacgccacgttagaaggtggtgatgtgctggtgattggtcggggggccgtgttgatcggcatgtctgaacgcaccacgccacaaggaatcgagtttcttgctcaggcattgtttaaacatcgtcaggctgaacgggtaatcgctgttgagctgcctaaacaccgctcctgtatgcatcttgacaccgttatgactcatatcgatatcgacaccttctcggtttatcccgaagttgtgcgcccggatgttaattgctggacgctaacacctgacggtcacggcggcctgaaacgtactcaagaaagcacactcctccatgctatcgaaaaagccctcggtattgaccaggtacgtttaatcaccacggggggtgatgcctttgaggcagaacgcgaacagtggaatgacgctaacaatgtgctcacgcttcggccgggagtggtagtgggctacgagcgcaacatctggactaacgaaaaatatgacaaagcaggcatcaccgttttacccatccccggtgatgaattaggccgcggacgtggcggcgcacgttgcatgagttgccctttgcatcgtgacggtatctaa

SEQ ID NO: 9788 - protein, 406 aa, Escherichia coli
MEKHYVGSEIGQLRSVMLHRPNLSLKRLTPSNCQELLFDDVLSVERAGEEHDIFANTLRQQGIEVLLLTDLLTQTLDIPEAKSWLLETQISDYRLGPTFATDVRTWLAEMSHRDLARHLSGGLTYSEIPASIKNMVVDTHDINDFIMKPLPNHLFTRDTSCWIYNGVSINPMAKPARQRETNNLRAIYRWHPQFAGGEFIKYFGDENINYDHATLEGGDVLVIGRGAVLIGMSERTTPQGIEFLAQALFKHRQAERVIAVELPKHRSCMHLDTVMTHIDIDTFSVYPEVVRPDVNCWTLTPDGHGGLKRTQESTLLHAIEKALGIDQVRLITTGGDAFEAEREQWNDANNVLTLRPGVVVGYERNIWTNEKYDKAGITVLPIPGDELGRGRGGARCMSCPLHRDGI

SEQ ID NO: 9789 - DNA, 453 bp, Escherichia coli
atgattgttggcaacatccatcacttacaatcctggctgccggaagaacttcgcgaagcaattgagtacatcaaatcacatgtcagcgatgagacagcaaaaggtaagcacgctattgacggcgaccgcctgttttatctgatttctgaggatacgactgaaccaggtgaactgcgtcgtgctgagtatcatgctcgttatctcgatatccagattgtattaaaagggcaggaagggatgacatttagcacgcaaccagcaggcgtaccagagactgactggctggcagataaagatattgcttttatcgggcaggggatcgatgaaaaaacagtgattcttaatgaaggggattttgtcgttttctatcctggcgaagttcacaaaccgctttgtgcggtgggagcccccgctcaggtacggaaagcagtagttaagctattaaaatcgtaa

SEQ ID NO: 9790 - protein, 150 aa, Escherichia coli
MIVGNIHHLQSWLPEELREAIEYIKSHVSDETAKGKHAIDGDRLFYLISEDTTEPGELRRAEYHARYLDIQIVLKGQEGMTFSTQPAGVPETDWLADKDIAFIGQGIDEKTVILNEGDFVVFYPGEVHKPLCAVGAPAQVRKAVVKLLKS

SEQ ID NO: 9791 - DNA, 1005 bp, Escherichia coli
atgtccgggttttatcataagcatttcctgaaattactcgatttcacgccagctgaactcaacagcttgttgcagttagccgcgaagctgaaagccgataagaaaagcggtaaagaagaagccagactcactggcaaaaacatcgcgctcatcttcgaaaaagactcgacccgtacccgatgctctttcgaagttgccgcatatgaccagggtgctcgcgttacttatctcggcccaagcggcagccagattggtcacaaagagtcgattaaagacactgcccgcgtgcttggtcgcatgtatgacggtattcagtatcgcggctatggtcaggagattgtcgaaacactggcggaatacgctggcgtgccagtatggaacggcctgaccaatgagttccaccccacgcagctgctggcggatctcctcaccatgcaggagcatttgcccggcaaagcattcaacgaaatgacgctggtctatgcaggtgacgcgcgtaacaacatgggcaattcgatgctcgaagctgcggcgcttaccggtctggatttgcgtctggtcgcgccacaggcatgctggccggaagctgcgctggtcgccgaatgcagtgctctggcacaaaaacacgggggtaaaatcaccttgacggaagatatcgcctctggggttaaaggtgcagactttatctataccgatgtctgggtatcgatgggtgagcccaaagagaaatgggcggagcgtattgccctgctgcgtgactatcaggtgaatagcaaaatgatggccctgaccggtaattcgcaggttaagttcctccactgtctgcctgcatttcatgatgagcaaaccacgctgggtaaaaaaatggccgcagaattcggtctgtatggtggaatggaagtcaccgatgaagtctttgaatctccggcaagtattgtctttgaccaggcagaaaaccggatgcacaccataaaagctgttatggtcgctacattagcaaaataa

SEQ ID NO: 9792 - protein, 334 aa, Escherichia coli
MSGFYHKHFLKLLDFTPAELNSLLQLAAKLKADKKSGKEEARLTGKNIALIFEKDSTRTRCSFEVAAYDQGARVTYLGPSGSQIGHKESIKDTARVLGRMYDGIQYRGYGQEIVETLAEYAGVPVWNGLTNEFHPTQLLADLLTMQEHLPGKAFNEMTLVYAGDARNNMGNSMLEAAALTGLDLRLVAPQACWPEAALVAECSALAQKHGGKITLTEDIASGVKGADFIYTDVWVSMGEPKEKWAERIALLRDYQVNSKMMALTGNSQVKFLHCLPAFHDEQTTLGKKMAAEFGLYGGMEVTDEVFESPASIVFDQAENRMHTIKAVMVATLAK

SEQ ID NO: 9793 - DNA, 417 bp, Escherichia coli
atggcaaacccggaacaactggaagaacagcgtgaagaaacacgtttgattattgaagaattactggaagatggcagcgatccggacgcgctgtacaccatcgaacaccatctttccgcagacgatctggaaaccctggaaaaagcagcagttgaagcgtttaaactcggttacgaagtgaccgatccagaagagctggaagttgaagatggtgacatcgtgatttgctgcgacatcctcagcgagtgtgcgttgaatgccgacctgatcgatgcccaggttgaacaactgatgacgctggcggagaaatttgacgttgagtacgatggttggggcacttactttgaagatcctaacggcgaagacggcgacgatgaagattttgtcgatgaagacgatgacggtattcgtcactaa

SEQ ID NO: 9794 - protein, 138 aa, Escherichia coli
MANPEQLEEQREETRLIIEELLEDGSDPDALYTIEHHLSADDLETLEKAAVEAFKLGYEVTDPEELEVEDGDIVICCDILSECALNADLIDAQVEQLMTLAEKFDVEYDGWGTYFEDPNGEDGDDEDFVDEDDDGIRH

SEQ ID NO: 9795 - DNA, 99 bp, Escherichia coli
atgccttatccgggctacaaattcaccaggttgcaggaactacctgggcctgatatgcgtagcgcatcaggtaacgcagcctttgtcgtcaacgcttaa

SEQ ID NO: 9796 - protein, 32 aa, Escherichia coli
MPYPGYKFTRLQELPGPDMRSASGNAAFVVNA

SEQ ID NO: 9797 - DNA, 522 bp, Escherichia coli
ttgaaattgagctatgctatgaatgttgtcgcttctcccgcactccgtttgcgcaaacttaccgtcgccgataatcctgctatcgcccacgtcattcgtcaggtatccgccgaatacggtcttaccgctgataaaggctacaccgtcgccgatccgaaccttgacgagctgtatcaagtatatagtcagcctggccacgcatattgggtggttgagtacgagggtgaagtggtcggcggcggtgggattgcgccattaaccgggagtgagtcagacatttgcgaactgcaaaagatgtattttcttccggctatccgcggcaaagggctggcaaaaaaactggccttaatggcaatggagcaggcgcgagaaatgggtttcaaacgctgctatctggaaacgaccgcttttttaaaggaagccattgcgctttatgagcatttgggctttgagcatatcgactatgcgcttggctgcacgggtcatgtcgattgtgaagtacggatgctacgcaaactttga

SEQ ID NO: 9798 - protein, 173 aa, Escherichia coli
MKLSYAMNVVASPALRLRKLTVADNPAIAHVIRQVSAEYGLTADKGYTVADPNLDELYQVYSQPGHAYWVVEYEGEVVGGGGIAPLTGSESDICELQKMYFLPAIRGKGLAKKLALMAMEQAREMGFKRCYLETTAFLKEAIALYEHLGFEHIDYALGCTGHVDCEVRMLRKL

SEQ ID NO: 9799 - DNA, 1188 bp, Escherichia coli
atgaatgatgtaaacatcgggaaagataattctcggcactcgtttgttttcacaggcaaaggtggtgagtattttcttatttgtcttgtgaatttttcactgacaattattactctgggaatatatggaccgtgggcattgataaaatgccgtcgttatatttatcaacatgtgacactcaaggggcaaccatttagttataagggaacaggtggtgccatttttgttagcatgttacttattgtggtggtttatcttctcagtatttcttgttttgcaggtcaacactttgcgctcggtttattcctgtttgctctcttgatctgcggtattccttgtatggcagtgaagagtctgcagtatcaggcgaacatgacctcactgaatgacattcgctttggctttaactgctcaatgatgcgtgcatggtgggttatgctaggactgcctgttctgttggcgttagttttttggttcgcactgtatcttattgcacaagtgacgacatcgataggagggttattctttaacttagtcgcattaagtttgctttctgccatcgggctaggtgttgtccatggtataacctatagtaaatggatgccattgctgggtaataatgcaacttttggcattcataagttttctattcaggtaaacgtaaaagaatgcattaaaggttgcatgctcgcaatattaaccatggttcctttcatcattgtgattggtattatgatcgcaccagtattccagcagttaatgatgatgaccatgttgggtaggtctgatgctggcagtgagtttgtattacaatattacccgcagattatggcttcttatttcctgtattttgtcgcgatccttgtttttgccagttatctctatgtcacgttacgcaatctgtttttgaataatctgacgctggcaaatgggacaattcgttttcattcatctgttaccgcgatcggtatgcttctgcgcatgttggcggtattaatggggtcctcaattacctgtggtctggcttatccctggctgaaaatgtggatggttagctggattgctaacaatacccatgtccagggcgaccttgattcgctggagttaaccaatgatgacaaaccgcaggatagcggttcgttaatgtggatatctcgcggtattatgccgtatgttccgtttatctaa

SEQ ID NO: 9800 - protein, 395 aa, Escherichia coli
MNDVNIGKDNSRHSFVFTGKGGEYFLICLVNFSLTIITLGIYGPWALIKCRRYIYQHVTLKGQPFSYKGTGGAIFVSMLLIVVVYLLSISCFAGQHFALGLFLFALLICGIPCMAVKSLQYQANMTSLNDIRFGFNCSMMRAWWVMLGLPVLLALVFWFALYLIAQVTTSIGGLFFNLVALSLLSAIGLGVVHGITYSKWMPLLGNNATFGIHKFSIQVNVKECIKGCMLAILTMVPFIIVIGIMIAPVFQQLMMMTMLGRSDAGSEFVLQYYPQIMASYFLYFVAILVFASYLYVTLRNLFLNNLTLANGTIRFHSSVTAIGMLLRMLAVLMGSSITCGLAYPWLKMWMVSWIANNTHVQGDLDSLELTNDDKPQDSGSLMWISRGIMPYVPFI

SEQ ID NO: 9801 - DNA, 2856 bp, Escherichia coli
atggaaaagacatataacccacaagatatcgaacagccgctttacgagcactgggaaaagcagggctactttaagcctaatggcgatgaaagccaggaaagtttctgcatcatgatcccgccgccgaacgtcaccggcagtttgcatatgggtcacgccttccagcaaaccatcatggataccatgatccgctatcagcgcatgcagggcaaaaacaccctgtggcaggtcggtactgaccacgccgggatcgctacccagatggtcgttgagcgcaagattgccgcagaagaaggtaaaacccgtcacgactacggccgcgaagctttcatcgacaaaatctgggaatggaaagcggaatcaggcggcaccattacccgtcagatgcgccgtctcggcaactccgtcgactgggagcgtgaacgcttcaccatggacgaaggcctgtccaatgcggtgaaagaagttttcgttcgtctgtataaagaagacctgatttaccgtggcaaacgcctggtaaactgggacccgaaactgcgcaccgctatctccgacctggaagtggaaaaccgcgaatcgaaaggttcgatgtggcacatccgctatccgctggctgacggcgcgaaaaccgcagacggtaaagattatctggtggttgcgactacccgtccggaaaccctgctgggcgatactggcgtggccgttaacccggaagatccgcgttataaagatctgattggcaaatatgtcattctgccactggttaaccgtcgtattccgatcgttggcgacgaacacgccgacatggaaaaaggcactggctgcgtgaagatcaccccagcgcacgactttaacgactatgaagtcggtaaacgtcacgccctgccgatgatcaacatcctgacctttgacggcgatatccgtgaaagcgcccaggtgttcgataccaaaggtaacgaatctgacgtttattccagcgaaatcccggcagagttccagaaactggagcgttttgctgcacgtaaagcagtcgttgctgcggttgacgcgctcggcctgctggaagaaattaaaccgcacgacctgaccgttccttatggcgaccgtggtggcgtggttatcgaaccgatgctgaccgaccagtggtacgtgcgtgccgatgtactggcgaaaccggcagttgaagcggttgagaatggcgacattcagttcgtaccgaagcagtacgaaaacatgtatttctcctggatgcgcgatattcaggactggtgtatctctcgtcagctatggtggggtcaccgtatcccggcatggtatgacgaagcgggtaatgtttatgttggccgcaacgaagacgaagtgcgtaaagaaaataacctcggtgctgatgttgcgctgcgtcaggatgaagacgttctcgacacctggttctcctccgcgctgtggactttctctacactcggctggccggaaaacaccgacgcactgcgccagttccacccaaccagcgtgatggtatctggttttgacatcatcttcttctggattgcccgcatgatcatgatgaccatgcacttcatcaaagatgaaaatggcaaaccgcaggtgccgttccacaccgtttacatgaccggcctgattcgtgatgacgaaggccagaagatgtccaaatccaaaggtaacgtgattgacccactggatatggttgacggtatttcgctgccggaactgctggaaaaacgtaccggcaatatgatgcagccgcagctggcggacaaaatccgtaagcgcaccgagaagcagttcccgaacggcattgagccgcacggtactgacgcgctgcgcttcaccctggcggcgctggcttctaccggtcgtgacatcaactgggatatgaagcgtctggaaggctaccgtaacttctgtaacaagctgtggaacgccagccgttttgtgctgatgaacacggaaggtcaggattgcggcttcaacggcggtgaaatgacgctgtcgctggcggatcgctggattctggcggagttcaaccagaccatcaaagcgtaccgcgaagcgctggacagcttccgcttcgatatcgccgcaggcattctgtatgaattcacctggaaccagttctgtgactggtatctggagctgaccaagccggtaatgaacggtggaacagaagccgaactgcgcggtactcgccatacgctggtgactgtactggaaggtctgctgcgcctcgcgcatccgatcattccgttcatcaccgaaaccatctggcagcgcgtgaaagtactttgcggtatcactgccgacaccatcatgctgcagccgttcccgcagtacgatgcgtctcaggttgatgaagcggcactggccgacaccgagtggctgaaacaggcgatcgttgctgtacgtaacatccgtgcagaaatgaacatcgcgccgggtaaaccgctggagctgctgctgcgtggttgcagcgcggatgcagaacgtcgcgtaaatgaaaaccgcggcttcctgcaaacgctggcgcgtctggaaagcatcaccgtgctgcctgctgatgataaaggtccggtttccgttacaaagatcgtcgacggcgcagaactgctgatcccgatggcaggcctcatcaacaaagaagatgagctggcacgtctggcgaaagaagtagcgaagatcgaaggcgaaatcagccgtattgagaacaagctggcgaacgaaggctttgtcgcccgcgcaccggaagcggtcatcgcgaaagagcgtgagaagctggaaggctacgcagaagcgaaagcgaagctgattgaacagcaggctgttatcgccgcgctgtaa

SEQ ID NO: 9802 - protein, 951 aa, Escherichia coli
MEKTYNPQDIEQPLYEHWEKQGYFKPNGDESQESFCIMIPPPNVTGSLHMGHAFQQTIMDTMIRYQRMQGKNTLWQVGTDHAGIATQMVVERKIAAEEGKTRHDYGREAFIDKIWEWKAESGGTITRQMRRLGNSVDWERERFTMDEGLSNAVKEVFVRLYKEDLIYRGKRLVNWDPKLRTAISDLEVENRESKGSMWHIRYPLADGAKTADGKDYLVVATTRPETLLGDTGVAVNPEDPRYKDLIGKYVILPLVNRRIPIVGDEHADMEKGTGCVKITPAHDFNDYEVGKRHALPMINILTFDGDIRESAQVFDTKGNESDVYSSEIPAEFQKLERFAARKAVVAAVDALGLLEEIKPHDLTVPYGDRGGVVIEPMLTDQWYVRADVLAKPAVEAVENGDIQFVPKQYENMYFSWMRDIQDWCISRQLWWGHRIPAWYDEAGNVYVGRNEDEVRKENNLGADVALRQDEDVLDTWFSSALWTFSTLGWPENTDALRQFHPTSVMVSGFDIIFFWIARMIMMTMHFIKDENGKPQVPFHTVYMTGLIRDDEGQKMSKSKGNVIDPLDMVDGISLPELLEKRTGNMMQPQLADKIRKRTEKQFPNGIEPHGTDALRFTLAALASTGRDINWDMKRLEGYRNFCNKLWNASRFVLMNTEGQDCGFNGGEMTLSLADRWILAEFNQTIKAYREALDSFRFDIAAGILYEFTWNQFCDWYLELTKPVMNGGTEAELRGTRHTLVTVLEGLLRLAHPIIPFITETIWQRVKVLCGITADTIMLQPFPQYDASQVDEAALADTEWLKQAIVAVRNIRAEMNIAPGKPLELLLRGCSADAERRVNENRGFLQTLARLESITVLPADDKGPVSVTKIVDGAELLIPMAGLINKEDELARLAKEVAKIEGEISRIENKLANEGFVARAPEAVIAKEREKLEGYAEAKAKLIEQQAVIAAL

SEQ ID NO: 9803 - DNA, 444 bp, Escherichia coli
atgaaaaacgcaacgttctaccttctggacaatgacaccaccgtcgatggcttaagcgccgttgagcagttggtgtgtgaaattgccgcagaacgttggcgcagtggtaagcgcgtactcatcgcctgtgaagatgaaaagcaggcttaccgactggatgaagccctgtgggcgcgtccggcagaaagctttgttccgcataatttagcgggagaaggaccgcgcggcggtgcgccggtggagatcgcctggccgcaaaagcgcagcagcagcccgcgcgatatattgattagtctgcgaacaagctttgcagattttgccaccgctttcacagaagtggtagacttcgttccttatgaagattctctgaaacaactggcgcgcgaacgctataaagcctaccgcgtggctggtttcaacctgaatacggcaacctggaaataa

SEQ ID NO: 9804 - protein, 147 aa, Escherichia coli
MKNATFYLLDNDTTVDGLSAVEQLVCEIAAERWRSGKRVLIACEDEKQAYRLDEALWARPAESFVPHNLAGEGPRGGAPVEIAWPQKRSSSPRDILISLRTSFADFATAFTEVVDFVPYEDSLKQLARERYKAYRVAGFNLNTATWK

SEQ ID NO: 9805 - DNA, 1512 bp, Escherichia coli
atggagtttagtgtaaaaagcggtagcccggagaaacagcggagtgcctgcatcgtcgtgggcgtcttcgaaccacgtcgcctttctccgattgcagaacagctcgataaaatcagcgatgggtacatcagcgccctgctacgtcggggcgaactggaaggaaaaccggggcagacattgttgctgcaccatgtgccgaatgtactttccgagcgaattctccttattggttgcggcaaagaacgtgagctggatgagcgtcagtacaagcaggttattcagaaaaccattaatacgctgaatgatactggctcaatggaagcggtctgctttctgactgaactgcacgttaaaggccgtaacaactactggaaagtgcgtcaggctgtcgagacggcaaaagagacgctctacagtttcgatcagttgaaaacgaacaagagcgaaccgcgtcgtccgctgcgtaaaatggtgttcaacgtgccgacccgccgtgagctgaccagcggtgaacgcgcgatccagcatggtctggcgattgccgcagggattaaagccgcgaaagatctcggcaatatgccaccgaatatctgtaacgctgcttacctcgcctctcaggcgcgccagttggctgacagctacagcaagaatgtcatcacccgcgttatcggcgaacagcagatgaaagagctggggatgcattcctatctggcggtcggtcagggttcgcaaaacgaatcgctgatgtcagtgattgagtacaaaggcaacgcgtcggaagatgcacgcccaatcgtgctggtgggtaaaggtttaaccttcgactccggcggtatctcgatcaagccttcagaaggcatggatgagatgaagtacgatatgtgcggtgcggcagcggtctacggcgtgatgcgtatggtcgcggagctacaactgccgattaacgttatcggcgtgctggcaggctgcgaaaacatgcctggcggtcgtgcctatcgtccgggcgatgtgttaaccaccatgtccggtcaaaccgtagaagtgctgaataccgacgccgaaggccgcctggtactgtgcgatgtgttaacttacgttgagcgttttgagccggaagcggtgattgacgtggcgacgctgaccggtgcctgcgtgatcgcgctgggtcatcatattactggtctgatggcgaaccataacccactggcccatgaactgattgccgcgtctgaacaatccggtgaccgtgcatggcgcttacctctgggcgacgagtaccaggaacaactggagtccaattttgccgatatggcgaacattggcggtcgtcctggtggggcgattaccgcaggttgcttcctgtcgcgctttacccgtaagtataactgggcgcacctggatatcgccggtactgcctggcgttctggtaaggcgaaaggcgcaaccggtcgcccggtggcgttgctggcacagttcctgctaaaccgcgccgggtttaacggcgaagagtaa

SEQ ID NO: 9806 - protein, 503 aa, Escherichia coli
MEFSVKSGSPEKQRSACIVVGVFEPRRLSPIAEQLDKISDGYISALLRRGELEGKPGQTLLLHHVPNVLSERILLIGCGKERELDERQYKQVIQKTINTLNDTGSMEAVCFLTELHVKGRNNYWKVRQAVETAKETLYSFDQLKTNKSEPRRPLRKMVFNVPTRRELTSGERAIQHGLAIAAGIKAAKDLGNMPPNICNAAYLASQARQLADSYSKNVITRVIGEQQMKELGMHSYLAVGQGSQNESLMSVIEYKGNASEDARPIVLVGKGLTFDSGGISIKPSEGMDEMKYDMCGAAAVYGVMRMVAELQLPINVIGVLAGCENMPGGRAYRPGDVLTTMSGQTVEVLNTDAEGRLVLCDVLTYVERFEPEAVIDVATLTGACVIALGHHITGLMANHNPLAHELIAASEQSGDRAWRLPLGDEYQEQLESNFADMANIGGRPGGAITAGCFLSRFTRKYNWAHLDIAGTAWRSGKAKGATGRPVALLAQFLLNRAGFNGEE

SEQ ID NO: 9807 - DNA, 129 bp, Escherichia coli
ttgacagaagaagatcaaaagcaagatgaagagtatcgccagctggcttttgagcgtctcccgcaccagatatcttatgattatcactttaaatacgcccgtaaaaactcgtcttttgcaggattttag

SEQ ID NO: 9808 - protein, 42 aa, Escherichia coli
MTEEDQKQDEEYRQLAFERLPHQISYDYHFKYARKNSSFAGF

SEQ ID NO: 9809 - DNA, 1032 bp, Escherichia coli
ttgatcttcttctgtcaaaagttagtgaggatcctcggcgcagcggttgacggcgatattccggcgaacttggtgctctcccttctcgggttgggcgtgccggaaatggcgcagcttatcctgccattaagcctgttcctcgggctgctgatgacgctgggcaaactgtataccgaaagtgaaattacggtaatgcatgcctgcggtctgagcaaagcggtgctggtgaaagcggcaatgatccttgcggtgttcacggcaatcgtcgcggcggttaacgtgatgtgggcgggaccatggtcatcgcgtcatcaggatgaagtgttagcagaagcgaaagcgaaccctggcatggcggcgctggcgcaagggcaattccagcaagcgactaatggcagctcggtgctgttcatcgaaagcgttgacggcagcgatttcaaagatgtgttcctcgcgcaaattcgaccaaaaggtaatgcacgaccttctgtggtggtggccgattccggacatttaacccagctgcgcgacggctcccaggtcgtcactctcaaccagggaacgcgcttcgaaggcactgcactgttacgtgatttccgcattacggatttccaggattatcaggcgatcattggtcaccaggcggtggcgctcgacccgaacgataccgaccagatggacatgcgcacattgtggaacactgacaccgatcgtgctcgcgcagaactgaactggcgtatcacgttggtgttcaccgtgtttatgatggcacttatggtcgtaccgctgagcgtggttaacccgcgtcaggggcgcgtactatcgatgctgccagccatgctgctgtatctgttgttcttcctgatccagacctccctgaaatcgaacggcggtaaaggtaagctggacccgacgctgtggatgtggaccgttaacctgatttatctggctttggcgattgttctcaacctttgggacaccgtgccggtccgccgcctgcgcgccagtttttcgcgtaaaggagcggtgtga

SEQ ID NO: 9810 - protein, 343 aa, Escherichia coli
MIFFCQKLVRILGAAVDGDIPANLVLSLLGLGVPEMAQLILPLSLFLGLLMTLGKLYTESEITVMHACGLSKAVLVKAAMILAVFTAIVAAVNVMWAGPWSSRHQDEVLAEAKANPGMAALAQGQFQQATNGSSVLFIESVDGSDFKDVFLAQIRPKGNARPSVVVADSGHLTQLRDGSQVVTLNQGTRFEGTALLRDFRITDFQDYQAIIGHQAVALDPNDTDQMDMRTLWNTDTDRARAELNWRITLVFTVFMMALMVVPLSVVNPRQGRVLSMLPAMLLYLLFFLIQTSLKSNGGKGKLDPTLWMWTVNLIYLALAIVLNLWDTVPVRRLRASFSRKGAV

SEQ ID NO: 9811 - DNA, 138 bp, Escherichia coli
ttgctaacaataataaagggagctttcgctccctttattcgttcattcggttacgattttctcattaacagccacaggctgattaagaagaagctggcgcttggcaacagtgcgccgatgatcggcgggatgccgtaa

SEQ ID NO: 9812 - protein, 45 aa, Escherichia coli
MLTIIKGAFAPFIRSFGYDFLINSHRLIKKKLALGNSAPMIGGMP

SEQ ID NO: 9813 - DNA, 1083 bp, Escherichia coli
atgcaaccttttggcgtacttgaccgctatatcggtaaaactattttcaccaccatcatgatgacgctgttcatgctggtgtcgctgtccggcattatcaagtttgtcgatcagctgaaaaaagccgggcaggggagttacgacgcgttaggcgcaggaatgtataccttgctgagcgtgccgaaagatgtgcaaatcttcttcccgatggcggctctgcttggggcgttgcttggtcttgggatgctggcgcagcgcagcgaactggtggtgatgcaggcttctggttttacccgtatgcaggtggcgctgtcggtgatgaaaaccgccattccgctggtcttgctgacgatggcgattggtgaatgggtcgcgccgcagggcgagcagatggcgcgtaactaccgtgcgcaggcgatgtacggcggctcgttgctctctacccagcaaggtttatgggcgaaagatggcaacaacttcgtctacattgagcgggttaaaggtgacgaagagttaggtggcatcagtatttatgcctttaacgagaatcgtcgtctgcaatccgtacgctatgccgctgccgcgaagtttgacccggaacataaagtctggcgtctgtcgcaggttgatgaatctgatttgaccaatccgaaacagatcaccggttcgcagacggtgagcggcacctggaaaaccaacctcacgccagacaaactgggcgtggtggcgctggacccggatgcactctctatcagcggtttgcacaactatgtgaagtatctgaagtcgagcggtcaggatgccggacgttatcagctcaacatgtggagcaaaatcttccagccgctatccgtggcggtgatgatgctgatggcgctgtcgttcatctttggcccactgcgtagcgtaccgatgggcgtgcgtgtggtcactggtattagcttcggttttgtcttctacgtactggaccagatcttcggcccgctgacgttggtttacggcatcccgccgatcatcggcgcactgttgccaagcgccagcttcttcttaatcagcctgtggctgttaatgagaaaatcgtaa

SEQ ID NO: 9814 - protein, 360 aa, Escherichia coli
MQPFGVLDRYIGKTIFTTIMMTLFMLVSLSGIIKFVDQLKKAGQGSYDALGAGMYTLLSVPKDVQIFFPMAALLGALLGLGMLAQRSELVVMQASGFTRMQVALSVMKTAIPLVLLTMAIGEWVAPQGEQMARNYRAQAMYGGSLLSTQQGLWAKDGNNFVYIERVKGDEELGGISIYAFNENRRLQSVRYAAAAKFDPEHKVWRLSQVDESDLTNPKQITGSQTVSGTWKTNLTPDKLGVVALDPDALSISGLHNYVKYLKSSGQDAGRYQLNMWSKIFQPLSVAVMMLMALSFIFGPLRSVPMGVRVVTGISFGFVFYVLDQIFGPLTLVYGIPPIIGALLPSASFFLISLWLLMRKS

SEQ ID NO: 9815 - DNA, 1503 bp, Escherichia coli
atgagcgaacccctgttaattgcccgcacgccggacacagaactgtttttactgccgggaatggctaaccgccatgggctgattaccggcgcaacggggacgggtaaaaccgttacgctgcaaaaactggcggagtcattgtcggaaatcggcgtgcctgtgtttatggctgatgtgaaaggtgatttaacgggagttgcggaggaaggtacatcttcggaaaaactgctcgcaaggcttaaaaatatcggcgtaaatgactggcaacctcatactaatccggtggtggtgtgggatatctttggcgagaaaggccatccggtgcgggcgacggtttcggatctggggccgctgttgctggcacgactgttgaatctcaacgatgtgcaatctggcgtgctgaatatcattttccgcattgctgacgatcagggattgttgctgctcgactttaaagatctgcgggcaattacccagtacatcggcgataacgccaaatccttccagaatcagtacggtaatatcagtagtgcatcggttggtgccatccagcgcgggctgttgtcgctggaacagcaaggcgcagcacacttctttggtgagccgatgctggatatcaaagactggatgcgcaccgatgccaacggtaaaggcgttatcaatatcctcagcgccgagaagctctaccagatgccgaaactgtacgccgccagcctgctgtggatgctttcagagttgtatgaacaattgccggaagcgggcgatctggagaaaccaaaactggtgtttttcttcgacgaagcgcatctgctgtttaacgatgcaccgcaggtactgctggataagattgagcaggtgataaggcttattcgctcaaaaggcgtgggcgtctggttcgtttcgcaaaacccgtcagatatcccggataacgtgctcgggcagctcggtaatcgcgttcaacacgctttgcgtgcttttacgcctaaagatcagaaagcagtgaaggcagcggcgcaaaccatgcgggccaatccaacatttgataccgaaaaggcaatccaggaactggggacgggcgaagcgttaatctcgtttctcgatgcgaaaggaagcccttcagtggtggaacgggcgatggtgattgccccctgttcacgaatggggccggtgacggaagatgagcgcaatggcttgattaaccactccccggtgtatggcaagtacgaggatgacgtggaccgggaatccgcctatgagatgttgcaaaaaggctttcaggccagtatcgagcagcaaaataatcctcccgcgaaagggaaagaggtggcggtggatgacggtattctcggtggattgaaggatattttgtttggcactaccggaccacgcggcgggaagaaagatggtgtggtgcaaacaatggcaaaaagcgccgcccgccaggtgacgaatcagattgtgcgcgggatgttggggagtttgctgggggggagaagaaggtaa

SEQ ID NO: 9816 - protein, 500 aa, Escherichia coli
MSEPLLIARTPDTELFLLPGMANRHGLITGATGTGKTVTLQKLAESLSEIGVPVFMADVKGDLTGVAEEGTSSEKLLARLKNIGVNDWQPHTNPVVVWDIFGEKGHPVRATVSDLGPLLLARLLNLNDVQSGVLNIIFRIADDQGLLLLDFKDLRAITQYIGDNAKSFQNQYGNISSASVGAIQRGLLSLEQQGAAHFFGEPMLDIKDWMRTDANGKGVINILSAEKLYQMPKLYAASLLWMLSELYEQLPEAGDLEKPKLVFFFDEAHLLFNDAPQVLLDKIEQVIRLIRSKGVGVWFVSQNPSDIPDNVLGQLGNRVQHALRAFTPKDQKAVKAAAQTMRANPTFDTEKAIQELGTGEALISFLDAKGSPSVVERAMVIAPCSRMGPVTEDERNGLINHSPVYGKYEDDVDRESAYEMLQKGFQASIEQQNNPPAKGKEVAVDDGILGGLKDILFGTTGPRGGKKDGVVQTMAKSAARQVTNQIVRGMLGSLLGGRRR

SEQ ID NO: 9817 - DNA, 999 bp, Escherichia coli
atgcgcaatcacagaatttctttacaggatatcgctacgctggctggcgtaacaaaaatgaccgtgagtcgttatatccgctcgccgaaaaaggtggcaaaggaaacaggcgagcgcatcgccaaaattatggaagagatcaattatatccctaatcgcgctcccggcatgttgttgaatgcacaaagttataccctcggtatcttgattccgtcatttcaaaatcaactcttcgctgacattctcgcgggaatagaatccgtcacctctgtgcataattatcagaccattattgctaattacaattacgatcgcgattccgaagaagagtcggtgattaacctgctctcttataacattgacgggattattctttcggaaaaatatcacaccatcaggacggtgaaatttctgcgttcagccaccattccggtcgtggaattgatggatgtacagggagaacggctggatatggaggtcggttttgataatcggcaggctgcttttgacatggtgtgtaccatgctggataagcgagtcaggcgcaaaattctgtatctcggttccaaagatgacacccgcgatgaacagcgttatcaggggtattgcgatgcgatgatgctgcataatctttccccattacgcatgaatccacgcgccatctcatccattcatttaggaatgcagttaatgcgtgatgcccttagcgcaaacccggatttagacggtgtattttgcaccaatgacgatattgcgatgggtgcgcttctgctgtgccgcgagcgaaacctcgccgtgccagaacaaatttccattgcgggttttcatgggctggagattggcaggcaaatgatcccaagcctcgccagcgtaattactccccgttttgatattggtcggatggccgcccaaatgttgctgagcaaaattaagaataacgatcacaaccacaacactgttgacctcgggtatcagatttatcacggtaacacgctttag

SEQ ID NO: 9818 - protein, 332 aa, Escherichia coli
MRNHRISLQDIATLAGVTKMTVSRYIRSPKKVAKETGERIAKIMEEINYIPNRAPGMLLNAQSYTLGILIPSFQNQLFADILAGIESVTSVHNYQTIIANYNYDRDSEEESVINLLSYNIDGIILSEKYHTIRTVKFLRSATIPVVELMDVQGERLDMEVGFDNRQAAFDMVCTMLDKRVRRKILYLGSKDDTRDEQRYQGYCDAMMLHNLSPLRMNPRAISSIHLGMQLMRDALSANPDLDGVFCTNDDIAMGALLLCRERNLAVPEQISIAGFHGLEIGRQMIPSLASVITPRFDIGRMAAQMLLSKIKNNDHNHNTVDLGYQIYHGNTL

SEQ ID NO: 9819 - DNA, 1320 bp, Escherichia coli
atgccattaatcattattgcggcaggcgtcgcgctgcttcttatcctgatgatcggctttaaagttaacggctttattgccctcgttctggtcgctgccgtcgtcggatttgccgaagggatggatgcacaggccgtcctgcactctatacaaaatggtatcggcagcacgctcggcgggctggcaatgatcctcggtttcggggccatgttaggcaagctgatttctgatacgggtgcggcacaacgtatcgccactacgctgattgccacttttggtaaaaaacgcgtgcaatgggcgctagtgatcaccggtctggttgtgggcctcgccatgttttttgaagtgggctttgtcctgctgttgccgttggtatttaccatcgtggcatcatctggattacccctgttgtatgttggcgtaccgatggtagcagcgctctctgtaacccactgttttctgccgccacatccagggcctactgccatcgcgactatctttgaggctaatctcggaacgactttactgtatggatttatcattaccattccgacagttattgtcgcaggaccgctgttttctaaactgctaactcgctttgagaaagcaccaccggaaggcttatttaatcctcatctgtttagcgaagaggagatgccctccttctggaacagtattttcgctgccgtgatcccggtcatcctgatggctatcgccgccgtttgtgaaattacgttaccgaaaactaacaccgtgcgcctcttctttgaatttgtcggtaaccctgccgttgcgctgtttattgccattgttattgcgattttcacactgggccgacgtaatggacgcaccatcgagcaaatcatggatatcattggggattctataggcgctatcgcgatgattgtgtttattatcgctggcggcggcgcgtttaagcaggtattagtagatagcggtgtcgggcagtatatttcacacttaatgaccggaactacactttcgccgttattgatgtgctggactgtcgcggcgctgttgcgtatcgctctgggctctgccaccgtcgcggccattaccaccgcgggtgtggtgttgccgattatcaacgttacccatgccgatcccgctttaatggtactggcaaccggtgcgggcagcgtgatcgcgtcacacgtaaacgaccctggcttctggctatttaaagggtattttaatctgacggttggtgaaacgttgcgtacctggacggtgatggaaacccttatttctattatgggtttgctgggcgtgttagccattaacgtcgtattgcactga

SEQ ID NO: 9820 - protein, 439 aa, Escherichia coli
MPLIIIAAGVALLLILMIGFKVNGFIALVLVAAVVGFAEGMDAQAVLHSIQNGIGSTLGGLAMILGFGAMLGKLISDTGAAQRIATTLIATFGKKRVQWALVITGLVVGLAMFFEVGFVLLLPLVFTIVASSGLPLLYVGVPMVAALSVTHCFLPPHPGPTAIATIFEANLGTTLLYGFIITIPTVIVAGPLFSKLLTRFEKAPPEGLFNPHLFSEEEMPSFWNSIFAAVIPVILMAIAAVCEITLPKTNTVRLFFEFVGNPAVALFIAIVIAIFTLGRRNGRTIEQIMDIIGDSIGAIAMIVFIIAGGGAFKQVLVDSGVGQYISHLMTGTTLSPLLMCWTVAALLRIALGSATVAAITTAGVVLPIINVTHADPALMVLATGAGSVIASHVNDPGFWLFKGYFNLTVGETLRTWTVMETLISIMGLLGVLAINVVLH

SEQ ID NO: 9821 - DNA, 765 bp, Escherichia coli
atgaacgatctattttcactggcaggaaaaaatatcttgattaccggttcagcacagggcattggctttttactggcaaccggcctgggtaaatatggcgcacaaataattattaatgatattactgccgaacgcgcagaacttgctgtagaaaaactccaccaggagggtattcaggccgttgccgcaccttttaatgttactcataaacatgaaattgatgccgccgttgaacatatcgaaaaggacatcggccccattgatgtgctggtgaataacgccggtatccagcgccgtcatccttttactgagttccctgaacaagagtggaatgatgtgatcgcagtaaaccagaccgccgtgttcctggtatcgcaagcggtaactcgtcacatggttgaacgcaaggcaggtaaagttattaatatttgctcgatgcaaagcgaactgggacgtgacaccatcaccccttatgccgcatcgaaaggggcggtaaaaatgctcacccgcggcatgtgcgtcgagctggcgcgccacaatattcaggtcaacggtattgcgccgggctatttcaaaacagaaatgactaaagcactggttgaggacgaagccttcaccgcctggttgtgcaaacggacccccgccgcacgctggggagatccgcaggaactgattggtgctgcggtgttcctttcttcaaaagcctctgatttcgtaaacggccacctgttgtttgttgatggcggcatgttagtggctgtttaa

SEQ ID NO: 9822 - protein, 254 aa, Escherichia coli
MNDLFSLAGKNILITGSAQGIGFLLATGLGKYGAQIIINDITAERAELAVEKLHQEGIQAVAAPFNVTHKHEIDAAVEHIEKDIGPIDVLVNNAGIQRRHPFTEFPEQEWNDVIAVNQTAVFLVSQAVTRHMVERKAGKVINICSMQSELGRDTITPYAASKGAVKMLTRGMCVELARHNIQVNGIAPGYFKTEMTKALVEDEAFTAWLCKRTPAARWGDPQELIGAAVFLSSKASDFVNGHLLFVDGGMLVAV

SEQ ID NO: 9823 - DNA, 1032 bp, Escherichia coli
atgcaagtgaaaacacagtcctgcgttgttgcgggcaagaaaactgttgccgttaccgagcagacgatagattggaataataatggaacattagtacaaataacccgaggtggaatttgcggttccgatttacattattatcaggaaggaaaagtaggtaatttcatgataaaggcaccgatggtgttaggtcatgaagttatcggtaaagttattcatagcgactcatcaaaattacatgaagggcaaacggtagccattaatccgtctaaaccgtgcggtcactgcaaatactgcattgaacataacgagaatcagtgtacagagatgcgtttttttggcagtgccatgtatttccctcatgttgatggtggctttacccgttataaaatggtcgaaacgtcgcaatgtgtcccttatccggccaaagctgacgaaaaggttatggcttttgccgaacctttagccgtcgcgattcatgccgcacatcaggccggcgagttacagggcaagcgagtatttatttctggtgttgggcccattggctgcctgattgtcagtgctgttaaaacactgggggccgcggaaattgtctgtgccgatgtgagtccccgttccctttcgctgggcaaagagatgggggcggatgtgctcgtaaacccacaaaacgacgacatggatcactggaaagcggaaaaaggctatttcgatgtcagctttgaagtgtccggtcatccttcatcagtgaatacctgtctggaggtcactcgtgcacgcggcgtaatggtgcaggtagggatgggaggcgcgatggcagaattcccaatgatgacgttgattggtaaggagatttcactcaaaggctctttccgttttaccagcgaatttaatacctcagtgtcatggctggcgaatggcgttattaatccactgcctttactgagtgctgaatatcccttcacagacctggaagaggcgctacgtttcgccggtgataaaacccaggcagcaaaagtccagcttgttttctaa

SEQ ID NO: 9824 - protein, 343 aa, Escherichia coli
MQVKTQSCVVAGKKTVAVTEQTIDWNNNGTLVQITRGGICGSDLHYYQEGKVGNFMIKAPMVLGHEVIGKVIHSDSSKLHEGQTVAINPSKPCGHCKYCIEHNENQCTEMRFFGSAMYFPHVDGGFTRYKMVETSQCVPYPAKADEKVMAFAEPLAVAIHAAHQAGELQGKRVFISGVGPIGCLIVSAVKTLGAAEIVCADVSPRSLSLGKEMGADVLVNPQNDDMDHWKAEKGYFDVSFEVSGHPSSVNTCLEVTRARGVMVQVGMGGAMAEFPMMTLIGKEISLKGSFRFTSEFNTSVSWLANGVINPLPLLSAEYPFTDLEEALRFAGDKTQAAKVQLVF

SEQ ID NO: 9825 - DNA, 564 bp, Escherichia coli
atggcgggtgaaagctttattttgatgggcgtttcagggagtggtaaaacattaattggtagcaaggttgccgcgttattatctgctaaatttattgatggtgacgatcttcatccagccaaaaatatagataaaatgtcgcagggtattccattatctgatgaagatcgacttccctggctggaacgcttaaatgatgcttcatacagtctttataaaaagaatgaaacaggatttattgtctgttcatcattaaaaaaacagtatcgtgatattttacgcaagggtagcccccatgttcatttcctctggttagatggcgactatgaaactattctcgcgcgaatgcagcgtcgggctgggcattttatgccggtagcgttactaaaaagtcagtttgaggcactggagcgtccacaagacgatgaacaggatattgtgcgcattgatatcaaccatgatattgccaatgtcaccgaacaatgtcggcaggctgtgctggcgatacgacaaaacagaatatgtgcgaaagagggctgcgcctcagatcagcgctgcgaatga

SEQ ID NO: 9826 - protein, 187 aa, Escherichia coli
MAGESFILMGVSGSGKTLIGSKVAALLSAKFIDGDDLHPAKNIDKMSQGIPLSDEDRLPWLERLNDASYSLYKKNETGFIVCSSLKKQYRDILRKGSPHVHFLWLDGDYETILARMQRRAGHFMPVALLKSQFEALERPQDDEQDIVRIDINHDIANVTEQCRQAVLAIRQNRICAKEGCASDQRCE

SEQ ID NO: 9827 - DNA, 1062 bp, Escherichia coli
atgctctacacttcccagacaacaccagagaaggaccaaaaaatgtcgatgataaaaagctatgccgcaaaagaagcgggcggcgaactggaagtttatgagtacgatcccggtgagctgaggccacaagatgttgaagtgcaggtggattattgcgggatctgccattccgatctatcgatgatcgacaatgaatggggattttcacaatatccgctgattgccgggcatgaggtgattggtcgcgtggtggcgctcgggagcgccgcgcaggataaaggtttgcaggtcggtcagcgtgtcgggattggctggacggcgcgtagctgcgggcattgcgatgcctgtattagcggtaatcagatcaactgcgagcaaggtgcggtgccaacaattatgaatcgcggcggttttgccgagaagttgcgtgcagactggcaatgggtgatcccactgccggaaaatatcgatatcgagtccgccgggccgctgctgtgtggtggtatcacggtctttaaaccactgttgatgcaccatatcactgctaccagccgcgttggggtaattggtattggcgggctgggacatatcgctataaaacttctgcacgcaatgggatgcgaggtgacagcctttagttcaaatccggcgaaagagcaggaagtactggcgatgggtgccgataaagtggtgaatagccgcgatccgcaggcactgaaaactctggcggggcagtttgatctcattatcaatactgtgaacgtcagcctcgactggcagccttattttgaggcgctgacgtatggcggtaatttccacaccgtcggtgcggttctcacgccgttgccggttccggcctttacgctgattgcgggcgatcgcagtgtctctggctctgctaccggtacaccttatgagttgcgtaagctgatgcgctttgccgcccgcagcaaggttgcgccgactaccgaactgttcccgatgtcgaaaattaacgacgccatccagcatgtgcgcgacggtaaggcgcgttaccgcgtggtgttgaaagccgatttttga

SEQ ID NO: 9828 - protein, 353 aa, Escherichia coli
MLYTSQTTPEKDQKMSMIKSYAAKEAGGELEVYEYDPGELRPQDVEVQVDYCGICHSDLSMIDNEWGFSQYPLIAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKTLAGQFDLIINTVNVSLDWQPYFEALTYGGNFHTVGAVLTPLPVPAFTLIAGDRSVSGSATGTPYELRKLMRFAARSKVAPTTELFPMSKINDAIQHVRDGKARYRVVLKADF

SEQ ID NO: 9829 - DNA, 1269 bp, Escherichia coli
atgaagctcaacgccagacaggtcgagaccgcaaagccaaaagacaaaacctacaaaatggccgatggtggtggtttgtatcttgaggtttcggccaaaggttccaaatactggcgcatgaaatacagacgtccctctgacaaaaaagaggatcgtcttgcgtttggtgtttggcctactgtgacgcttgctcaggcaagagcaaaacgcgatgaagctaaaaagcttttagtacagggcatagacccaaaagtcgtacaaaaagaagctcgggccgagaattcgggggcatatacttttgaagctatcgcccgagaatggcatgccagtaacaagcgctggagtgaagaccatcgatcgcgcgttcttcgctatcttgagctttatatattccctcatatcggttcgtccgacattcggcagcttaaaaccagccacctgttagccccgattaaaaaagttgatgccagtggcaaacacgatgtcgctcagcgcctgcaacagcgcgtcacagccattatgcgttatgccgtacagaacgattacatcgactcaaatccagccagcgatatggctggtgcgctatcgacaaccaaagcgcgacattaccctgctttaccttctagccgattccctgagtttcttgcacgtcttgctgcatatcgtggccgtgtaatgacacggattgcggtcgagctttccttgctaacttttgtgcgttccagtgaattacgtttcgcacgttgggatgaattcgacttcgataaatctctttggcgtatacctgcaaagcgagaagaaattaaaggtgtgcgttattcgtaccgaggcatgaagatgaaagaggaacatatcgttccgcttagtcgacaggcgatgattttattaaaccagttaaagcagattagtggtgataaagagctgctttttccgggggatcatgacgcaactaaggttatgagtgaaaacacggtaaacagcgcattgcgtgcgatgggctatgatactaaaaccgaggtgtgtgggcatggatttaggactatggcgcgtggtgcgttgggggagtcggggttatggagtgatgacgcgatagagaggcaactgagccactcagagcgtaataatgtacgtgcggcatatatccatacctccgagcatttggatgagcggcgtttaatgatgcagtggtgggctgattatttggatatgaaccgtaataaatatattacgccttatgattattcaaaatacaaagaaatacttaaataa

SEQ ID NO: 9830 - protein, 422 aa, Escherichia coli
MKLNARQVETAKPKDKTYKMADGGGLYLEVSAKGSKYWRMKYRRPSDKKEDRLAFGVWPTVTLAQARAKRDEAKKLLVQGIDPKVVQKEARAENSGAYTFEAIAREWHASNKRWSEDHRSRVLRYLELYIFPHIGSSDIRQLKTSHLLAPIKKVDASGKHDVAQRLQQRVTAIMRYAVQNDYIDSNPASDMAGALSTTKARHYPALPSSRFPEFLARLAAYRGRVMTRIAVELSLLTFVRSSELRFARWDEFDFDKSLWRIPAKREEIKGVRYSYRGMKMKEEHIVPLSRQAMILLNQLKQISGDKELLFPGDHDATKVMSENTVNSALRAMGYDTKTEVCGHGFRTMARGALGESGLWSDDAIERQLSHSERNNVRAAYIHTSEHLDERRLMMQWWADYLDMNRNKYITPYDYSKYKEILK

SEQ ID NO: 9831 - DNA, 705 bp, Escherichia coli
  n 686, 687, 688, 689, 690: n is any nucleotide
gtgattaacatggctgagttattgcgagagcaggaagttaaaatagccctaattgaatggttatataaaaaaggcatgcttagtgatgcaacgatcattaatgaaatggttgttgctaactggagcagaagagctgatttggctattgccaatggaagcctacaagcttttgaaataaaaagcgattttgactctcttaagcgattggatggtcagttaaaaatttttaaatctagcttcgaaaaagttacaattgtgtgcgcgccaaaatttaccagtgaagtatctaaacgggtttcatcagatgttggcgttgtagaatttcaatctaataatagtagcgtacgctttaaaataattcaaaaaggaagggtttgctctcgcttaaataaatttgtttatttgggttttttgcttaagtctgagcttaaagatctgcttaatcagtatggaattacattttcaaatgaactacatagggattgtcttgaggttttggcatctaagttatctttaaacaagattagagaatttgtcattacatctattaaaaataggtatcatgcgacatctaatgattttttatctagactccatggtaatcaagaaatatctataaacgatcttgccttattgagcaaagctaaaagaaggaataattctttggttaagtttgagtttaaggnnnnncattccattcattaa

SEQ ID NO: 9832 - protein, 234 aa, Escherichia coli
  Xaa 229, 230: Xaa is any amino acid
MINMAELLREQEVKIALIEWLYKKGMLSDATIINEMVVANWSRRADLAIANGSLQAFEIKSDFDSLKRLDGQLKIFKSSFEKVTIVCAPKFTSEVSKRVSSDVGVVEFQSNNSSVRFKIIQKGRVCSRLNKFVYLGFLLKSELKDLLNQYGITFSNELHRDCLEVLASKLSLNKIREFVITSIKNRYHATSNDFLSRLHGNQEISINDLALLSKAKRRNNSLVKFEFKXXHSIH

SEQ ID NO: 9833 - DNA, 930 bp, Escherichia coli
  n 912, 913, 914, 915, 916: n is any nucleotide
atgaaagtatattttgaaaattactcatactatccagccctaagaacacgatcagcagaaatgaccggactgaataatttatcatatgagaataagaaaaaaatattacctttaatttctttggggaaatggcctcgctcggaagaaatacaggtatcgttagataaaagtttagaagtgatgagtaatctcccatttattttggatgtcacaaaggataattctcatcattgcgcgtcaagcttcgaactactctctcctgagaatggttttaaaaactggatagagttttgttccagaaatgataatattattccagtagtccagatgccggattcagcaaaacttagagatatatctatccaagccagggttttagaggaacttaaaggttcaattgcatttagaattagaaatctaaatacagacattaataaaaccctgacgtcactagtatcgatgaactctccagaaaatgccatagttttcatagatttgggctacattagagggaatgtatctgctataacagctgcagcaataaattcgattaatcagattagaactgagattcctgaagccataattagtgtgctagcaacaagcttccctagttcagttacaaatttttgccgtgaaaatggacagtccggatatattgatgttattgagagagaattgcatcaaaatattggtggaagtgatgtcgctatttatggcgatcatggttcaattcattcagtagtgtatgacaacataattgggcgatatgttcctagaattgatatagcgttaaatgattcatggtatttcgagcgccgccctgggatgaataaagaagggttcattgaagctgcgaaatcaattttggcagagtatccacattatccaagggaggactcttggggagcnnnnncattcattcattaa

SEQ ID NO: 9834 - protein, 309 aa, Escherichia coli
  Xaa 305, 306: Xaa is any amino acid
MKVYFENYSYYPALRTRSAEMTGLNNLSYENKKKILPLISLGKWPRSEEIQVSLDKSLEVMSNLPFILDVTKDNSHHCASSFELLSPENGFKNWIEFCSRNDNIIPVVQMPDSAKLRDISIQARVLEELKGSIAFRIRNLNTDINKTLTSLVSMNSPENAIVFIDLGYIRGNVSAITAAAINSINQIRTEIPEAIISVLATSFPSSVTNFCRENGQSGYIDVIERELHQNIGGSDVAIYGDHGSIHSVVYDNIIGRYVPRIDIALNDSWYFERRPGMNKEGFIEAAKSILAEYPHYPREDSWGAXXFIH

SEQ ID NO: 9835 - DNA, 573 bp, Escherichia coli
atggaaagcacagccttacagcaggcctttgacacgtgtcagaataacaaagcagcatggctgcaacgcaaaaatgagctggctgcggccgaacaggaatatctgcggcttctgtcaggagaaggcagaaacgtcagtcgccttgacgaattacgcaatattatcgaagtcagaaaatggcaggtgaatcaggccgccggtcgttatattcgttcgcatgaagccgttcagcacatcagcatccgcgaccggctgaatgattttatgcagcagcacggcacagcactggcggcggcactggcaccggagctgatgggctacagtgagctgacggccattgcccgaaactgtgccatacagcgtgccacagatgccctgcgtgaagcccttctgtcctggcttgcgaagggggaaaaaattaattattccgcacaggatagcgacattttaacggccatcggattcaggcctgacgcggcttcggtggatgacagccgtgaaaaattcactcctgcgcagaacatgattttttcgcgtaaaagtgcgcaactggcatcacgtcagtctgtgtaa

SEQ ID NO: 9836 - protein, 190 aa, Escherichia coli
MESTALQQAFDTCQNNKAAWLQRKNELAAAEQEYLRLLSGEGRNVSRLDELRNIIEVRKWQVNQAAGRYIRSHEAVQHISIRDRLNDFMQQHGTALAAALAPELMGYSELTAIARNCAIQRATDALREALLSWLAKGEKINYSAQDSDILTAIGFRPDAASVDDSREKFTPAQNMIFSRKSAQLASRQSV

SEQ ID NO: 9837 - DNA, 501 bp, Escherichia coli
atgatttactgcccgtcgtgtggacatgttgctcacacccgccgcgcacatttcatggacgatggcaccaagataatgattgcacagtgccggaatatttattgctctgcgacatttgaagcgagtgaaagctttttctctgactgtaaagattcaggaatggaatacatttcaggcaaacagagataccgcgattcactgacgtcagcctccggtagcatgaaacgcccgaaaagaatgcttgttaccggatattgttgtcggagatgtaaaggccttgcactgtcaagaacatcgcggcgtctgtctcaggaagtcaccgagcgtttttatgtgtgcacggatccgggctgtggtctggtgtttaaaacgcttcagaccatcaaccgcttcattgtccgcccggtcacaccggacgaactggcagaacgcctgcatgaaaaacaggaactgccgccagtacggttaaaaacacaatcatattcgctgcgtctggaatga

SEQ ID NO: 9838 - protein, 166 aa, Escherichia coli
MIYCPSCGHVAHTRRAHFMDDGTKIMIAQCRNIYCSATFEASESFFSDCKDSGMEYISGKQRYRDSLTSASGSMKRPKRMLVTGYCCRRCKGLALSRTSRRLSQEVTERFYVCTDPGCGLVFKTLQTINRFIVRPVTPDELAERLHEKQELPPVRLKTQSYSLRLE

SEQ ID NO: 9839 - DNA, 735 bp, Escherichia coli
atgtctgacaacaccatccctgaatatctgcaacccgcactggcacaactggaaaaggccagagccgcccaccttgagaacgcccgcctgatggatgagaccgtcacggccattgaacgggcagagcaggaaaaaaatgcgctgacgcaggccgacggaaacgacgctgacgactggcgcacggcctttcgtgcagccggtggtgtcctgagcgacgagctgaaacagcgccacattgagcgcgtggcacgccgggagctggtacaggaatatgacaatctggccgtggtgctgaatttcgaacgtgaacgcctgaaaggggcgtgtgacagcacggccaccgcctaccggaaggcacatcatcaccttctgagtctgtatgcagggcatgagctggaacacgccctgaatgaaacctgtgaggcgcttgtccgggcaatgcatctgagcattctggtacaggaaaatccgctcgccaacaccaccggccatcagggctacatcgcacccgataaagctgtcatgcagcaggtgaaatcatcgctggaacagaaaataaaacagatgcaaatcagcctcaccggcgagccggttctccggctgaccggactgtcagcggcaacactcccgcacatggattatgaggtggcaggcacaccggcacagcgcaaggtgtggcaggacaaaatagaccagcagggagcagagcttaaggccagaggactgctgtcatga

SEQ ID NO: 9840 - protein, 244 aa, Escherichia coli
MSDNTIPEYLQPALAQLEKARAAHLENARLMDETVTAIERAEQEKNALTQADGNDADDWRTAFRAAGGVLSDELKQRHIERVARRELVQEYDNLAVVLNFERERLKGACDSTATAYRKAHHHLLSLYAGHELEHALNETCEALVRAMHLSILVQENPLANTTGHQGYIAPDKAVMQQVKSSLEQKIKQMQISLTGEPVLRLTGLSAATLPHMDYEVAGTPAQRKVWQDKIDQQGAELKARGLLS

SEQ ID NO: 9841 - DNA, 267 bp, Escherichia coli
atgcaagctgttttttcttccccgtctcccgcccctgtgacgccactgatgccgctgccggacattacacaggagcgttttttacgtcttccggaagtgatgcacctgtgcggcctgtcacgctcgaccatctatgaactcatccgtaagggggaatttccgccgcaggtgagtcttggcggtaaaaatgtggcctggctgcactctgaagtcaccgcatggatggccggccgcattgccggacgcaaacgggggtacgacgcatga

SEQ ID NO: 9842 - protein, 88 aa, Escherichia coli
MQAVFSSPSPAPVTPLMPLPDITQERFLRLPEVMHLCGLSRSTIYELIRKGEFPPQVSLGGKNVAWLHSEVTAWMAGRIAGRKRGYDA

SEQ ID NO: 9843 - DNA, 600 bp, Escherichia coli
atgatgatgcctgttctgcaaaaagtccctttttctggcttgcctttttccggcatttgcggatatagtttttccgctgccgcaaaatcggcagccgggcgtggaaacccgagcaattcacaggcgacatatgacgcgccatgcgtctttttttgtgtcgcaatcaacgccacagagcgccagattatggtgtggtgtgtggtcagtcgtgcagatggcattccgtgcatcctgcccgcgtccgctcattatgccgcagagtcaatggtagctcaggcggggcagcctccgggctggccggtatcctgtgaagccggtatttccacccccgtctgggctatcgccatcgagcgtggaaactccggcgatagcgttatttgctattcacaggaggctgccatcatggctacaacccttaccccctcacaccctgaatttgtctttgtgtttgcggctgtccgtcgcacagaccgtcatccccgtatctgtatgcttcgcaccgtcgccggtgatgaacgcagtgcccgccgttcccttgtccgtgactatgtgctctcccttgctgcccgtctgccggtggtggaggtgtcccgtgcgtaa

SEQ ID NO: 9844 - protein, 199 aa, Escherichia coli
MMMPVLQKVPFSGLPFSGICGYSFSAAAKSAAGRGNPSNSQATYDAPCVFFCVAINATERQIMVWCVVSRADGIPCILPASAHYAAESMVAQAGQPPGWPVSCEAGISTPVWAIAIERGNSGDSVICYSQEAAIMATTLTPSHPEFVFVFAAVRRTDRHPRICMLRTVAGDERSARRSLVRDYVLSLAARLPVVEVSRA

SEQ ID NO: 9845 - DNA, 456 bp, Escherichia coli
atgtttgattttccccagcccggtgagatttaccgttctgccggttttcccgatgtggccgtggtcggcattctggaagacggtattccgtgggaaatgccgtaccgctgcccggacattgtctggaacccgtaccgccgtaaattcagtatccttgtgcgtatcctcgctgacgggcgcaccacagacatcccgctggggcgttttctgcgggaatttacctgtgaccgtcctgacctgttcaaacgcagccccgtaaaccggcatgcggtactgaaagaaatggccggagacccggaattacagaaatggcgggagaaatatctggatatttacccgcaggacactgttccggccagccgggcggcaccggtggcgcgggaatggcgggaaattccccgcatggagcctgacccggaaaccaccccggataacagttaccgcaattatctgtaa

SEQ ID NO: 9846 - protein, 151 aa, Escherichia coli
MFDFPQPGEIYRSAGFPDVAVVGILEDGIPWEMPYRCPDIVWNPYRRKFSILVRILADGRTTDIPLGRFLREFTCDRPDLFKRSPVNRHAVLKEMAGDPELQKWREKYLDIYPQDTVPASRAAPVAREWREIPRMEPDPETTPDNSYRNYL

SEQ ID NO: 9847 - DNA, 321 bp, Escherichia coli
atgaaaacacccttaccgcccgtcttacgcgctgccctttaccgtcgcgctgtcgcctgtgcctggctgaccgtgtgcgaacgtcagcaccgctacccgcatctcacccttgaatcactggaggcggccatcgccgctgagctggagggcttttatctgcgccagcacggtgaggaaaaagggcgtcagatagcctgtgccctgctggaagatttaatggaatccggccccctgaaggccgcgccgtcgctgtcctttctcgggctggttgtgatggatgaactctgtgcccgtcacataaaagcgccggtactgcactga

SEQ ID NO: 9848 - protein, 106 aa, Escherichia coli
MKTPLPPVLRAALYRRAVACAWLTVCERQHRYPHLTLESLEAAIAAELEGFYLRQHGEEKGRQIACALLEDLMESGPLKAAPSLSFLGLVVMDELCARHIKAPVLH

SEQ ID NO: 9849 - DNA, 2334 bp, Escherichia coli
atgaaaatgaacgtaaccgccaccgtcagccatgcactcggccactggccgcgtattctcccggcgctggggattcaggtgctgaagaaccgtcatcagccctgtccggtctgtggcgggagtgaccgcttccgttttgatgacagggaggggcgcggcacctggtactgcaatcagtgtggtgccggtgacggcctgaaactggttgaaaaggtgtttggtgtttccccgtccgatgcggccgcaaaggtggctgccgtgaccggcagcctgcccccggctgacccggcagtgacggctgccgccggtgctgaaacagacgctgcccggaagaacgccgccgcactggcacaaaccctgatggcgaaaacccgtcccggaaccggtaacgcctacctgacccgcaagggctttcccggccgggaatgccggatgctgaccggcacacacagagccggtggcgtgagctggcgcgtcggtgaccttgtggtgccactgtatgacgacagcggcgaactggttaaccttcagttaatcagtgctgacggccgtaagcgcaccctgaaaggcggacaggtcaggggcacctgtcacacccttgaaggacagaatcaggccggaaaacgtctgtggatagcggagggatacgcgaccgcacttaccgtgcatcacctgaccggtgaaacggtgatggtggcgctttcttccgtgaacctcctttctctggccagccttgcccggcagaagcatccggcctgtcagattgtccttgccgcagaccgtgacctcagcggtgacggccagaaaaaagccgccgcagccgcagatgcgtgtgagggcgttgttgccctgccgccggtcttcggtgactggaatgatgccttcacgcagtacggcggggaggccacccgtaaggccatttatgatgccatccggccaccggctgaaagcccgttcgacaccatgagcgaagcggagttttccgccatgagtaccagcgaaaaggccatgcgtatctatgagcattacggcgaggcgctcgcggtcgatgccaacggccagcttctgtcccgctatgaaaatggtgtctggaaggtgctgccgccacaggactttgcccgggatgtggccgggctgtttcagcgtctgcgcgcgccgttctcctccgggaaagtggcctccgtggtggacaccctgaagctgattattccgcagcaggaagccccctcccgccgcctgattggctttcgtaacggcgtgctcgacacgcagaacggcacgttccacccgcacagtccgtcacactggatgcgtaccctgtgcgatgtggatttcaccccgccggtggaaggtgaaacgctggaaacccacgctcccgcgttctggcgctggcttgaccgtgctgccggtggtcgtgcggaaaaacgcgacgtgattctggccgcactgtttatggtgctggcaaaccgctacgactggcagctctttctggaggtgaccggtcccggcggcagcggcaaaagtatcatggccgaaatagccaccctgctggccggggaggataacgccacatcggccaccattgagacgctggaatccccgcgtgaacgtgccgcgttaactggcttctcactgatacgcctgccggaccaggaaaaatggagcggcgacggtgccggactcaaggccatcaccggcggcgatgcggtgtccgttgacccgaaataccgggatgcgtactccacgcatatcccggcggtgattctggccgtgaacaataacccgatgcgcttcaccgatcgcagcggcggcgtgtcacgccggcgggtgattattcacttcccggaacagatagccccgcaggagcgcgacccgcagcttaaggacaaaatcacccgcgagctggcggtcatcgtgcgtcacctgatgcagaagttcagcgacccgatgctcgcccggtcactgcttcagtcccagcagaactcagacgaggcgctgaacatcaaacgggatgccgacccgacgtttgattttatcggctatctggaaaccctgccgcagaccagcggcatgtatatggggaacgccagtatcatcccgcgtaattaccgtaaatacctctatcacgcctatctggcctacatggaggcaaacggctaccggaatgtactcagtctgaaaatgttcgggctggggctgccggtgatgctgaaggaatacggactgaattacgagaagcgccataccaaacaggggatacagaccaacctgacactgaaagaggaaagctacggcgactggctgccaaaatgtgacgaccctgcaacaacctga

SEQ ID NO: 9850 - protein, 777 aa, Escherichia coli
MKMNVTATVSHALGHWPRILPALGIQVLKNRHQPCPVCGGSDRFRFDDREGRGTWYCNQCGAGDGLKLVEKVFGVSPSDAAAKVAAVTGSLPPADPAVTAAAGAETDAARKNAAALAQTLMAKTRPGTGNAYLTRKGFPGRECRMLTGTHRAGGVSWRVGDLVVPLYDDSGELVNLQLISADGRKRTLKGGQVRGTCHTLEGQNQAGKRLWIAEGYATALTVHHLTGETVMVALSSVNLLSLASLARQKHPACQIVLAADRDLSGDGQKKAAAAADACEGVVALPPVFGDWNDAFTQYGGEATRKAIYDAIRPPAESPFDTMSEAEFSAMSTSEKAMRIYEHYGEALAVDANGQLLSRYENGVWKVLPPQDFARDVAGLFQRLRAPFSSGKVASVVDTLKLIIPQQEAPSRRLIGFRNGVLDTQNGTFHPHSPSHWMRTLCDVDFTPPVEGETLETHAPAFWRWLDRAAGGRAEKRDVILAALFMVLANRYDWQLFLEVTGPGGSGKSIMAEIATLLAGEDNATSATIETLESPRERAALTGFSLIRLPDQEKWSGDGAGLKAITGGDAVSVDPKYRDAYSTHIPAVILAVNNNPMRFTDRSGGVSRRRVIIHFPEQIAPQERDPQLKDKITRELAVIVRHLMQKFSDPMLARSLLQSQQNSDEALNIKRDADPTFDFIGYLETLPQTSGMYMGNASIIPRNYRKYLYHAYLAYMEANGYRNVLSLKMFGLGLPVMLKEYGLNYEKRHTKQGIQTNLTLKEESYGDWLPKCDDPATT

SEQ ID NO: 9851 - DNA, 108 bp, Escherichia coli
gtggacgatgcagcttccagccagagcaaacttgggaccatcgactacaaaatgaagaatactgaactgcttttctggcaggcctatatactgcacggatatgggtga

SEQ ID NO: 9852 - protein, 35 aa, Escherichia coli
MDDAASSQSKLGTIDYKMKNTELLFWQAYILHGYG

SEQ ID NO: 9853 - DNA, 1977 bp, Escherichia coli
ttgttctttttttgtgagtacataaaaagagatgatattagtatagatatcgccttggatgtgctgagaatatcttccatctattataatagattttcagttcagactgaagttgagtataacaatacattcaaaaaatgtattaatgagctagtaaactcatttcctgataacattgaactaatctctgagttcgagagtcaatgtaaaattatgcatgatataaataattctttctttgcggctacaaaatgtgctggtatttggcgtaaaaatacaaaaaaatcacatgcattaatacttaatctcatcatgttttgtgagatgtttttatcatcattatcatccttggttgtggtcaatgatcctaaaaaaatgaagaggatttttccattatttatcgtttctgaaaatattaatattcatgctgaacctgatatcgaatgttttcgagttatcgatagggcatttgatgaggtagccaattacaccggaagaatattttcttatttacggactcatgggccattgaaactaacttcttgtgtgaataaacaaaccttgctttcaatgggagggtaccttaatgagtggaatgtttttgactcattaagcagagtaagagactttttcagactaagtagtgcagtatttacaaaattggataataacatttactctcttgaggttgatagtttttgtttataccgagattatgagattgcaagaaatagactaatgatgagagcgtcacatctatatagcgaagttcatgaatttagtaacaaacattttcatctaaatagttgggtaaaggatcatatgccatcttacttaaattctgatggcgtttttagctcatttcatctaagcgagttggaaaatatgtctcctgatgaccttcatgaagaatatgggaatatatcattatttaattgggtgcacgcttatcaatgtttagtcgagttatctaaagaagaaatgagcaaaagattttcatcgacaaaacctatacccctacagttggatcgctggctgatcataaaaagccgtgagagttggttatcattctttcaacgtaaggggattgcagcagatgcagcaaaaaaactgatagattattttaccttcaattcaaaatcacatgatcttaatgattgcccatttattccctgtatggacggtttatgcttaatgcctgcattaatagcaaatagctcagtgactcgctctctaatgtcattatttggttccaaaaaaatttctcaagcaagtaaagggcgatttcatgagcaacaatttataaaacgagttcgtgatgcggggattaaagcttctccaattgatgctcatgctaattatcagtgtgattgcgtgattctcctggatgattgtttgatttttacagaactaaaatcaaatggtcaaccaatatattatggtaagtactatcagcaagtgtgtaacatcgttggagatagctcattaatacatgatcataataataaatttatgcgttcttattttcaacaaataaatcgaatttctgaacattatcttaatcatcttgatgtgatcattaaagaattcgaactaccatcaacatggcaacccaaaggtgtgtataagcttattgttactacaactatgctcggtgggaaatatcatgtggatgatacatatgtagcggataaatatgcattatctagtttttttcaacgaatacctggagtgatatatcaaacaaatgaaaatggaaaaatggcgaaaaatatcattgatgggtttgagtgttgcgaaggggaaatcactatcgataagtttatagattatctttcctctttgcccagtattaatgctgtacgtaaaaatataaaaaaattaacttatagtgttcgatttaatgaaaaattagtccatcacccttattatgattcttgggcttttggtccatatattcgtaagggaaatgattag

SEQ ID NO: 9854 - protein, 658 aa, Escherichia coli
MFFFCEYIKRDDISIDIALDVLRISSIYYNRFSVQTEVEYNNTFKKCINELVNSFPDNIELISEFESQCKIMHDINNSFFAATKCAGIWRKNTKKSHALILNLIMFCEMFLSSLSSLVVVNDPKKMKRIFPLFIVSENINIHAEPDIECFRVIDRAFDEVANYTGRIFSYLRTHGPLKLTSCVNKQTLLSMGGYLNEWNVFDSLSRVRDFFRLSSAVFTKLDNNIYSLEVDSFCLYRDYEIARNRLMMRASHLYSEVHEFSNKHFHLNSWVKDHMPSYLNSDGVFSSFHLSELENMSPDDLHEEYGNISLFNWVHAYQCLVELSKEEMSKRFSSTKPIPLQLDRWLIIKSRESWLSFFQRKGIAADAAKKLIDYFTFNSKSHDLNDCPFIPCMDGLCLMPALIANSSVTRSLMSLFGSKKISQASKGRFHEQQFIKRVRDAGIKASPIDAHANYQCDCVILLDDCLIFTELKSNGQPIYYGKYYQQVCNIVGDSSLIHDHNNKFMRSYFQQINRISEHYLNHLDVIIKEFELPSTWQPKGVYKLIVTTTMLGGKYHVDDTYVADKYALSSFFQRIPGVIYQTNENGKMAKNIIDGFECCEGEITIDKFIDYLSSLPSINAVRKNIKKLTYSVRFNEKLVHHPYYDSWAFGPYIRKGND

SEQ ID NO: 9855 - DNA, 180 bp, Escherichia coli
gtgcaggatcttgccactagtttacaactcgccttcgatagcgacgcaaaacgagttctgttgccgatatcctcggctatggatattccaacagttccggcagagttgtttaccaagtttcaggtaagtttttactcagaaccggttgatgcggtttataaggcgctggatgtgaattaa

SEQ ID NO: 9856 - protein, 59 aa, Escherichia coli
MQDLATSLQLAFDSDAKRVLLPISSAMDIPTVPAELFTKFQVSFYSEPVDAVYKALDVN

SEQ ID NO: 9857 - DNA, 873 bp, Escherichia coli
atggcttccagtaaatcgctacagcaggcaattgccaacataaaaatctggcacaagggtgaacagcgcgcgccgcataaaccattgttattgctatacgtattagcgggatacctgaatggacatccacgccttttcgattatggctcggaaatctacgaacctctgcacagtttactggaacgttttggtccacagcgttcacagtaccgacctgatatgccgttctggcgattacaaggcgacggattctggcaattacgcaatgccgagctttgctcaacagcaggtagcagccgacaaccgccagtgaaggaactgaccgaacaccgcgttgcaggcggtttcgatgaacagcactacgccctggtaaccggcaataaaaaactcatcaataccctggcgcaacagatactcgaagcgcacttcaccgagagtattcaggaagaaattgctgacgagctgggttttgatctccagcaaatccgtaaacagcgcgacccgttatttcgcaaaaatgtattacgcgcttataaataccagtgcgcgatatgtggctttaatatgcgccacgacgacaccaccgtcgcgttggaagcggcgcatataaaatggaaacagcacggcggtccttgtgaaattcctaatggcctggcgctttgcgcaattcaccataaagcctttgataaaggatcgattggcctggacgaaaatatgcgggtactggtatcagatgcggtaaacggcggagggatcgttgagagattattctgggattttgacgggaaaactattacgttgccgcaggtgcgtaaaaattacccttttgaggggtttgtggagtggcatcggaaagaggtttttagggggtga

SEQ ID NO: 9858 - protein, 290 aa, Escherichia coli
MASSKSLQQAIANIKIWHKGEQRAPHKPLLLLYVLAGYLNGHPRLFDYGSEIYEPLHSLLERFGPQRSQYRPDMPFWRLQGDGFWQLRNAELCSTAGSSRQPPVKELTEHRVAGGFDEQHYALVTGNKKLINTLAQQILEAHFTESIQEEIADELGFDLQQIRKQRDPLFRKNVLRAYKYQCAICGFNMRHDDTTVALEAAHIKWKQHGGPCEIPNGLALCAIHHKAFDKGSIGLDENMRVLVSDAVNGGGIVERLFWDFDGKTITLPQVRKNYPFEGFVEWHRKEVFRG

SEQ ID NO: 9859 - DNA, 126 bp, Escherichia coli
atgttggcaattgcctgctgtagcgatttactggaagccattgatatccctggcagtgaaataattgcgatcatgctcgcaaattttctgctgttcaagcctgcaagcgaagatatattaccttga

SEQ ID NO: 9860 - protein, 41 aa, Escherichia coli
MLAIACCSDLLEAIDIPGSEIIAIMLANFLLFKPASEDILP

SEQ ID NO: 9861 - DNA, 981 bp, Escherichia coli
atgaacgcaataatatcgcccgattattactatgttcttaccgttgctggtcagtctaatgccatggcgtatggcgaaggactaccattaccggacaaggaagatgcgcctcatcccagaattaaacaattagcgagatttgcgcatacacatcccggaggcccgtcatgtcactttaacgacattattccactgactcactgcccacacgatgttcaggatatgcagggttatcaccatcctctggcaacgaatcatcaaacacagtacggcaccgttggccaggcactgcatatagcacggaaattactgccctttattcctgataatgcaggggttctcatcgttccgtgttgccgtggcggatcagcttttaccgcgggcagcgaagggacatattcagaaccgcacggagccagccatgatgcttgtcgttggggatcggatactccgctataccaggatttagtcagcagaacgcgagccgcactggcaaaaaatccgcagaacaaattcctcggcgtatgctggatgcaaggcgaatttgacttaatgaccagtgactacgcgtcacaccctcaacactttaatcatatggttgacgcctttcgtagggctctaaaacaataccattctcagcttaataaaattactgacgcgccgtggttttgcggcgataccacctggtactggaaagaaaatttccctcatgcgtatgaagctatttatggcaattatcaaaataatgttttagccaatattattttcgtcgacttccagcaacaaggtgaaagaggactgacgaacgtgcctgatgaagacccggacgatttaagcacgggatattacggttcagcgtaccggtcaccggagaactggacgacggcactgcgaagcagtcatttcagcgcggcagcccgtcgagggattatttctaacaggtttgtagaagcaattttgcagttttggcgcgaaaggtga

SEQ ID NO: 9862 - protein, 326 aa, Escherichia coli
MNAIISPDYYYVLTVAGQSNAMAYGEGLPLPDKEDAPHPRIKQLARFAHTHPGGPSCHFNDIIPLTHCPHDVQDMQGYHHPLATNHQTQYGTVGQALHIARKLLPFIPDNAGVLIVPCCRGGSAFTAGSEGTYSEPHGASHDACRWGSDTPLYQDLVSRTRAALAKNPQNKFLGVCWMQGEFDLMTSDYASHPQHFNHMVDAFRRALKQYHSQLNKITDAPWFCGDTTWYWKENFPHAYEAIYGNYQNNVLANIIFVDFQQQGERGLTNVPDEDPDDLSTGYYGSAYRSPENWTTALRSSHFSAAARRGIISNRFVEAILQFWRER

SEQ ID NO: 9863 - DNA, 1107 bp, Escherichia coli
atgaataaaacaataacggcgcttactatcataatggcttcatttgccacaaacgcgtctgtattaccggaaactcctgtgccatttaaaagtggtaccggagcaattgataacgacactgtctacattgggttaggtagcgcaggtacggcatggtacaagctggatacacaggccaaagataaaaaatggacggcgttagctgcattccctggcggaccgagagatcaagcaacctctgcatttattgatggcaatctgtatgtgtttggcggcattggcaaaaacagcgagggcttgactcaggtatttaatgacgtacacaaatacaaccccaaaaccaatagctgggttaaattgatgtcgcacgcgccgatgggcatggcgggccatgtgacttttgtacacaacggcaaggcttatgttactggcggtgttaaccagaatatcttcaatggctattttgaagatctcaacgaagctggaaaagattcaaccactatagataaaatcaacgcccactattttgacaaaaaagcagaagattatttcttcaataagtttctgttatcttttgatccctctacacagcaatggagttacgctggcgaatctccctggtacggaacggctggtgcggcggttgtgaataaaggtgataaaacctggcttattaatggcgaagccaaaccaggattgcgaacggatgccgtatttgaacttgatttcaccggtaataatttaaaatggaataagcttgctcccgtcgcatcaccagatggcgtcgctggcggttttgcaggcatgagcaatgactcacttatatttgccggaggggccggattcaaaggttcacgagaaaattaccagaacggtaagaactatgcgcatgaaggcctgaaaaaatcatatagcgctgatattcatctttggcataacgggaaatgggataaatcgggcgaattatcgcaaggtcgggcctacggagtatcattgccctggaataatagtttattaattattggcggtgaaactgcaggcggcaaagcggtgacggattcagttttgatttctgtgaaggataataaagtcacagtacaaaactaa

SEQ ID NO: 9864 - protein, 368 aa, Escherichia coli
MNKTITALTIIMASFATNASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTTIDKINAHYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 9865 - DNA, 717 bp, Escherichia coli
atgaaaaaggctaaaatactttctggcgtattattactgtgcttttcgtcaccactaatttctcaggctgcgacactggacgtacgtggtggatatcgtagtggaagccacgcctatgagactcgactcaaagtcagtgagggatggcaaaatggatggtgggcaagtatggaaagtaatacctggaataccattcatgataataaaaaggaaaatgccgcactcaatgatgttcaggttgaagttaattacgcgattaaacttgatgatcaatggacggtgcgcccgggaatgttaacgcattttagcagcaacggcacacgctacggaccctacgtaaaactgtcctgggacgcgacaaaagatcttaattttggcattcgctatcgttacgactggaaagcttaccgacaacaagacttatccggtgatatgtctcgtgataacgttcatcgttgggatggatatgtcacttaccatattaatagtgatttcaccttcgcatggcaaacgacgctatacagcaaacagaacgattatcgctatgcaaaccataagaaatgggcgacggaaaatgcatttgttctacaataccatatgacgcccgatattacgccatatatagaatatgactaccttgaccgtcagggtgtttacaacggcagagataatttatcggaaaacagttatcgcattggtgtgtcatttaaactgtag

SEQ ID NO: 9866 - protein, 238 aa, Escherichia coli
MKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 9867 - DNA, 603 bp, Escherichia coli
atgaagaataaggctgataacaaaaaaaggaacttcctgacccatagtgaaatcgaatcactccttaaagctgcaaataccgggcctcatgctgcacgtaattattgtctgacattactttgttttattcatggtttccgggcgagtgaaatttgccgattgaggatttcggatattgatcttaaggcaaagtgtatatatatccatcgattaaaaaaaggcttttcaacaacgcacccgctattgaacaaagaaattcaggctttaaaaaactggttgagtatccgtacttcttatccgcatgctgagagcgagtgggtatttttatcacgtaaggggaatccactttctcggcaacagttttaccatattatctcgacttccggtggtaatgccgggttgtcactggagattcatccgcacatgttacgccattcgtgtggttttgctttggcgaatatgggaatagatacgcgacttatccaggattatcttggacatcgcaatattcgtcatactgtctggtataccgccagcaatgcagggcgtttttacggcatctgggatagagccagaggacgacagcgtcacgctgttttatag

SEQ ID NO: 9868 - protein, 200 aa, Escherichia coli
MKNKADNKKRNFLTHSEIESLLKAANTGPHAARNYCLTLLCFIHGFRASEICRLRISDIDLKAKCIYIHRLKKGFSTTHPLLNKEIQALKNWLSIRTSYPHAESEWVFLSRKGNPLSRQQFYHIISTSGGNAGLSLEIHPHMLRHSCGFALANMGIDTRLIQDYLGHRNIRHTVWYTASNAGRFYGIWDRARGRQRHAVL

SEQ ID NO: 9869 - DNA, 555 bp, Escherichia coli
atgatgcaggcggtgtgttacggggcaacgggagccagagattattgtcttattctgttggcatatcggcatgggatgcgtattagtgaactgcttgatctgcattatcaggatcttgaccttaatgaaggtcgaataaatattcgccgactgaagaacggattttctaccgttcacccgttacgttttgatgagcgtgaagccgtggaacgctggacccaggaacgtgctaactggaaaggcgctgaccggaccgacgctatatttatttctcgccgtgggagtcggctttctcgccagcaggcctatcgcattattcgcgatgccggtattgaagctggaaccgtaacgcagactcatcctcatatgttaaggcatgcttgtggttatgaactggctgagcgtggtgcagatacccgtttaattcaggattatctcgggcatcgaaatattcgccatactgtgcgttataccgccagtaatgctgctcgttttgccggattatgggaaagaaataatctcataaacgaaaaattaaaaagagaagaagcttga

SEQ ID NO: 9870 - protein, 184 aa, Escherichia coli
MMQAVCYGATGARDYCLILLAYRHGMRISELLDLHYQDLDLNEGRINIRRLKNGFSTVHPLRFDEREAVERWTQERANWKGADRTDAIFISRRGSRLSRQQAYRIIRDAGIEAGTVTQTHPHMLRHACGYELAERGADTRLIQDYLGHRNIRHTVRYTASNAARFAGLWERNNLINEKLKREEA

SEQ ID NO: 9871 - DNA, 555 bp, Escherichia coli
atgaaaattaaaactctggcaattgttgttctgtcggctctgtccctgagttctacagcggctctggctgatactacacccacgacggtaaatggtgggaccgttcactttaaaggggaagttgttaacgccgcttgcgcagttgatgcaggctctgttgatcaaaccgttcagttaggacaggttcgtaccgccactttgaagcaggctggagcaaccagctctgctgtcggttttaacattcagctgaatgattgcgataccactgttgccacaaaagccgctgttgccttcttggggacggcgattgacagtactcatcctaaagtcctggctctacagagttcagctgcgggtagcgcaacaaacgttggcgtgcagattctggacagaacaggtaatgagctgacgctggacggtgcgacatttagtgcagaaacaaccctgaataacggtactaacaccattccgttccaggcgcgttattttgcaaccggtgctgcaaccccaggtgctgctaatgcggatgcgaccttcaaggttcagtatcaataa

SEQ ID NO: 9872 - protein, 184 aa, Escherichia coli
MKIKTLAIVVLSALSLSSTAALADTTPTTVNGGTVHFKGEVVNAACAVDAGSVDQTVQLGQVRTATLKQAGATSSAVGFNIQLNDCDTTVATKAAVAFLGTAIDSTHPKVLALQSSAAGSATNVGVQILDRTGNELTLDGATFSAETTLNNGTNTIPFQARYFATGAATPGAANADATFKVQYQ

SEQ ID NO: 9873 - DNA, 639 bp, Escherichia coli
atgcggatgcgaccttcaaggttcagtatcaataacctacccaggttcagggacgtcattacgggcagggatgcccacccttgtgcgataaaaataacgatgaaaaggaagagattatttctgttagcgtcgttgctgccaatgtttgctctggccggaaataaatggaataccacgctgcccggcggaaatatgcaatttcagggtgtcattattgcggaagcttgccggattgaagccggtgataaacaaatgacggtcaatatggggcaaatcagcagtaaccggtttcatgcggtaggggaagatagctcaccggtgccttttgttattcatttacgggaatgtagcacggtggtgagtgaacgtgtgggtgtggcgtttcacggtgtcgcggatggtaaaaatccggatgtgctttccgtgggagaggggccagggatagccaccaatattggcgtagcgttgtttgatgatgaaggaaacctcgtaccgattaaccgtcctccagcaaactggaaacggctttactcaggctctacttcgctacatttcatcgccaaatatcgtgctaccgggcgtcgggttactggcggcatcgccaatgcccaggcctggttctctttaacctatcagtaa

SEQ ID NO: 9874 - protein, 212 aa, Escherichia coli
MRMRPSRFSINNLPRFRDVITGRDAHPCAIKITMKRKRLFLLASLLPMFALAGNKWNTTLPGGNMQFQGVIIAEACRIEAGDKQMTVNMGQISSNRFHAVGEDSSPVPFVIHLRECSTVVSERVGVAFHGVADGKNPDVLSVGEGPGIATNIGVALFDDEGNLVPINRPPANWKRLYSGSTSLHFIAKYRATGRRVTGGIANAQAWFSLTYQ

SEQ ID NO: 9875 - DNA, 726 bp, Escherichia coli
gtgagtaataaaaacgtcaatgtaaggaaatcgcaggaaataacattctgcttgctggcaggtatcctgatgttcatggcaatggtggttgccggacgcgctgaagcgggagtggccttaggtgcgactcgcgtaatttatccggcagggcaaaaacaagtgcaacttgccgtgacaaataatgatgaaaatagcacctatttaattcaatcatgggtagaaaatgccgatggtgtaaaggatggccgttttatcgtgacgccacctctgtttgcgatgaagggaaaaaaagagaataccttgcgtattcttgatgcaacaaataaccaattgccacaggatcgggaaagtttattctggatgaatgttaaagcgattccgtcaatggataaatcaaaattgactgagaatacgctacagctcgcaattatcagccgcattaaactgtactatcgtccggctaaattagcgttgccacccgatcaggccgcagaaaaattaagatttcgtcgtagcgcgaattctctgacgctgattaacccgacaccctattacctgacggtaacagagttgaatgccggaactcgggttcttgaaaatgcattggtgcctccaatgggcgaaagcgcggttaaattgccttctgatgcaggaagcaatattacttaccgaacaataaatgattatggcgcacttacccccaaaatgacgggcgtaatggaataa

SEQ ID NO: 9876 - protein, 241 aa, Escherichia coli
MSNKNVNVRKSQEITFCLLAGILMFMAMVVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESAVKLPSDAGSNITYRTINDYGALTPKMTGVME

SEQ ID NO: 9877 - DNA, 2637 bp, Escherichia coli
atgtcatatctgaatttaagactttaccagcgaaacacacaatgcttgcatattcgtaagcatcgtttggctggtttttttgtccggctctttgttgcctgtgcttttgccgcacaggcacctttgtcatctgccgaactctattttaacccgcgttttttagcggatgatccccaggctgtggctgatttatcgcgttttgaaaatgggcaagaattaccgccagggacgtatcgtgttgatatctatttgaataatggttatatggcaacgcgtgatgtcacatttaatacgggcgacagcgaacaagggattgttccctgcctgacacgcgcgcaactcgccagtatggggctgaatacggcttctgtctccggtatgaatctgctggcggatgatgcctgcgtgccattaacctcaatgatccatgacgctactgcgcaactggatgtgggtcagcagcgactcaacctgacgatccctcaggcatttatgagtaatcgcgcgcgtggttatattcctcctgagttatgggatcccggtattaatgccggattgctcaattataatttcagcggaaatagtgtacagaatcgaattgggggtaacagccattatgcatatttaaacctacagagtgggttaaatatcggtgcgtggcgtttacgcgacaataccacctggagttataacagtagcgacagttcatcaggtagcaaaaataaatggcagcatatcaatacctggcttgagcgagacataattccgttacgttcccggctgacgctgggtgatggttatactcagggcgatattttcgatggtattaactttcgcggcgcacaattggcctcagatgacaatatgttacccgatagccaaagaggatttgccccggtgatccacggtattgctcgtggtactgcacaggtcactattaaacaaaatgggtatgacatttataatagtacggtgccaccggggccttttaccatcaacgatatctatgccgcaggtaatagtggtgacttgcaggtaacgattaaagaggctgacggcagtacgcagatttttaccgtaccctattcgtcagtcccgcttttgcagcgtgaagggcatacacgttattccattacggcaggagaataccgtagtggaaatgcgcaacaggaaaaaccccgctttttccagagtacattactccacggccttccggctggctggacgatatatggtggaacgcaactggcggatcgttatcgtgcgtttaatttcggtatcgggaaaaatatgggggcactgggcgctctgtctgtggatatgacgcaggctaattccacacttcccgatgacagtcagcatgacggacaatcggtgcgttttctttataacaaatcgctcaatgagtcaggtacgaatattcagttagtgggttaccgttattcgaccagtgggtattttaatttcgctgatacaacatacagtcgaatgaatggctacaacatcgaaacacaggatggagttattcaggttaagccgaaattcaccgactattacaatctcgcttataacaaacgcgggaaattacaactcaccgttactcagcaactcgggcgcacatcaacactgtatttgagtggtagccatcaaacttattggggaacgagtaatgtcgatgagcaattccaggctggattaaatactgcgttcgaagatattaactggacgctcagctatagcctgacgaaaaacgcctggcaaaaaggacgggatcagatgttagctcttaacgtcaatatacctttcagccattggctgcgttctgacagtaaatctcagtggcgacatgccagtgccagctacagcatgtcacacgatctcaacggtcggatgaccaatctggccggtgtatacggtacgttgctggaagacaacaacctcagctatagcgtgcaaaccggttatgccgggggaggcgatggaaatagcggaagtacaggctacgccacgctgaattatcgcggtggttacggcaatgccaatatcggttacagccatagcgatgatattaagcagctctattacggagtcagcggtggggtactggctcatgccaatggcgtaacgctggggcagccgttaaacgatacggtggtgcttgttaaagcgcctggcgcaaaagatgcaaaagtcgaaaaccagacaggagtgcgtaccgactggcggggttatgccgtgctgccttatgccactgaatatcgggaaaacagagtggcgctggataccaataccctggctgataacgtcgatttagataatgcggtcgctaacgttgttcccacccgtggggcgatcgtgcgagcagagtttaaagcgcgcgttgggataaaactgctcatgacgctaacccacaataataagccgctgccgtttggggcgatggtgacatcagagagtagccagagtagcggcattgttgcggataatggtcaggtttacctcagcggaatgcctttagcgggaaaagtgcaggtgaaatggggagaagaggaaaatgctcactgtgtcgccaattatcaactgccaccagagagtcagcagcagttattaacccagctatcagctgaatgtcgttaa

SEQ ID NO: 9878 - protein, 878 aa, Escherichia coli
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 9879 - DNA, 531 bp, Escherichia coli
atgagaaacaaacctttttatcttctttgcgcttttttgtggctggcggtaagtcacgctttggctgcggatagcacgattactatccgcggctatgtcagagataatggctgtagtgtggccgctgaatcaaccaattttactgttgatctgatggaaaacgcggcgaagcaatttaacaacattggcgcgacgactcctgttgttccatttcgtattttgctgtcaccctgtggtaacgccgtttctgccgtaaaggttgggtttaccggcgttgcagatagccacaatgccaacctgcttgcacttgaaaatacggtgtcagcggctgcgggactgggaatacagcttctgaatgagcagcaaaatgagataccccttaatgccccatcgtccgcgatttcgtggacgaccctgacgccgggtaaaccaaatacgttgaatttttacgcccggctaatggcgacacaggtgcctgtcactgcggggcatattaatgccacggctaccttcactcttgaatatcagtaa

SEQ ID NO: 9880 - protein, 176 aa, Escherichia coli
MRNKPFYLLCAFLWLAVSHALAADSTITIRGYVRDNGCSVAAESTNFTVDLMENAAKQFNNIGATTPVVPFRILLSPCGNAVSAVKVGFTGVADSHNANLLALENTVSAAAGLGIQLLNEQQNEIPLNAPSSAISWTTLTPGKPNTLNFYARLMATQVPVTAGHINATATFTLEYQ

SEQ ID NO: 9881 - DNA, 504 bp, Escherichia coli
atgaaatggtgcaaacgtgggtatttattggcggcaatgttggcgttcgcaagtgcgacgatacaggcagccgatgtcaccatcacggtgaacggtaaggtcgtcgccaaaccgtgcacagtttccaccaccaatgccacggtagatctcggcgatctttattctttcagtcttatgtctgccggggcggcatcggcctggcatgatgttgcgcttgagttgactaattgtccggtgggaacgtcgagggtcactgccagcttcagcggggcagccgacagtaccggatattataaaaatcaggggaccgcgcaaaacatccagttagagctacaggatgacagtggcaacacattgaatactggcgcaaccaaaacagttcaggtggatgattcctcacaatcagcgcacttcccgttacaggtcagagcattgaccgtaaatggtggagccactcagggaaccattcaggcagtgattagcatcacctatacctacagctga

SEQ ID NO: 9882 - protein, 167 aa, Escherichia coli
MKWCKRGYLLAAMLAFASATIQAADVTITVNGKVVAKPCTVSTTNATVDLGDLYSFSLMSAGAASAWHDVALELTNCPVGTSRVTASFSGAADSTGYYKNQGTAQNIQLELQDDSGNTLNTGATKTVQVDDSSQSAHFPLQVRALTVNGGATQGTIQAVISITYTYS

SEQ ID NO: 9883 - DNA, 903 bp, Escherichia coli
atgaaacgagttattaccctgtttgctgtactgctgatgggctggtcggtaaatgcctggtcattcgcctgtaaaaccgccaatggtaccgcaatccctattggcggtggcagcgccaatgtttatgtaaaccttgcgcctgccgtgaatgtggggcaaaacctggtcgtagatctttcgacgcaaatcttttgccataacgattacccagaaaccattacagactatgtcacactgcaacgaggtgcggcttatggcggcgtgttatctagtttttccgggaccgtaaaatataatggcagtagctatcctttccctactaccagcgaaacgccgcgggttgtttataattcgagaacggataagccgtggccggtggcgctttatttgacgccggtgagcagtgcggggggagtggcgattaaagctggctcattaattgccgtgcttattttgcgacagaccaacaactataacagcgatgatttccagtttgtgtggaatatttacgccaataatgatgtggtggtgcccactggcggctgcgatgtttctgctcgtgatgtcaccgttactctgccggactaccctggttcagtgccgattcctcttaccgtttattgtgcgaaaagccaaaacctggggtattacctctccggcacaaccgcagatgcgggcaactcgattttcaccaataccgcgtcgttttcacccgcgcagggcgtcggcgtacagttgacgcgcaacggtacgattattccagcgaataacacggtatcgttaggagcagtagggacttcggcggtaagtctgggattaacggcaaattacgcacgtaccggagggcaggtgactgcagggaatgtgcaatcgattattggcgtgacttttgtttatcaataa

SEQ ID NO: 9884 - protein, 300 aa, Escherichia coli
MKRVITLFAVLLMGWSVNAWSFACKTANGTAIPIGGGSANVYVNLAPAVNVGQNLVVDLSTQIFCHNDYPETITDYVTLQRGAAYGGVLSSFSGTVKYNGSSYPFPTTSETPRVVYNSRTDKPWPVALYLTPVSSAGGVAIKAGSLIAVLILRQTNNYNSDDFQFVWNIYANNDVVVPTGGCDVSARDVTVTLPDYPGSVPIPLTVYCAKSQNLGYYLSGTTADAGNSIFTNTASFSPAQGVGVQLTRNGTIIPANNTVSLGAVGTSAVSLGLTANYARTGGQVTAGNVQSIIGVTFVYQ

SEQ ID NO: 9885 - DNA, 1185 bp, Escherichia coli
atggaacagacctggcgctggtacggcccaaacgatccggtttctttagctgatgtccgtcaggcgggcgcaactggcgtggttaccgcgctgcaccatatcccgaacggcgaagtatggtccgtagaagagatcctcaaacgcaaggcgatcgttgaagacgcaggcctggtgtggtctgtcgttgaaagcgtaccaattcacgaagatatcaaaacccacactggcaactatgagcagtggattgctaactatcagcagaccctgcgcaacctggcgcagtgcggcattcgcaccgtgtgctacaacttcatgccggtgctcgactggacccgtactgacctcgaatacgtgctgccagacggctccaaagctctgcgcttcgaccagatcgaattcgctgcattcgaaatgcatatcctgaagcgtccaggcgcggaagcggattacaccgaagaagaaattgctcaggccgctgaacgcttcgccactatgagcgacgaagacaaagcgcgtctgacccgtaacatcattgccggtctgccaggtgcggaagaagggtataccctcgaccagttccgtaagcacctggagctatacaaagatatcgacaaagccaaactgcgcgaaaacttcgccgtcttcctgaaagcgattattccggttgccgaagaagttggcgtccgtatggcggttcacccggacgatccgccgcggccgatcctcggcctgccgcgcattgtttccaccattgaagatatgcagtggatggttgataccgtaaacagcatggcgaacggtttcaccatgtgcaccggttcctacggcgtgcgtgctgacaacgatctggttgatatgatcaagcagttcggtccgcgtatttacttcacccatctgcgctccaccatgcgtgaagataacccgaaaaccttccacgaagcggcgcacctgaacggtgacgttgatatgtacgaagtggtgaaagcgattgttgaagaagaacaccgtcgtaaagcggaaggcaaagaagacctgatcccgatgcgtccggaccacggtcatcagatgctggacgacctgaagaagaaaaccaatcctggttactccgcaattggtcgtctgaaaggcctggccgaagttcgcggtgtcgaactggcgatccagcgcgctttctttagccgttaa

SEQ ID NO: 9886 - protein, 394 aa, Escherichia coli
MEQTWRWYGPNDPVSLADVRQAGATGVVTALHHIPNGEVWSVEEILKRKAIVEDAGLVWSVVESVPIHEDIKTHTGNYEQWIANYQQTLRNLAQCGIRTVCYNFMPVLDWTRTDLEYVLPDGSKALRFDQIEFAAFEMHILKRPGAEADYTEEEIAQAAERFATMSDEDKARLTRNIIAGLPGAEEGYTLDQFRKHLELYKDIDKAKLRENFAVFLKAIIPVAEEVGVRMAVHPDDPPRPILGLPRIVSTIEDMQWMVDTVNSMANGFTMCTGSYGVRADNDLVDMIKQFGPRIYFTHLRSTMREDNPKTFHEAAHLNGDVDMYEVVKAIVEEEHRRKAEGKEDLIPMRPDHGHQMLDDLKKKTNPGYSAIGRLKGLAEVRGVELAIQRAFFSR

SEQ ID NO: 9887 - DNA, 1461 bp, Escherichia coli
atgactactattgttgacagcaatctgccggttgcccgcccgtcatgggatcattctcgtctggaatcacgcattgtgcatctcggttgcggggcgtttcaccgcgcgcaccaggcgctgtatacccatcatctgctggaaagtaccgacagcgactggggtatctgcgaagttaacctgatgccaggcaacgaccgcgtgctgatcgaaaacctgaaaaaacagcaactgctgtacaccgtggcggaaaaaggcgcggaaagcaccgagctgaaaattatcggttcgatgaaagaagcgctgcatccggaaatcgacggttgcgaaggtattctcaacgcgatggcgcgtccgcagacggcgattgtctctctgacggtcacggaaaaaggctactgcgctgatgcggcaagcggtcagctggatctcaataacccgctgatcaagcacgatctcgaaaacccgactgcgccgaagtccgcgattggttacatcgtagaagccctgcgtctgcgtcgtgaaaaagggctgaaagcatttacggtgatgtcctgcgacaacgtgcgtgaaaacggtcatgtggcgaaggttgccgttcttgggctggctctggcgcgtgacccgcaactggcggcatggattgaagaaaacgtcacctttccgtgcaccatggttgaccgcatcgttccggcggcgacgccagaaaccttacaggaaattgctgaccagctgggtgtttacgacccgtgcgccattgcctgcgaaccgttccgtcagtgggtaattgaagataacttcgttaatggtcgtccggactgggataaagtcggcgcgcagtttgttgcggatgttgtaccgttcgaaatgatgaagctgcgtatgctgaacggtagccactctttcctggcgtacctcggttacctcggcggctatgaaactattgccgacaccatgactaacccggcttatcgcaaagcggcctttgccctgatgatgcaggaacaagcgccaacgctgtcgatgccggaaggtacggacctgaacgcctatgcgacgctgctgatcgagcgtttcagcaacccgtctctgcgtcaccgtacctggcagattgcaatggacggcagccagaagttaccgcagcgtctgctggacccggtgcgtctgcacctgcaaaacggcggtagctggcgtcacctggcgctgggcgtggcgggctggatgcgttacacccagggcgtggatgagcagggtaatgccattgacgtggttgacccgatgatggcggagttccagaagatcaacgcgcagtatcagggtgcagaccgcgtgaaagcactgctgggcctgagcggtatctttgccgatgatctgccgcaaaacgccgactttgttggcgcggtgacggcggcatatcagcagctgtgtgagcgcggtgcgcgcgagtgtgtggctgcgctgtaa

SEQ ID NO: 9888 - protein, 486 aa, Escherichia coli
MTTIVDSNLPVARPSWDHSRLESRIVHLGCGAFHRAHQALYTHHLLESTDSDWGICEVNLMPGNDRVLIENLKKQQLLYTVAEKGAESTELKIIGSMKEALHPEIDGCEGILNAMARPQTAIVSLTVTEKGYCADAASGQLDLNNPLIKHDLENPTAPKSAIGYIVEALRLRREKGLKAFTVMSCDNVRENGHVAKVAVLGLALARDPQLAAWIEENVTFPCTMVDRIVPAATPETLQEIADQLGVYDPCAIACEPFRQWVIEDNFVNGRPDWDKVGAQFVADVVPFEMMKLRMLNGSHSFLAYLGYLGGYETIADTMTNPAYRKAAFALMMQEQAPTLSMPEGTDLNAYATLLIERFSNPSLRHRTWQIAMDGSQKLPQRLLDPVRLHLQNGGSWRHLALGVAGWMRYTQGVDEQGNAIDVVDPMMAEFQKINAQYQGADRVKALLGLSGIFADDLPQNADFVGAVTAAYQQLCERGARECVAAL

SEQ ID NO: 9889 - DNA, 726 bp, Escherichia coli
atgatccgcgatctgatcataaagacgccgtacaatcctggcgaacggctgccaccggagcgtgaaattgcagaaatgcttgatgtcacgcggacggtggtacgtgaagcgctgatcatgctggagatcaaagggctggtggaagtgcgtcggggtgcaggtatctatgttcttgatagctcaggcagccacaacgcagacagtccggatgccaacgtctgcaacgatgccggtccttttgagctgttacaggcgcggcagttactggaaagtaacatcgccgagtttgccgccctgcaggctacccgcgaagatatcgtcaaaatgcgcaaggcattgcaactggaagagcgtgaactggcttccagcgcgccgggcagcagcgaaagcggtgacatgcagttccatctcgccattgccgaagcaacgcataacagcatgctggtggagttattccgtcagtcctggcagtggcgggaaaacaatccaatgtggatccagttgcacagccatctggatgacagcctgtatcgcaaagagtggttgggcgatcacaaacagatcctcgccgcgttaatcaaaaaagatgcccgagcggcgaagctggcaatgtggcagcatctggagaatgtgaagcagcgcttgctggagttctctaatgttgatgacatctatttcgatggctatctgtttgattcatggccgctggataaagtcgacgcctga

SEQ ID NO: 9890 - protein, 241 aa, Escherichia coli
MIRDLIIKTPYNPGERLPPEREIAEMLDVTRTVVREALIMLEIKGLVEVRRGAGIYVLDSSGSHNADSPDANVCNDAGPFELLQARQLLESNIAEFAALQATREDIVKMRKALQLEERELASSAPGSSESGDMQFHLAIAEATHNSMLVELFRQSWQWRENNPMWIQLHSHLDDSLYRKEWLGDHKQILAALIKKDARAAKLAMWQHLENVKQRLLEFSNVDDIYFDGYLFDSWPLDKVDA

SEQ ID NO: 9891 - DNA, 384 bp, Escherichia coli
atgatgcgccaatcagttcagacggtattacctgaaagtacaggaaacaatacgttatcgctgcgtgattccgtatgccgggatctctttcaactttttagttctccccattcaccgctaccaatattacttgtttcaggcatgcctgagtggcaagggcataatcagagcgacaagcttctccagagttggtattgccgccagttacgctccgcgcttttatttcatgagccacgtattgcggcattgcaggtcaatctgaaagaagcctattgccacgagttggccattagtctggagatgatgctgtaccacgatgatgagccgctaacgtttgacctggtctggcagaaggggaactggcatcgcacgatgccgcagtaa

SEQ ID NO: 9892 - protein, 127 aa, Escherichia coli
MMRQSVQTVLPESTGNNTLSLRDSVCRDLFQLFSSPHSPLPILLVSGMPEWQGHNQSDKLLQSWYCRQLRSALLFHEPRIAALQVNLKEAYCHELAISLEMMLYHDDEPLTFDLVWQKGNWHRTMPQ

SEQ ID NO: 9893 - DNA, 2382 bp, Escherichia coli
atggttgccattgttattgtttctcatagtctacgtctcgcccagggggttgaggaattagcactacagatgtctggaggggacgttcctctggccattgctgcaggtattgatgatccgcaaaatccgattggcactgatgctattgccattatgtctgcgattgaatcggtctggtcaccggatggcgttctggtactcatggatatgggcagtgcgctgcttagtaccgagatggcgctggagctgctttctgaagagcaaagaagtgcaatttatctgctcgccgcccctgtagtgaaaggtgccatgtcagcggtaacgtctgccgcagcggggctttcggtgacggagattatcgctgaagtggatcttgctctgtgtgctaaacagcagcaactcacgccatcctcaactgcaggcgaggttattccagtaatatcaccagtcaatcattgcgatgaatggcaaactttttgctggacgatacgtaatccccacggcattcatgctcgtccggcagccagcatcctgaaagtatcagcacaatattcggcaaacattatcgtcatcaaaggcgataaacgcgccagcacccgcagtctcaacgaactggcaatgctgggcgtccgctgtggcgatgaaatcatcttccaggccgaaggcaccgatgccagtgacgctctcaaggcaattgaaacgttggcgaaaaatcattttggtgaagctcacctgctcgcttcttcagagattccgctaacggaaacgccggtggtcagcgcccctgtcgatggcgcaatatcaggcttgtcagtacaaaatggtatcgctattggtcctgttaaatggtttacctgcgaacgaccagaaattacgcagcgcaccgtcgattctccgcaagaagagctgtcgcgaatcgagtctgctatcgacattgttgtttgtgaacttgccgataaagcggcaggccctgaaggcgatatttttgccgcccataaaatgatgcttgaagatccagagattaaccggcaattacagcaacgtctggcaaagggcaaacaggcggaattcgcatggttagaagtcatgcaggcattagcagagcaatattgtcaggcggaaacactgtatttacgtgaacgcgaggcagatatccgtgaccttacacgtcaggtactgaaccagctttgcggggtaagtgaacaacactttatcactaccgcgccctgcattttgttagccaacgatctgttgccatcacagataaccagcctgaataaagcacacattcttggcatttgtcttcataatggcggaacaacttcacatacagcgatccttgccagagcaatgggtattcctgccattgtgaaggcagctattaccccgcaaaacgtccgcgataacgacacggtcattcttgatggtgaaacaggccgtttgtggctacagccggatgaggtcacccgcctagatttactgcaacgcgccgaagcatggcggcaacaaagggatcgtcagttagctgatgccatgctgcccgctgtcacgcaaggtgggcgaaaaatcagcgtgctggcgaatattggtgacctgcaagatattgaggctgcgctatctcacggggctgagggcgtgggtttactgcgcacagagtttttattccatgagtctgcaacattacccgatgaagaagagcagtttcgcgtgtattgttctgttgctcaggcttttggcgataaaccagtcaccatccgcactctggatattggcggtgacaagccattaccttcgtaccctttacccgcagaggacaacccgttcctgggacttcgcggtatccggttgtgcctggcgcatccgcaaatatttattccgcaattacgcgcacttctccgggccgggaaagaatacccaacgttgcaaattatgctgccgatggtttcaacgctcgaggaggtcaacgccgtcaaaacgctgatacaaacgcaggcaaaactgctgggacttactgcagaaaatcttccggcgctgggaattatgattgaggttcctgctgcagtcatgattgcagaaaaattagccagtgaagtcgatttcttttccatcggcaccaacgatctgacgcaatatattatggcggcagacagaggaaatagcaccgtcgcgaaactggtcgattatcgtaatgacgcggtgattaacgctattgctatggtgtgtcaggccggacgtaataatgaaattccggtcagtatgtgcggtgaaatggctggagatacccagcaaacagcacgactgctcaccatggggattgataagctcagtgccagcccgtcccggcttccggccttgaaagcagcaatcagagcctcccactaa

SEQ ID NO: 9894 - protein, 793 aa, Escherichia coli
MVAIVIVSHSLRLAQGVEELALQMSGGDVPLAIAAGIDDPQNPIGTDAIAIMSAIESVWSPDGVLVLMDMGSALLSTEMALELLSEEQRSAIYLLAAPVVKGAMSAVTSAAAGLSVTEIIAEVDLALCAKQQQLTPSSTAGEVIPVISPVNHCDEWQTFCWTIRNPHGIHARPAASILKVSAQYSANIIVIKGDKRASTRSLNELAMLGVRCGDEIIFQAEGTDASDALKAIETLAKNHFGEAHLLASSEIPLTETPVVSAPVDGAISGLSVQNGIAIGPVKWFTCERPEITQRTVDSPQEELSRIESAIDIVVCELADKAAGPEGDIFAAHKMMLEDPEINRQLQQRLAKGKQAEFAWLEVMQALAEQYCQAETLYLREREADIRDLTRQVLNQLCGVSEQHFITTAPCILLANDLLPSQITSLNKAHILGICLHNGGTTSHTAILARAMGIPAIVKAAITPQNVRDNDTVILDGETGRLWLQPDEVTRLDLLQRAEAWRQQRDRQLADAMLPAVTQGGRKISVLANIGDLQDIEAALSHGAEGVGLLRTEFLFHESATLPDEEEQFRVYCSVAQAFGDKPVTIRTLDIGGDKPLPSYPLPAEDNPFLGLRGIRLCLAHPQIFIPQLRALLRAGKEYPTLQIMLPMVSTLEEVNAVKTLIQTQAKLLGLTAENLPALGIMIEVPAAVMIAEKLASEVDFFSIGTNDLTQYIMAADRGNSTVAKLVDYRNDAVINAIAMVCQAGRNNEIPVSMCGEMAGDTQQTARLLTMGIDKLSASPSRLPALKAAIRASH

SEQ ID NO: 9895 - DNA, 633 bp, Escherichia coli
atgaaaattcaaaacaaacatgttattgcctggctggagagttgtgctgcacatcttactgaacaacaagattttctaaccgcacttgacagagatattggtgatgccgaccacggcctcaatatgaatcgtggtttcagtgccgtgaaagcgacgttgcccgacattgaacgtcagcatattggcaatatccttaaaaatactggcatgaaactactttccagcgttggcggtgccagtggtcctctttacggcacattatttattcgcgcttctgcggcagtgggagccagaacagaattaactctggaagagtggctggcgtgtctggaagaagggattgcaggcgttatcgcacgaggaaaagcagaacaaggggataaaacactgtgtgatgtctgggttccagttctccacgaagccaaaaagaacctgcaagccggaatgtcgccttcccttctgctgaatacgatggtgcaagatgcggcaacagccgtcgataacaccatcaatatgcaggcgaaaaaaggacgtgccagttatctcggcgctcgcagtgtgggccatcaggatccaggcgcgacctcctcctggctgatgattaaggctatgcaggaaggattcgcgggataa

SEQ ID NO: 9896 - protein, 210 aa, Escherichia coli
MKIQNKHVIAWLESCAAHLTEQQDFLTALDRDIGDADHGLNMNRGFSAVKATLPDIERQHIGNILKNTGMKLLSSVGGASGPLYGTLFIRASAAVGARTELTLEEWLACLEEGIAGVIARGKAEQGDKTLCDVWVPVLHEAKKNLQAGMSPSLLLNTMVQDAATAVDNTINMQAKKGRASYLGARSVGHQDPGATSSWLMIKAMQEGFAG

SEQ ID NO: 9897 - DNA, 1065 bp, Escherichia coli
atgaagaaattaattaaccagattgattctgttgtcacagaacaaatggaaggactcatcgccacctggccacacctgcaggcaaattacgcaccccgatatgtgtggtgcaaacaaaccgataatgcagtggcgctgatttcaggcggcggctcaggccatgaaccactgcatgcaggttttgtcggtatgggaatgttaaccggtgcatgtcctggtgaaatcttcacatcgcccacaccagaccaaatgatcgaatgtgccaaagcggttgataatggttctggcgttctgtttttcatcaaaaattacactggcgatattctgaatttcgaaacggcagtcgagatgttacacgaagaaggcatcgccgttgggaccgtcattattgatgatgatgtagcggtaaaagatagcctgtatacagccggacgtcgcggtgttgcgggtacagtttttgttgaaaagattgtcggtgcggctgcacttcagggatataacctggggcagtgcgagcaacttggcaaagatgttaacaatgccacccgttcttttggcatcgcactgtcagcctgtacggttcccgccgcgggaaaaccctcatttgaactggctgataatgaaatcgaatttggtgtcgggatccacggtgaacccggcattgaacgccgcactttgcaagatctgaacactttaatcgacagcgtgatagcgcaattactggataataccccctggcgacgcacattacgccattgggatcgccatgcggggggatggattgacgcatcatcaatgaatgagtcattcgatcaaaatgccgaatatattgtgttaattaacggacttggcagcacgcctgaatcagagttatatggtgtagccagggtatttatgtgcgccgcacagcgccagggaattaaaattagccgccagttggtcggtaattattgtacatcattagatatggccggattttccattagcctgctgaaatgtaccccagagtttttgcaactttgggatgccccggtcaatacgccagcgcttcgttggggatgttaa

SEQ ID NO: 9898 - protein, 354 aa, Escherichia coli
MKKLINQIDSVVTEQMEGLIATWPHLQANYAPRYVWCKQTDNAVALISGGGSGHEPLHAGFVGMGMLTGACPGEIFTSPTPDQMIECAKAVDNGSGVLFFIKNYTGDILNFETAVEMLHEEGIAVGTVIIDDDVAVKDSLYTAGRRGVAGTVFVEKIVGAAALQGYNLGQCEQLGKDVNNATRSFGIALSACTVPAAGKPSFELADNEIEFGVGIHGEPGIERRTLQDLNTLIDSVIAQLLDNTPWRRTLRHWDRHAGGWIDASSMNESFDQNAEYIVLINGLGSTPESELYGVARVFMCAAQRQGIKISRQLVGNYCTSLDMAGFSISLLKCTPEFLQLWDAPVNTPALRWGC

SEQ ID NO: 9899 - DNA, 99 bp, Escherichia coli
ttgcgtaacttgttttgcttcactgttaacctactcgttgcatccagtggcggcaaacatttcattcgcgaaaaattatgttttatgatcgcgctgtaa

SEQ ID NO: 9900 - protein, 32 aa, Escherichia coli
MRNLFCFTVNLLVASSGGKHFIREKLCFMIAL

SEQ ID NO: 9901 - DNA, 1083 bp, Escherichia coli
atggataagattattataagtccggctaaatatatccagggaaatggttctctggataatattgctacatatgcggcgagtttgggaacagaaccattaattattgcagatgaatttgtgaccggtctggttggtgacagagtaagccagagctttgcaagagaaaacattattgcggattttgatgttttttgcggtgaatgctcgcaaaatgaaatttctcgaattcgtaagaaatttaatcagcgtaaatataatgtcgttattggtattggcggcggtaaaacgttggatacggcaaaagccgtagcgtattaccaaaaaattccggtggtggtggtgccgacaattgcttccacagatgcgccaaccagttctctggcagtaatttacaccccggatggtcagtttagcgaatatctgtttttcccgaaaaacccggatatggtgattatggatactggcgtcatttcagccgcgccagtgcgtctgctggtggccggtatgggagatgcattgtcaacctggtttgaggcgagagccaatcaggcgtcaggaaaagccacaatggcaggtggggcgtcgacactggcggcactggctattgcccgactctgttataccacgctactggaagatggctataaggcaaaagtcgcggttgaacaaggtgttagcaccaaagcggtagagaatattatcgaagctaatacctatcttagcggcattggatttgaaagtagcggcctggcggcagctcatgccattcataacggcatgacgcaactggaggaatgtcatcattgctaccacggtgaaaaagtggcatttggcgtcctggtacagctcgtactggaaaacgcaccacaggaggaaattgaaaccgtactcaatttctgccatagcgttggcttgccgacaaatcttcatatgttaggcgtgaaggaaattaataaagataaattacgggcagtggctaaagccgcgactgctgaaggggaaactatccataatatgccattcgtagtaacagcgcaggacgttctttgtgcaattttaactgcacatcatttgggactttaa

SEQ ID NO: 9902 - protein, 360 aa, Escherichia coli
MDKIIISPAKYIQGNGSLDNIATYAASLGTEPLIIADEFVTGLVGDRVSQSFARENIIADFDVFCGECSQNEISRIRKKFNQRKYNVVIGIGGGKTLDTAKAVAYYQKIPVVVVPTIASTDAPTSSLAVIYTPDGQFSEYLFFPKNPDMVIMDTGVISAAPVRLLVAGMGDALSTWFEARANQASGKATMAGGASTLAALAIARLCYTTLLEDGYKAKVAVEQGVSTKAVENIIEANTYLSGIGFESSGLAAAHAIHNGMTQLEECHHCYHGEKVAFGVLVQLVLENAPQEEIETVLNFCHSVGLPTNLHMLGVKEINKDKLRAVAKAATAEGETIHNMPFVVTAQDVLCAILTAHHLGL

SEQ ID NO: 9903 - DNA, 1269 bp, Escherichia coli
atgaccagtaactggaaacgttggatcacgctggcgttatgtggtattgccggaagtgcaatatataaattgccttatttacgggaaacctattacgacgcgatgcagcaggctacaggagcgactaatgctgaacttggttttctaatgacagcctatggtctggtgaactttttattatatctacctggcggttgggctgccgatagattttctgcacgtaaattaatgaccttttcattaatttccaccgggataagcggtttttattatgcgaccttcccctcgtatactatgatctgtttgttacatgcactttgggctgttacaaccgtatttacgttttgggccgtgtgtgtgcgaattattcgtaccctgggaaccagcgaagaacaaggacgcttatacggttactggtttctgggtaagggattaacctccattgtactgggatttctttccgtgccggtatttgccaaatttggcgaaggtgttgatggtttacgggcgacaattattttttattccgtagtgactattctggccggtgttttagcctggtttgtttgtcaggatgaaacgcacagcgaagataaagcgaatttccgtctggcagatatggcattcgtgctgaaaatgccgacggtttggctggcaggtgttgtgaccttttgtatgtggtcaatttatatcggctttggcatggtcacgccgtatctcacgcagatcctgcatatgggcgaatcggaagtggcagttgccagtattcttcgcgcctatgtgttatttgcgatggggggattaattggcggacaactggccgaccgctgtgcgtcacgcacgcgttttatgatttacgcctttatcggcatgattgtctttactaccgtttatttcttcctgcccggtgagtcgcgctacgtcactattgcgctggcgaatatggttgcgttgggcgtgtttatttactctgcgaatgccgtgttcttctcaattattgatgaggttcggatcccggcaaaagtcacagggactgctgcgggtctgatctctttactgacctatttcccggaaatctactgctacacgatggtgggcaatatggtcgaccgcaaaccgggtattgccggttatcaggatgttttcctgttcatgttggtttgcgcattcatcggccttatcgccgcactggtcctccagcgtgtgaatcgtaaaagtaaaaatcaagtcaatgaaatcactcaaaacaatgcggattgcgcatcctga

SEQ ID NO: 9904 - protein, 422 aa, Escherichia coli
MTSNWKRWITLALCGIAGSAIYKLPYLRETYYDAMQQATGATNAELGFLMTAYGLVNFLLYLPGGWAADRFSARKLMTFSLISTGISGFYYATFPSYTMICLLHALWAVTTVFTFWAVCVRIIRTLGTSEEQGRLYGYWFLGKGLTSIVLGFLSVPVFAKFGEGVDGLRATIIFYSVVTILAGVLAWFVCQDETHSEDKANFRLADMAFVLKMPTVWLAGVVTFCMWSIYIGFGMVTPYLTQILHMGESEVAVASILRAYVLFAMGGLIGGQLADRCASRTRFMIYAFIGMIVFTTVYFFLPGESRYVTIALANMVALGVFIYSANAVFFSIIDEVRIPAKVTGTAAGLISLLTYFPEIYCYTMVGNMVDRKPGIAGYQDVFLFMLVCAFIGLIAALVLQRVNRKSKNQVNEITQNNADCAS

SEQ ID NO: 9905 - DNA, 1365 bp, Escherichia coli
atggtggacatgattaatgaaagtgcacggcaaacgccagtcattgcacaaacggacgttctggttatcgggggcggtccggcaggattatccgctgccattgcggcagggcggttaggtgccagaaccatgattgttgagcgctacgggtcgctaggcggcgtattgacgcaggtcggggtagaaagttttgcctggtatcgtcatccggggacggaagattgtgaagggatctgtcgtgagtatgaaggccgcgcacgagcgctgggtttcacacgaccagaacctcagtcaattagcgaagttatagatactgaaggatttaaagttgtcgccgatcagatgattacggaatctggcgttgagccgttatatcactcctgggttgtggacgtgatcaaggacggggatacgttatgcggtgttatcgtcgagaataaatcaggtcgaggggcaattctggcgaaaagaatcgtcgattgcacgggggatgctgatattgccgctcgtgcaggcgcgccctggacgaaacggagcaaggaccaactgatgggcgtcaccgtgatgttcagttgcgcaggtgttgatgtggcacgctttaaccgttttgttgcggaagaacttaagccgacctacgcggattggggcaaaaactggacgattcaaaccacgggtaaagaagacccgatgtttagcccgtatatggaggatatttttacccgcgcgcaacaggatggtgtgattccaggtgacgcccaggcgattgccggaacctggtcgaccttttctgaaagcggtgaggctttccagatgaatatggtgtacgcctttggttttgactgtaccgatgtcttcgatttaaccaaagctgagattgccggaaggcagcaagcattatgggcaattgacgcactacgccactatgttccgggctttgaaaatgtacggttacgcaattttggtgccacgctggggacgcgtgaatcacggcttattgagggggaaatacgtattgctgatgattacgtccttaatcaggggcgttgttcggacagtgtagggattttcccggaatttattgatggttccggttatctcattttgccaacgaccgggcgtttctttcagatcccttatggttgtctggtgccgcaaaaagtggagaaccttttggtcgccggtcgctgtatttccgcaggcgtagttgcacatacttctatgcgtaacatgatgtgttgtgccgttaccggtgaggccgcaggtactgccgccgtggtttcgctacagcaaaattgcaccgtgcgtcaggttgctatccctgatttgcaaaacacgctgcaacagcagggcgttcgtctggcataa

SEQ ID NO: 9906 - protein, 454 aa, Escherichia coli
MVDMINESARQTPVIAQTDVLVIGGGPAGLSAAIAAGRLGARTMIVERYGSLGGVLTQVGVESFAWYRHPGTEDCEGICREYEGRARALGFTRPEPQSISEVIDTEGFKVVADQMITESGVEPLYHSWVVDVIKDGDTLCGVIVENKSGRGAILAKRIVDCTGDADIAARAGAPWTKRSKDQLMGVTVMFSCAGVDVARFNRFVAEELKPTYADWGKNWTIQTTGKEDPMFSPYMEDIFTRAQQDGVIPGDAQAIAGTWSTFSESGEAFQMNMVYAFGFDCTDVFDLTKAEIAGRQQALWAIDALRHYVPGFENVRLRNFGATLGTRESRLIEGEIRIADDYVLNQGRCSDSVGIFPEFIDGSGYLILPTTGRFFQIPYGCLVPQKVENLLVAGRCISAGVVAHTSMRNMMCCAVTGEAAGTAAVVSLQQNCTVRQVAIPDLQNTLQQQGVRLA

SEQ ID NO: 9907 - DNA, 1542 bp, Escherichia coli
atgcactatttaaaaaaacgcttttctttgattgaactgaatgtgtttatcccagcaatattatttattgcggtaatcattctgtgtttgacgatatatccacaagataccagccggtatataaataaaatacatcattttttaacctgggaaatgggcgggatttttctggtcatgacttttctggttgtactttgttgtctgtggctggccttctcacgttatggcgatatcttgttaggtcagtcgggagaaaaacctgacttcagcttgttaacctggcttggacttatttttacttctggaacggggggcagcttgttatatctggcctctgtagagtggatttggatcattcagcaaccgccttttggcgcaacagcaggaagcgctcaggctgctcgttgggcctctgtttatggcatgttccattgggggccgtccgcatgggcatggtatttgatttgcgccgttcctattggttggtttatgcatgttaagaaaacaaactcattaaaggtcagtgatttatgtcgtggatgtttgggagcgcgtgcggatggtttttgcgggcattgtgtgaattttttctacatgtttggtttgctcggcggcgcggtaacgtctctggcgctgggaacgccgatgatttctgccgtattttgccatgtgttccatctggatcctgccgggcagtttatcaatgtcatggttatttttatctggacgctagtaccattattcattctcttttttggacttaaaaaaggtgtggcatgggccagtaactggaatattcgtgctgacattttgatgctactggcaatactgatttgtggaccaacggcatttatacttaatcaatcaattgatggtctcggcctgatgctgcaaaattttgtagcgatgagtttaagtaccgatgctattggtcgtagcggatttccacagatgtggaccgtattttatttttcatggtgggtcgtgtatgccatcccattcggtttatttatcgcccgtatttcaaaaggaaggacgatccggcaattgattgtatgtggaactctggcaggttcattgggatgcatggttttttacatggtactggctaatttcggcttatcgttgcagacaactcatgtcatcgattttgttcccatacttaacgaacaagggcgaggcgttgtcgtttctcgtttactggagcagctacccgcaagtcaggtgtttttggttgcttttggggctatagcattaatttcatatattaccggacactgtactgtgggttatgccctcggttttgcgacgcaaaaacgggcagatagtgagagtgaaccggcattctggaacgtggcattttggttgattatgactggaatcgtcgccatcacactctatcttcttgatgcgcaaagtctgcaaccgctacaaacggtgtctattctggctggactaccgctttgcggcgtggtgtttattttattgaagagttttttgacgcagcttgcggctgaagagaaaaacgcgagagatgaataa

SEQ ID NO: 9908 - protein, 513 aa, Escherichia coli
MHYLKKRFSLIELNVFIPAILFIAVIILCLTIYPQDTSRYINKIHHFLTWEMGGIFLVMTFLVVLCCLWLAFSRYGDILLGQSGEKPDFSLLTWLGLIFTSGTGGSLLYLASVEWIWIIQQPPFGATAGSAQAARWASVYGMFHWGPSAWAWYLICAVPIGWFMHVKKTNSLKVSDLCRGCLGARADGFCGHCVNFFYMFGLLGGAVTSLALGTPMISAVFCHVFHLDPAGQFINVMVIFIWTLVPLFILFFGLKKGVAWASNWNIRADILMLLAILICGPTAFILNQSIDGLGLMLQNFVAMSLSTDAIGRSGFPQMWTVFYFSWWVVYAIPFGLFIARISKGRTIRQLIVCGTLAGSLGCMVFYMVLANFGLSLQTTHVIDFVPILNEQGRGVVVSRLLEQLPASQVFLVAFGAIALISYITGHCTVGYALGFATQKRADSESEPAFWNVAFWLIMTGIVAITLYLLDAQSLQPLQTVSILAGLPLCGVVFILLKSFLTQLAAEEKNARDE

SEQ ID NO: 9909 - DNA, 1143 bp, Escherichia coli
atgaagatagttatctcccccgactcctttaaagaatgccttcccgcatggaaagtcgctgaagcgctggcaaccggctggcgcaaggtcctgcctggcagccaactggtgtgtttgcccgtggctgacggcggcgaaggcacgctcgaaacactcattcatgcgactgacggtacgttttacactaaaaaagtcaccggaccgcttggcgaatcaatacatgcgcaatacggtattttaggcaaccaaaccaccgcagtgatagaactggcacaagcttcagggctggaactggtttctcctgtccagcgttctcccctttatacgacgtcgtttggcactggcgaacttattctcgccgccctggaacacaatattgataccgttattctatgcctgggtggcagtgctacaaatgatggcggtattgggttgatgtcggcacttggcgcatcgtttacagacgccgaagggctatcagtctctgttaatgggatggggctggcggcaattcaccacattgacttacagcacctcgatccacgattgaaaaatgtgaaatttattgcggcctgtgatgtcaccaacccactaaccggcgataacggcgcgacccgggtttttgctcaacaaaaaggggccagtgctaacgaccttgagcaactggaacagggaatgaaaaactatgcccgttgcatctaccgttgttgtggtaaagacgtcgatacgatacccggttctggggcggctggcggcgttggcgcggccttgatggcttttctcgatgctcgcttacaaccgggtatttcgctcgtgctggaagcgattcaatatacccaacatttaaaatacgcagcattggccattgtcggtgaagggaaattagatagtcagagcctgaatggcaaagcgcccgtaggcgcagccaaagttgcccagatgatgggcgttccggttatcgcaattgccgggtatatcgatgatcaacttgatctgaatgagttacgccagtgtggaatagaagcctgtttttctgtcgtcaacggcccttgcaatttaccgaccgcgctgagtcagggagaaaataatttaattcgtcttggagaaaatctggcgggatattttcgtgcgatcctgagttaa

SEQ ID NO: 9910 - protein, 380 aa, Escherichia coli
MKIVISPDSFKECLPAWKVAEALATGWRKVLPGSQLVCLPVADGGEGTLETLIHATDGTFYTKKVTGPLGESIHAQYGILGNQTTAVIELAQASGLELVSPVQRSPLYTTSFGTGELILAALEHNIDTVILCLGGSATNDGGIGLMSALGASFTDAEGLSVSVNGMGLAAIHHIDLQHLDPRLKNVKFIAACDVTNPLTGDNGATRVFAQQKGASANDLEQLEQGMKNYARCIYRCCGKDVDTIPGSGAAGGVGAALMAFLDARLQPGISLVLEAIQYTQHLKYAALAIVGEGKLDSQSLNGKAPVGAAKVAQMMGVPVIAIAGYIDDQLDLNELRQCGIEACFSVVNGPCNLPTALSQGENNLIRLGENLAGYFRAILS

SEQ ID NO: 9911 - DNA, 888 bp, Escherichia coli
atgaatattggatttatcggcaccggcataatgggtaagccgatggcttataatttacaacaagccggacatactctttatttttcagcgcattttgaacctgcaccgcaagagtttattggtgaacgtggcattgtttgctctacaccgcgtgaagtcgcgcaggagtgtgaggtcatcatcaccatgctccctgataccccacatgttgaggatgttctttttcatcccaactatggcgtaatacacggtttaagccacgggaaaattgtgattgatatgagttcaatttccccggttgccaccaaagcatttgcacaacgtattatcgcgggaggcgcggaatatatcgatgcgcccgtctctggcggtgaagttggcgcgaaagccgggacgctttccattatggttggcggatgtgaagaggtttatttgcagatcaaaccgattctggaattgatgggtaaaaatatcactctggtcggtaacgtcggtgatggtcaaacgtgcaaagtcgctaaccaaattattgttgcactgaatattgaagcggtggctgaagccctgctctttgccagtaaatcaggtgccgatcccgcccgcgtacgtgaagcgctgatgggagggtttgcctcctctcgcgtgctggaagttcatggcgaacggatgataaaaggaacattcgaacccggttttcgtattagtctgcatcaaaaagatctgaatctggcgctggagaatgcccgcctgttgaataccccgcttcctaacacggcgacgacacagcagttatttagcgcctgcgccgcgctcggtggtaaagagtgggatcattctgcgttaattcgggcgcttgaaacacaagccaatttcactatccgtaaataa

SEQ ID NO: 9912 - protein, 295 aa, Escherichia coli
MNIGFIGTGIMGKPMAYNLQQAGHTLYFSAHFEPAPQEFIGERGIVCSTPREVAQECEVIITMLPDTPHVEDVLFHPNYGVIHGLSHGKIVIDMSSISPVATKAFAQRIIAGGAEYIDAPVSGGEVGAKAGTLSIMVGGCEEVYLQIKPILELMGKNITLVGNVGDGQTCKVANQIIVALNIEAVAEALLFASKSGADPARVREALMGGFASSRVLEVHGERMIKGTFEPGFRISLHQKDLNLALENARLLNTPLPNTATTQQLFSACAALGGKEWDHSALIRALETQANFTIRK

SEQ ID NO: 9913 - DNA, 504 bp, Escherichia coli
atggcaaagtttgcagcgaatttatcaatgctttttaccgagcatccatttattgaacgttttgcgcaggcaagtcacgcaggattccacggcgttgaatatctttttccctatgacttttccactgacgagctggcttcgcaactgcatcaacataatctgactcaggttttgtttaatcttcctgcgggtaactggcaagagggtgaacggggtattgcatgtcatcctagtcgggcaaaagaatttcaggagggtgtttgcagagcgatagaatatgcccaggcccttaattgttcacaagttaattgccttgcaggaaaacatccaggtggttattcgcatgaacaatgtcatgaaacactggtcgaaaatttgcgctatgcagtagataaattggcttctcatggcataaagttagttctggaagccattaatacaaaagatattcccggttttttgttaacaacaccagacaagccctcaatattattcatgatgtaa

SEQ ID NO: 9914 - protein, 167 aa, Escherichia coli
MAKFAANLSMLFTEHPFIERFAQASHAGFHGVEYLFPYDFSTDELASQLHQHNLTQVLFNLPAGNWQEGERGIACHPSRAKEFQEGVCRAIEYAQALNCSQVNCLAGKHPGGYSHEQCHETLVENLRYAVDKLASHGIKLVLEAINTKDIPGFLLTTPDKPSILFMM

SEQ ID NO: 9915 - DNA, 207 bp, Escherichia coli
ttgaatatgttcaatgttattcaggttgtttttgattgttgtagcaatattcccttccatgatttgcatatgataaatatcgtattgatagcgaaaatcaggatgatttacatcatgaataatattgagggcttgtctggtgttgttaacaaaaaaccgggaatatcttttgtattaatggcttccagaactaactttatgccatga

SEQ ID NO: 9916 - protein, 68 aa, Escherichia coli
MNMFNVIQVVFDCCSNIPFHDLHMINIVLIAKIRMIYIMNNIEGLSGVVNKKPGISFVLMASRTNFMP

SEQ ID NO: 9917 - DNA, 1293 bp, Escherichia coli
atgcgttcaggccgccctggcccggttcttttagatctcccttttgatgttcagatgaccgaaattgagtttgatatcgatctctatcagccactaatcccctggcaacctaaggcaacacgggcccaggccgtacgcgcattagaaatgctaaatgacgccgaaaagcccgtcatcatcgctggcggtggcattattaacgccgaagcgagtgaattgttgcgtgagtttgtcgagttaactggcgttcccgtcattcaaaccttacgcggttggggcgctttatcagacgatcaccccctaatgattggtcgcatgggatgtcaggcgggtcatcgctatggtaacgccagttatctggcctcagattttgtttttggtatcggtaaccgttgggcaaaccgccataccggagccattgagacctacaccgaaggccgcaaattcattcatgttgatatcgaacctgcacaaattggccggatatttgcgccggatctgggcattgtttctgatgctgaaagcgccttaacgctatttattcaggtcgcccgtgatatgaagtcacgtggagaactgaaagaccgcagtcgctggattgccgaatgtgccgagcgtaaacgcacaatgcttcgtcgttcagactttgactgcaatccaattaaaccgcagcgcgtgtatcacgaaatgaataaggttttcggaccggagacacgctatatttcgacaattggtctggcgcaaatcgccgcaaaccaatttttacatgtttaccgcccacgccactggattaatgcctgtcaggctgggccgctaggctggacaatgcccgcagcactgggcgcggtaaaagctgatccatctgttcccgttgtggcaatatccggtgattacgattttcaattcttgattgaagaattagccgtcggcgcacaatttaatcttccgtatatccatattttacttaacaacgcttatcttggtttgattcgtcaatcacaacgtgcatttgatattgattattgcgttcaactgtcatttgaaaatattaatgctccagaaattaatggttatggcgttgatcataaagctgtggttgaaggattaggatgtaaagcgattcgcgtattcgcatcacaggatattgcgcctgcactgcaagaagcccagcgtttgcgtgacgaatttcacgtacctgttgttgtagaaattattactgaacgcgtgactaatatcgctatgggacctgacattaataaagtcacagaatttgaagaaattctcgatttataa

SEQ ID NO: 9918 - protein, 430 aa, Escherichia coli
MRSGRPGPVLLDLPFDVQMTEIEFDIDLYQPLIPWQPKATRAQAVRALEMLNDAEKPVIIAGGGIINAEASELLREFVELTGVPVIQTLRGWGALSDDHPLMIGRMGCQAGHRYGNASYLASDFVFGIGNRWANRHTGAIETYTEGRKFIHVDIEPAQIGRIFAPDLGIVSDAESALTLFIQVARDMKSRGELKDRSRWIAECAERKRTMLRRSDFDCNPIKPQRVYHEMNKVFGPETRYISTIGLAQIAANQFLHVYRPRHWINACQAGPLGWTMPAALGAVKADPSVPVVAISGDYDFQFLIEELAVGAQFNLPYIHILLNNAYLGLIRQSQRAFDIDYCVQLSFENINAPEINGYGVDHKAVVEGLGCKAIRVFASQDIAPALQEAQRLRDEFHVPVVVEIITERVTNIAMGPDINKVTEFEEILDL

SEQ ID NO: 9919 - DNA, 444 bp, Escherichia coli
atggcgaggatgcgtgcaatcgaagctgcagtagaaatactgaaaaaagaaggcattagcgttgcttttggtgtacccggcgcagcaataaacccactctatgccgcgatgaaaaaatcaggcggtattgatcatattctggcccgtcatgttgagggcgcctcgcatatggctgaaggttacacccgcagtcagaatggcaatattggcgtgtgtattggcacatcaggccctgcgggcactgatatgattaccgggctgtattctgcctctgcggattccattcctattctctgcattactggtcaagctcccgtaggaaaacttcataaagaagatttccaggccgtcgatattgaggctatcgccacgccagtaaccaaaatggctcgcacaattctcgaagcgggtcagttgccggggatattccagaaagccttctag

SEQ ID NO: 9920 - protein, 147 aa, Escherichia coli
MARMRAIEAAVEILKKEGISVAFGVPGAAINPLYAAMKKSGGIDHILARHVEGASHMAEGYTRSQNGNIGVCIGTSGPAGTDMITGLYSASADSIPILCITGQAPVGKLHKEDFQAVDIEAIATPVTKMARTILEAGQLPGIFQKAF

SEQ ID NO: 9921 - DNA, 1950 bp, Escherichia coli
atggatattattataatgaataaagagtcgtatcataatgatctaaaaaataaatggaaaatgtttgttaagcatggttgggtcgcgacaaattcgactaatcatgtgatgctgaggtcatggcaaaaatgtctcaagcattgtgaccctcgccactggaacacgcctgtcaaagcttccgggcaaacattgcagacgattttttctcgtaacgaagagtttattagaatttcacaaagagttgttgaagaccatttcaccctggctggtgacgaccggttggcatttttgatcattgatccacacggctgggttctatcgttgaatgcagcaggcgattattccagtcaattgcgagagttaggaattgaatctggtatgtcatgggccgaagatggcattggaaccaatgtatatagtctttgtcgggaaacaaatttatatacacaactggaaggagcagaacattttagtgaacagctacattgttatgcgatgagcgctgctccggtcattgattattatggtaatatacatggatacattgtatgtataattgaaaccaccgccgagcttgttaaattaaaaacatcatattcatgtgcaacagaaatcgctaattatatctatattgagaatgaacaaaagttaataaacaaagtactttgccagcataatgctgtgattgaatgtatggatgacggttttatttgttggaatagtcattctttaattacgatggttaattctcaagcacaaacattactgaatattgataaagaaagtttaattggtcagaacatccgaaaaggattcgtatttccgccgattttgaatgaggcaattacacaacgaaacaaactatcgcaaaagcaaattgtcctcgaatgccgtggcgaatttattgaacttatggttacccttcgcccgttaagcgatggttcgtttttgctttttcttcatccattagacaaaatcaggaaaatagcccaacagcaaataagcactaatgcaaattttacctttgacagtttacatgcggcttcaggtggtatgaagcaggtattacttatcgctcgccgggcaattaaatccatctctccgattttgatcaatggcgaagaaggtgtgggaaaattgagtttggcgatggcaatacataatgagagcgagcaacgtgatgggccatttatttctgtagattgtcagatgctatcaccagaaaatatcttacacgaacttcttggctctgatgttggcccttcgccatcgaaatttgaactggctcataatggcaccttatatctggataaagtcgaatatctatcaggggaagttcagagtgttttattgaaagtattgaaaacggggcttgttactcgctcagacagccatcgtttgatccccgtacgctttcgtctgattacatgtaccagtagttctttacgtgagtacgtgcaacaaggggcttttagccgacagctatattatgagatctccatgaatgaaattgaaattccgccattgcgcaaacgtcgtgaagatctcaagcaaatgattgacgatattattgataagtatcaggagcgcacgcgaaaaaaaatgacaatcacgcctgacgcaaattcagttctgcttgagtaccgttggcctgggaacatctccgagttcaaaaatcgaatggagaaggtatttattaactgcaatcgacttgtactcgggttagagaatattcctctggatatccgacaaaataacagtagtggcgacgatgatatccctcatcttacttcactggcagaattggagatgcaagctattgagcatacatgtcgtgtctgcgaatggaatctaactaaagcagctgaagtattaaaaattggtcgtacaacattatggcgcaaacttaagatctataatctctatccaaatgttgagcatgcagattga

SEQ ID NO: 9922 - protein, 649 aa, Escherichia coli
MDIIIMNKESYHNDLKNKWKMFVKHGWVATNSTNHVMLRSWQKCLKHCDPRHWNTPVKASGQTLQTIFSRNEEFIRISQRVVEDHFTLAGDDRLAFLIIDPHGWVLSLNAAGDYSSQLRELGIESGMSWAEDGIGTNVYSLCRETNLYTQLEGAEHFSEQLHCYAMSAAPVIDYYGNIHGYIVCIIETTAELVKLKTSYSCATEIANYIYIENEQKLINKVLCQHNAVIECMDDGFICWNSHSLITMVNSQAQTLLNIDKESLIGQNIRKGFVFPPILNEAITQRNKLSQKQIVLECRGEFIELMVTLRPLSDGSFLLFLHPLDKIRKIAQQQISTNANFTFDSLHAASGGMKQVLLIARRAIKSISPILINGEEGVGKLSLAMAIHNESEQRDGPFISVDCQMLSPENILHELLGSDVGPSPSKFELAHNGTLYLDKVEYLSGEVQSVLLKVLKTGLVTRSDSHRLIPVRFRLITCTSSSLREYVQQGAFSRQLYYEISMNEIEIPPLRKRREDLKQMIDDIIDKYQERTRKKMTITPDANSVLLEYRWPGNISEFKNRMEKVFINCNRLVLGLENIPLDIRQNNSSGDDDIPHLTSLAELEMQAIEHTCRVCEWNLTKAAEVLKIGRTTLWRKLKIYNLYPNVEHAD

SEQ ID NO: 9923 - DNA, 1371 bp, Escherichia coli
atggaattttatctggaacccgctcgtaatatacctgtactggcaaccacggaagtgttagttgttggtggtggtccatcgggtattgccgcagcaatgagtgccgctcgtgaaggcgcagctactatgctgattgaacgtttcggttgttttggcggaatgatgacaacggctggcgtcgagtcaattgcctggtggcgtcatgaaaatacggtagagtcaggtggactggcacgcgaaatagaagaaacggcaaaatcaatgggggcgtccagccctgagccgcaatcgaatagtcaggctattaacgccgagcgtttcaaactggttgcggatgcaatgcttgaacaggcaggtgtgcgccgcgtactacacattaccgccgttgatgttatcaagcagggcaataatttactcggcgtaataacagagagtaaatctggtcgtcaggctattttggcaaatgtcattattgactgtactggtgatgctgatattgcatggtttgccggagcaccatttattaagcgtgaacgcgaagagctaatgtgtatgacaaccgtttttagttgcgcaaatataaataaaaacgcgttcatgcaaaatattaatagcacggaacctaaatatggagactggggggcggatgaagaaaataaaaactggtcttatgatgttcatgaatcttgtcgcgatatgtttagcccttatctgggtaaagtctttgcgaaaggaaagtcggcaggaattattccaaaagatgtgacgttaggcggttcctggagtacggtcaccgagtatggtgatgcgaattacttgaacgttgtcagcatccctgccgtcgattgtacggatgtttttgacctgacgcgtgcagaaatagaaggccgcaagcaagccatgcaggcgattgaagcgttgcgtcaattccagccaggatttgaacaggcacaattaaaaaatttcggtatgacggtgggaacaagagaatcaagacatattattgggcgagtccagcttacggaaaatgatatttgtaatgagggacgtcatgcggattcaataggggtattccctgagtttatagatggaaatggtcatcttaaattacctcttgaagcgaactattttcaaatcccttatggcgtaatgattccgcagcaagttgaaaacctgttggtttgcggacgggcaatcgatgcagataatttcgcctatgcgacaatccgtaatatggggtgttgtattgtcactggagaaggtgcagggactgccgctgctattgccattaaaaataacactaccgtttcacaggtagatattcagacggtacaggaacgcttacagcaaaatggcgtaaaagtcttttaa

SEQ ID NO: 9924 - protein, 456 aa, Escherichia coli
MEFYLEPARNIPVLATTEVLVVGGGPSGIAAAMSAAREGAATMLIERFGCFGGMMTTAGVESIAWWRHENTVESGGLAREIEETAKSMGASSPEPQSNSQAINAERFKLVADAMLEQAGVRRVLHITAVDVIKQGNNLLGVITESKSGRQAILANVIIDCTGDADIAWFAGAPFIKREREELMCMTTVFSCANINKNAFMQNINSTEPKYGDWGADEENKNWSYDVHESCRDMFSPYLGKVFAKGKSAGIIPKDVTLGGSWSTVTEYGDANYLNVVSIPAVDCTDVFDLTRAEIEGRKQAMQAIEALRQFQPGFEQAQLKNFGMTVGTRESRHIIGRVQLTENDICNEGRHADSIGVFPEFIDGNGHLKLPLEANYFQIPYGVMIPQQVENLLVCGRAIDADNFAYATIRNMGCCIVTGEGAGTAAAIAIKNNTTVSQVDIQTVQERLQQNGVKVF

SEQ ID NO: 9925 - DNA, 114 bp, Escherichia coli
atgcaggaaaacgccgctgaaattaataaacagacgctggcaggccagcccataacaccgatgccaacaaccaacacgatcatcataaaaatgatcggtgtaagcgcgacataa

SEQ ID NO: 9926 - protein, 37 aa, Escherichia coli
MQENAAEINKQTLAGQPITPMPTTNTIIIKMIGVSAT

SEQ ID NO: 9927 - DNA, 1404 bp, Escherichia coli
atgagagaaaaacccagtttttatgtcgcgcttacaccgatcatttttatgatgatcgtgttggttgttggcatcggtgttatgggctggcctgccagcgtctgtttattaatttcagcggcgttttcctgcattattgcaatggctaagctgaaatatacctgggatgaaatccaggggtttattatcgataagatttcggcggtgatggcaccggtacttatcgttattttcgttggctttatggtcgcgacatggagctatgcaggtacactgccgatgctggtttattacggtatgttactggttgcgcccgcatggctttatgccatagcgttttttctgaacgcagtattgtcctatgtttccggggcatcatggggatctgtcgcttctattggtgttgcattaatgggcatcggttccggcttacatgccgatcttccaattctggcggcagccattgttaccggggcttattttggcgacaaactttcaccgttaagtgataccaccaacctgacttcagcggtaaccaaaactaaactttatgatctgattaaatatctactctggacgaccatcccatcaacgattattagcctgctgttttttacctggctgggaatgattcatacttctacgggctctatttcaccagaaagcatgcagatgctggtacagctcaaagagttatataagtttggtctgttaccgctactgcctatgcttattgttctgtgctttacctttttgcgtttgcctacagtaccggcattattaagcagtgcgttcgtggccgtattggttggatggctgtatcaaggtttcccgctggccgaaggtattaaggccacaatgagtggtttccgtctgacgatgatcactgattcaacgacgctgttaccttctgtgaaagaactgcttgaacaaggcggcctgaataatcagggcggattcctgtcatttattatctgcgccatgatgtttgctggcatcctgacgggaacaggaatgatggatgtcacattacaaagtgcggcaaacaaaataaaaagtgcttttggcgctattctggcaagtggtgttttagcggtcatcattaacttgcttaccggttctgatggtttgaataagattgttatatctgaattgatgatgaagaaattcgaagatcttaatttatctccattagttttagcccgaacgctggaagattttggcaccatgagtgcgccaataattccgtggtcagccgccggattgtatatggcgacgacgctaggtgttccgacgtttagttacctgccgtactgtgtattctgtttctgctcgatgatatttgcgttgatctatgcttctacaggtttccgtttactgcgcttcaacgaagcaaaggcctga

SEQ ID NO: 9928 - protein, 467 aa, Escherichia coli
MREKPSFYVALTPIIFMMIVLVVGIGVMGWPASVCLLISAAFSCIIAMAKLKYTWDEIQGFIIDKISAVMAPVLIVIFVGFMVATWSYAGTLPMLVYYGMLLVAPAWLYAIAFFLNAVLSYVSGASWGSVASIGVALMGIGSGLHADLPILAAAIVTGAYFGDKLSPLSDTTNLTSAVTKTKLYDLIKYLLWTTIPSTIISLLFFTWLGMIHTSTGSISPESMQMLVQLKELYKFGLLPLLPMLIVLCFTFLRLPTVPALLSSAFVAVLVGWLYQGFPLAEGIKATMSGFRLTMITDSTTLLPSVKELLEQGGLNNQGGFLSFIICAMMFAGILTGTGMMDVTLQSAANKIKSAFGAILASGVLAVIINLLTGSDGLNKIVISELMMKKFEDLNLSPLVLARTLEDFGTMSAPIIPWSAAGLYMATTLGVPTFSYLPYCVFCFCSMIFALIYASTGFRLLRFNEAKA

SEQ ID NO: 9929 - DNA, 729 bp, Escherichia coli
gtgacgccgctgcaactctcggaacaagggaaaatctttcattcgcagatccgccatctgttgcaacagttagaaagcaacctggcagagctgcgtggcggcagcgattacgcgcaacgtaaaatcaagattgccgctgcacactctctttccctcggtctgttaccgtccattatcagccagatgccgccgctctttacctgggcgattgaagccattgatgtcgatgaagcggtcgataaactgcgtgaagggcaaagtgactgtattttttcctttcacgacgaagatttgctggaagcgccgtttgaccacattcgcttatttgaatctcaattgttccccgtctgcgcaagtgacgaacacggagaagcactgtttaacctcgcgcagccacactttccgttactgaattacagccgcaactcctacatggggcgattgattaatcgcaccctgacgcgccacagcgagttaagtttcagcaccttttttgtctcttcgatgagcgagctattaaagcaggttgccctcgacggctgtgggattgcctggctgccggagtacgccatccaacaagaaattcgcagcgggcagctcgttgtgcttaatcgggacgaactggtgatcccgattcaggcctacgcataccggatgaatacccgtatgaatccagttgccgaacgcttctggcgtgaactgcgcgagctggagattgtgcttagctga

SEQ ID NO: 9930 - protein, 242 aa, Escherichia coli
MTPLQLSEQGKIFHSQIRHLLQQLESNLAELRGGSDYAQRKIKIAAAHSLSLGLLPSIISQMPPLFTWAIEAIDVDEAVDKLREGQSDCIFSFHDEDLLEAPFDHIRLFESQLFPVCASDEHGEALFNLAQPHFPLLNYSRNSYMGRLINRTLTRHSELSFSTFFVSSMSELLKQVALDGCGIAWLPEYAIQQEIRSGQLVVLNRDELVIPIQAYAYRMNTRMNPVAERFWRELRELEIVLS

SEQ ID NO: 9931 - DNA, 267 bp, Escherichia coli
ttgttccgagagttgcagcggcgtcacctggcggttaaacaattcaacgccaatcgcctgttccagcgcgcggatgcggcggctgaatgccggttgcgagacgttgcgactgactgccgcctgggaaaaattgcggcatttttccagagtcagaaaatcataaagctatttggtttcaatattatgcaaaaccgcaccacagtcatccattacgttttactctgtcagccgcccttgcgggcattctacgtccattcgggcggctga

SEQ ID NO: 9932 - protein, 88 aa, Escherichia coli
MFRELQRRHLAVKQFNANRLFQRADAAAECRLRDVATDCRLGKIAAFFQSQKIIKLFGFNIMQNRTTVIHYVLLCQPPLRAFYVHSGG

SEQ ID NO: 9933 - DNA, 1173 bp, Escherichia coli
atgattgattattccgcagccggttttaccctgctgcagggagcgcatttgtatgcgccggaagatcggggaatttgcgatgtcctcatcgctaacggcaaaattattgccgttgccagcaacatcccttctgacattgtaccggactgcacggttgtcgatctcagcgggcagatcctctgcccaggttttattgatcaacacgtccatttgattggcggtggcggcgaagcaggtcccacgacgcgcacgccggaagtggcgctaagtcgtctgacggaagcgggcgtcacgtcagtggttggcctgctgggcaccgactctatctctcgccacccggaatccctgctcgccaagacccgtgcgctcaatgaagaaggcatcagcgcctggatgctgaccggcgcttatcatgtcccttcccgcactattacgggttccgtggaaaaagacgtggcgattatcgatcgcgtgattggtgtgaaatgcgccatctctgatcaccgttctgccgcaccggacgtttatcacctggctaatatggcggcggaatcccgcgttggcggtttgctcggcggtaaacctggcgtcaccgtgttccacatgggtgacagcaaaaaggcgttacagcctgtctatgacctgctggaaaactgcgatgtgccgatcagcaagctgctgccgacccacgttaaccgcaacgttccgttgtttgagcaggcgctggagttcgcgcgcaaaggcggcaccatcgacatcaccagcagcattgacgaaccggtcgcccctgccgaaggtattgcccgcgccgttcaggcgggtattccgctggcacgcgtcactctcagctccgacggcaacggtagccagccgttcttcgatgacgaaggaaatttaacccatatcggtgttgcaggttttgaaacattgctggaaaccgtgcaggtgctggtcaaagactatgatttcagtatcagcgatgccctgcgcccgctcaccagtagcgtagccggtttccttaacctgaccgggaaaggcgaaattctgcctggcaatgacgcagacttactggtcatgacgccagaattgcgcattgagcaggtatacgctcgcggcaaactgatggtcaaagacggcaaagcctgcgttaaaggaacgtttgaaacggcttaa

SEQ ID NO: 9934 - protein, 390 aa, Escherichia coli
MIDYSAAGFTLLQGAHLYAPEDRGICDVLIANGKIIAVASNIPSDIVPDCTVVDLSGQILCPGFIDQHVHLIGGGGEAGPTTRTPEVALSRLTEAGVTSVVGLLGTDSISRHPESLLAKTRALNEEGISAWMLTGAYHVPSRTITGSVEKDVAIIDRVIGVKCAISDHRSAAPDVYHLANMAAESRVGGLLGGKPGVTVFHMGDSKKALQPVYDLLENCDVPISKLLPTHVNRNVPLFEQALEFARKGGTIDITSSIDEPVAPAEGIARAVQAGIPLARVTLSSDGNGSQPFFDDEGNLTHIGVAGFETLLETVQVLVKDYDFSISDALRPLTSSVAGFLNLTGKGEILPGNDADLLVMTPELRIEQVYARGKLMVKDGKACVKGTFETA

SEQ ID NO: 9935 - DNA, 462 bp, Escherichia coli
atgacaactcaggtccgtaaaaacgtcatggatatgtttattgatggcgcgcgccgtggctttactatcgctaccaccaacctgctgccaaacgtggtgatggcctttgtcatcatccaggcgctgaaaattactggcctgctcgactgggtgggacatatctgtgaacccgtaatggcgctgtggggattgcccggtgaagcggcaaccgtccttttagccgcattgatgagcatgggcggcgcagtcggtgttgccgccagtctggcgaccgctggcgcattaaccggccacgatgtcaccgttttactgcccgcgatgtatttaatgggcaacccggtgcaaaatgtcggtcgctgcctggggacagccgaagtgaatgccaaatattatccgcatatcattacggtctgcgtgattaacgcattgctgtcgatctgggttatgcagcttattgtttaa

SEQ ID NO: 9936 - protein, 153 aa, Escherichia coli
MTTQVRKNVMDMFIDGARRGFTIATTNLLPNVVMAFVIIQALKITGLLDWVGHICEPVMALWGLPGEAATVLLAALMSMGGAVGVAASLATAGALTGHDVTVLLPAMYLMGNPVQNVGRCLGTAEVNAKYYPHIITVCVINALLSIWVMQLIV

SEQ ID NO: 9937 - DNA, 684 bp, Escherichia coli
atgacacaacaaggggatgctgtagctggggagctggcgacagaaaaagtgggtgttaaagggtatctggccttttttctcacgattatctttttttccggtgttttttccgggacagacagttggtggcgcgtttttgacttttccgttctgaacggatcgtttgggcaactgcctggtgcgaatggcgctaccacctcgtttcgcggcgcaggtggcactggagctaaagatggctttctcttcgcgctggaactggctccgtcagtgattctctctctgggaattatctcgattaccgatggtcttggcggattgcgcgccgcgcagcagttaatgacgcccgtgctaaaaccgttgttgggcattccaggcatctgttcactggcgctgattgctaacctgcaaaacaccgatgccgccgcaggtatgaccaaagaactggcgcaggaaggggaaattaccgaacgtgataaagtgatattcgccgcctatcaaaccagcggtagcgccatcatcaccaactacttctcttccggcgtcgcggtgtttgcctttctgggcacgtccgtaatcgtacctttagccgtcatcctggtgtttaaatttgtcggagccaacattttgcgcgtctggcttaacttcgaagaacgtcgcaacccaacgcaaggagcgcaagcatga

SEQ ID NO: 9938 - protein, 227 aa, Escherichia coli
MTQQGDAVAGELATEKVGVKGYLAFFLTIIFFSGVFSGTDSWWRVFDFSVLNGSFGQLPGANGATTSFRGAGGTGAKDGFLFALELAPSVILSLGIISITDGLGGLRAAQQLMTPVLKPLLGIPGICSLALIANLQNTDAAAGMTKELAQEGEITERDKVIFAAYQTSGSAIITNYFSSGVAVFAFLGTSVIVPLAVILVFKFVGANILRVWLNFEERRNPTQGAQA

SEQ ID NO: 9939 - DNA, 462 bp, Escherichia coli
gtgtggcaaaggttctgcgcaggattgagttgcagaaaattcataaacccagtgacaatgacatcagtaaataaaaacagaaaattcagggacgaaaacgcgatggcaaaatacaacgacaaagagctggcagagacgagcaagtttttaagttttgtcctccgacataaaccagaggcgattggcatcgtgctggaccgtgaaggatgggcggatatcgataagctcatactctgtgcccaaaaagcgggcaagcggttaacccgcgcattactggatatcgttgtcgccaccagcgataaaaagcgctttagttattccagtgatggtacgtgtattcgcgccgttcaggggcatttgacttcgcaggtcgccattggcttcatcgaaaaaacaccgccacaatttctctaccacggtacggcaagccgttttcttgacgagataaaaaacaagggctga

SEQ ID NO: 9940 - protein, 153 aa, Escherichia coli
MWQRFCAGLSCRKFINPVTMTSVNKNRKFRDENAMAKYNDKELAETSKFLSFVLRHKPEAIGIVLDREGWADIDKLILCAQKAGKRLTRALLDIVVATSDKKRFSYSSDGTCIRAVQGHLTSQVAIGFIEKTPPQFLYHGTASRFLDEIKNKG

SEQ ID NO: 9941 - DNA, 174 bp, Escherichia coli
gtgcatctctctgctgatgaagcaacggcacgcaaagtaggagcaagacacggatcgccagttattttaaccgtcaaagcacaggaaatggcgaaacgaggcatccctttttggcaagcggaaaacggggtctggctgacatcaacggttgcggttgagtttcttgagtggtaa

SEQ ID NO: 9942 - protein, 57 aa, Escherichia coli
MHLSADEATARKVGARHGSPVILTVKAQEMAKRGIPFWQAENGVWLTSTVAVEFLEW

SEQ ID NO: 9943 - DNA, 1179 bp, Escherichia coli
atgccttcgccctcgcatcccgtagaacgcttttctttcagcaccgcgcttttcgggatgctggttctgaccttaggtatgggtttaggccgcttcctttatacgcctatgttgcccgtcatgatggcggaaggatcgttttcatttagccagctctcgtggattgccagcggcaactatgcggggtatctggctggcagtctgctattttcgtttggcgcatttcaccagccatcgcgcctgcgcccatttctgttggcttctgccctggcgagcgggttgttgatcctcgcaatggcatggttgctgccatttattctggtgttattgattcgcgtcctggcgggtgtcgccagcgccggaatgctgatttttggttcgacgctgattatgcagcacacgcgccatccttttgtgctggcagctttgttttctggcgttggcattggcatcgcactgggcaatgaatatgttctggcaggcctgcattttgacctctcctcgcaaacgttatggcaaggcgccggggcgctttctggcatgatgctgattgcacttacgcttttaatgccctcgaaaaaacacgccatcacaccaatgccattggcaaaaacggagcaacagataatgagctggtggttactggctattctgtacggcctggcgggatttggttatatcatcgtcgcgacttacctgccgctcatggcgaaagatgcaggctcaccattgttaaccgcccatctctggacgttagtcggcttatcaattgtgcctggttgctttggctggctatgggcagcaaaacgttggggggctttgccctgcctgacggcgaatttgctggtgcaggctattagtgtgttgcttactctcgccagcgactcgcctctcttgcttatcatcagcagtcttggttttggcggtacctttatgggcacgacatctctggtgatgactatcgcccgccaactgagcgtaccgggaaatctcaatcttttaggctttgtgacactcatttacggcattgggcaaatcctcggcccggcgctaaccagtatgcttggcaatggaacatcggcgcttgccagcgccactctctgcggcgcggcggcgttgtttattgctgcgcttatcagcacagcgcaattatttaagctgcaagtggttacttcatga

SEQ ID NO: 9944 - protein, 392 aa, Escherichia coli
MPSPSHPVERFSFSTALFGMLVLTLGMGLGRFLYTPMLPVMMAEGSFSFSQLSWIASGNYAGYLAGSLLFSFGAFHQPSRLRPFLLASALASGLLILAMAWLLPFILVLLIRVLAGVASAGMLIFGSTLIMQHTRHPFVLAALFSGVGIGIALGNEYVLAGLHFDLSSQTLWQGAGALSGMMLIALTLLMPSKKHAITPMPLAKTEQQIMSWWLLAILYGLAGFGYIIVATYLPLMAKDAGSPLLTAHLWTLVGLSIVPGCFGWLWAAKRWGALPCLTANLLVQAISVLLTLASDSPLLLIISSLGFGGTFMGTTSLVMTIARQLSVPGNLNLLGFVTLIYGIGQILGPALTSMLGNGTSALASATLCGAAALFIAALISTAQLFKLQVVTS

SEQ ID NO: 9945 - DNA, 954 bp, Escherichia coli
ttgcacattacgggatttctccgcgttaaggattcattaagatcgctacgtatacttctcgatatcttattgatttgccttaaagggattaccgtgacaaaaagtatttcgttaagtaaacgcatcttcgttattgtgattctttttgtcattgtggcagtgtgtactttcttcgtgcaatcttgcgcccgtaaaagcaatcatgcagcatcatttcagaattaccacgccaccattgacggcaaagaaattgcaggcataacgaataatatctcttcgctgacctggtcggcacaaagcaatactctttttagcactatcaacaaacctgccgccattgttgaaatgaccaccaatggcgatttgatccgcacaattcctctggattttgttaaggatctcgagacgatcgaatacattggcgataatcagtttgtcattagcgatgagcgcgattatgccatttatgtgatttcactgaccccaaactcggaagtaaaaatcctcaaaaaaataaaaatcccgctgcaggaatccccaaccaattgcggttttgaaggattggcctattctcgccaggatcacactttctggttttttaaagagaaaaacccgattgaagtctacaaagttaacgggctgttaagtagcaatgaattgcatatcagcaaagacaaggcactacaacggcaatttactttagatgatgtgtccggcgcagaatttaaccaacaaaaaaatacgcttctggtgctgtctcatgaatctcgcgcactccaggaagtaacgctggttggcgaggttatcggtgaaatgtcactaaccaaaggcagtcgaggtttgtcgcataacatcaaacaggccgaaggggttgcgatggatgcctctggtaatatttatatcgttagcgaaccaaatcgtttttatcgctttacccctcaatcatcgcattaa

SEQ ID NO: 9946 - protein, 317 aa, Escherichia coli
MHITGFLRVKDSLRSLRILLDILLICLKGITVTKSISLSKRIFVIVILFVIVAVCTFFVQSCARKSNHAASFQNYHATIDGKEIAGITNNISSLTWSAQSNTLFSTINKPAAIVEMTTNGDLIRTIPLDFVKDLETIEYIGDNQFVISDERDYAIYVISLTPNSEVKILKKIKIPLQESPTNCGFEGLAYSRQDHTFWFFKEKNPIEVYKVNGLLSSNELHISKDKALQRQFTLDDVSGAEFNQQKNTLLVLSHESRALQEVTLVGEVIGEMSLTKGSRGLSHNIKQAEGVAMDASGNIYIVSEPNRFYRFTPQSSH

SEQ ID NO: 9947 - DNA, 258 bp, Escherichia coli
atgaaagagtatctgtttttatttcactccacggtcggcgtcatacaaacccgcaaggcgttgcaggcagcgggcatgacttttcgcgtcagcgatattccccgtgatttacgcggcggctgcgggttatgcatttggctgacctgtccgcctggcgaggaaattcaatgggtgatccctgggcatacggaatcagtttattgtcagcaggatggtggctggcgctgcattgcacattacgggatttctccgcgttaa

SEQ ID NO: 9948 - protein, 85 aa, Escherichia coli
MKEYLFLFHSTVGVIQTRKALQAAGMTFRVSDIPRDLRGGCGLCIWLTCPPGEEIQWVIPGHTESVYCQQDGGWRCIAHYGISPR

SEQ ID NO: 9949 - DNA, 768 bp, Escherichia coli
gtgacatattcgattggcattgattccggctcaaccaccaccaaagggatcttactggctgacggcgtgattacgcgccgtttcctcgttccaacaccctttcgcccggcaacagcaattactgaagcctgggaaactctgcgcgaagggttagagacaacaccgtttctgacgctcaccggctacggacggcaactggtggattttgccgataaacaagtgacggagatctcctgtcacgggctgggcgcacggtttcttgagccagcaacgcgcgcggtaatcgacatcggtggtcaggacagcaaagtgattcagcttgatgatgacggtaacctgtgcgatttcctgatgaatgacaaatgcgcggcgggcaccgggcgtttcctggaggtgatctcgcgcacgcttggcaccagcgtcgaacagctcgacagcattaccgaaaatgtcacgccgcacgccatcacgagtatgtgcacagtgtttgctgaatcagaagtgatcagcctgcgctctgcgggcgtagcgccagaagcgattctcgccggagtgattaacgcgatggcgcggcggagtgccaatttcattgctcgtctctcctgtgaagcgccgattctgtttactggtggcgttagtcattgccagacgtttgcccggatgctggaatctcacctgggaatgccggtaaatactcaccctgatgcgcaattcgctggtgcaattggcgcggcggtgatcggtcagcggcagagaaaacgcgcatga

SEQ ID NO: 9950 - protein, 255 aa, Escherichia coli
MTYSIGIDSGSTTTKGILLADGVITRRFLVPTPFRPATAITEAWETLREGLETTPFLTLTGYGRQLVDFADKQVTEISCHGLGARFLEPATRAVIDIGGQDSKVIQLDDDGNLCDFLMNDKCAAGTGRFLEVISRTLGTSVEQLDSITENVTPHAITSMCTVFAESEVISLRSAGVAPEAILAGVINAMARRSANFIARLSCEAPILFTGGVSHCQTFARMLESHLGMPVNTHPDAQFAGAIGAAVIGQRQRKRA

SEQ ID NO: 9951 - DNA, 1152 bp, Escherichia coli
atgtcacttgtcaccgatctacccgccattttcgatcagttctctgaagctcgccagaaaggctttctcaccgtcatggatctcaaggagcgcggcattccgctggttggcacctactgcacctttatgccgcaagagatcccgatggcagccggtgcggttgtggtttcgctatgttccacctctgatgaaaccattgaagaagccgagaaagatctgccgcgcaacctctgcccgctgattaaaagcagctacggcttcggcaaaaccgataaatgcccctacttctacttttctgatctggtggtcggtgaaaccacctgcgacggcaaaaagaaaatgtatgaatacatggcggagtttaagcccgttcatgtgatgcaactgccaaacagcgttaaggacgatgcctcgcgtgcattatggaaagccgagatgctgcgcttgcaaaaaacggtagaagaacgttttgggcacgagattagcgaagatgctctgcgcgatgccattgcgctgaaaaaccgcgaacgtcgcgcactggccaacttttatcatttggggcagttaaatcctccggcgcttagcggcagcgacattctgaaagtagtctacggcgcaaccttccggttcgataaagaggcgttgatcaatgaactggatgcaatgaccgcccgcgttcgtcagcagtgggaagaaggccagcgactggacccgcgcccacgtattttaatcaccggctgcccaattggcggcgcagcagagaaagtggtgcgcgcgattgaagagaatggcggctgggttgtcggttatgaaaactgcaccggggcgaaagccaccgagcaatgcgtggcggaaacgggtgatgtgtacgacgcgctggcggataaatatctggcgattggctgctcctgtgtttcgccgaacgatcagcgcctgcaaatgctcagccagatggttgaagaatatcaggtcgatggcgtagttgatgtgattttgcaggcgtgccatacctacgcggtggaatcgctggcgattaaacgtcatgtgcgccagcagcacaacattccttatatcgctattgaaacagactactccacctcggatgtcgggcagctcagcacccgtgtcgcggcctttattgagatgctgtaa

SEQ ID NO: 9952 - protein, 383 aa, Escherichia coli
MSLVTDLPAIFDQFSEARQKGFLTVMDLKERGIPLVGTYCTFMPQEIPMAAGAVVVSLCSTSDETIEEAEKDLPRNLCPLIKSSYGFGKTDKCPYFYFSDLVVGETTCDGKKKMYEYMAEFKPVHVMQLPNSVKDDASRALWKAEMLRLQKTVEERFGHEISEDALRDAIALKNRERRALANFYHLGQLNPPALSGSDILKVVYGATFRFDKEALINELDAMTARVRQQWEEGQRLDPRPRILITGCPIGGAAEKVVRAIEENGGWVVGYENCTGAKATEQCVAETGDVYDALADKYLAIGCSCVSPNDQRLQMLSQMVEEYQVDGVVDVILQACHTYAVESLAIKRHVRQQHNIPYIAIETDYSTSDVGQLSTRVAAFIEML

SEQ ID NO: 9953 - DNA, 1317 bp, Escherichia coli
ttgcgttttcttaccgtcaggctctattcttacgatatgaataaactcattgaactcagacgcgccaaaatgttggcgctctctttactgcttatcgccgctgctacctttgtcgttacgctgtttttgccgcccaatttttgggtgagcggtgtgaaggcgattgctgaagcggcgatggtcggcgcgctggcggactggtttgcggtggtggcgctgtttcgccgcgtgccgattccgatcatttctcgtcatacggcgattatcccgcgtaataaagaccggattggcgaaaatctcggccagttcgtgcaggaaaaatttctcgatacccaatcgctggtggcattgattcgacgtcacgaaccggcgttgttgattggcaactggtttagtcagccggagaacgcccgccgcgttggtcagcatctgttacagatcatgagcggttttctcgaactgaccgatgatgcgcgtattcagcgcctgcttaagcgcgcggtccaccgggcgattgataaagtcgatctttctggcaccagtgcgttgatgctggagagtatgaccaaaaacgatcgtcatcaggtgctgctggatacgctgatcgcacagttgatcgcccttctccagcgcgataaatcacgcaagtttattgcccagcaaattgttcgctggctggagagcgagcatccactgaaagccaaaattttgcccactgaatggctgggcgaacatagcgcggagttggtttctgacgcggtgaattctttgcttgatgatatcagccgcgatcgtgcgcatcagatccgccatgcgtttgatcacgccacctttgccctgatcgacaagctgaaaaacgatccggaaatggcagcgcgagccgatgccgtaaaaagctatctgaaagaagatgaggcctttaaccgctatctcagtgaattgtggggggatttacgggaatggctgaaagcggatatcaacagtgaagattctcgtgtgaaagaacgtatcgcgcgggcggggcaatggtttggcgaaacgttaattgccgatgatgccttgcgggcgtcgttaaatggtcatctcgaacaagccgcacaccgcgttgcgcctgagttttccgcattcctgactcgccatatcagcgacacggtaaaaagctgggacgcacgggatatgtcgcggcaaatcgagttaaatatcggcaaagatctccagtttatccgtgtcaacggtacgctggttggcggttgtattggacttattttgtatttgctgtcgcagctcccggccttgttccccctcggcaatttatag

SEQ ID NO: 9954 - protein, 438 aa, Escherichia coli
MRFLTVRLYSYDMNKLIELRRAKMLALSLLLIAAATFVVTLFLPPNFWVSGVKAIAEAAMVGALADWFAVVALFRRVPIPIISRHTAIIPRNKDRIGENLGQFVQEKFLDTQSLVALIRRHEPALLIGNWFSQPENARRVGQHLLQIMSGFLELTDDARIQRLLKRAVHRAIDKVDLSGTSALMLESMTKNDRHQVLLDTLIAQLIALLQRDKSRKFIAQQIVRWLESEHPLKAKILPTEWLGEHSAELVSDAVNSLLDDISRDRAHQIRHAFDHATFALIDKLKNDPEMAARADAVKSYLKEDEAFNRYLSELWGDLREWLKADINSEDSRVKERIARAGQWFGETLIADDALRASLNGHLEQAAHRVAPEFSAFLTRHISDTVKSWDARDMSRQIELNIGKDLQFIRVNGTLVGGCIGLILYLLSQLPALFPLGNL

SEQ ID NO: 9955 - DNA, 921 bp, Escherichia coli
atgacaaactttacgaccagcacgccgcatgacgcattatttaaatcctttctcacacactctgacaccgcgcgggattttatggagatccacttacccaaagatttacgtgaactgtgcgatctcgatagcttaaaactggaatccgccagctttgtcgatgaaaaattgcgggcgctacattccgatattctgtggtcggtaaagacccgtgaaggcgatggctatatttatgtagtgattgaacatcagagccgtgaggatattcatatggcctttcgtctgatgcgatattccatggcggtgatgcagcgccatatcgaacatgataaacgccggcagctaccactggtcatcccgatgctgttttatcacggtagccgtagcccttatccctggtctttgtgctggctggacgaatttgccgacccaactaccgcacggaagctttataccgccgcgttcccgctggtggatatcactgtcgtgccagacgacgagattgtgcagcatcgcagagtcgccctgttggagttgatccaaaagcatattcgccagcgcgatctgatggggcttattgaccaactggtagtattactggttacagagtgtgctaatgacagccagataactgcgctgttaaattacattttactgactggtgatgaagcgcgttttaatgagtttatcagtgaaattacccgtcgactgccacaacaaagggagcgaataatgacgattgcagagcgaattcataatgatggatatataaaaggggaacagcgcattcttcgattgtttttgcagaatggggtagatcctgaatggatacaaaagattaccggactttcggcagagcaaatacaggcattagagcagcccttgcctgagcgtgagccttattcatggctcaagagctaa

SEQ ID NO: 9956 - protein, 306 aa, Escherichia coli
MTNFTTSTPHDALFKSFLTHSDTARDFMEIHLPKDLRELCDLDSLKLESASFVDEKLRALHSDILWSVKTREGDGYIYVVIEHQSREDIHMAFRLMRYSMAVMQRHIEHDKRRQLPLVIPMLFYHGSRSPYPWSLCWLDEFADPTTARKLYTAAFPLVDITVVPDDEIVQHRRVALLELIQKHIRQRDLMGLIDQLVVLLVTECANDSQITALLNYILLTGDEARFNEFISEITRRLPQQRERIMTIAERIHNDGYIKGEQRILRLFLQNGVDPEWIQKITGLSAEQIQALEQPLPEREPYSWLKS

SEQ ID NO: 9957 - DNA, 2202 bp, Escherichia coli
atgtggtgtaatggagagagtccttcacgaaacgatgggatttatatgtcacctcgtcagataaggggttattattgcgaaatcatcgcttcacggaaagacgtcagaatgaaagctacagaagcccgcctactcgattttttaaaacgttcgcagcagttcgttattaccatttatcaacggacttattcatggacagaacaacaatgtcggcaactttgggacgacatcattcgtgccggaaagcgtgacgatatatcagcgcattttatcggttcggttgtttatattgagcaggggttgtatcaggtttctggtatttctccgttactggtcattgatggtcaacaaaggctgacgaccgcaatgttgctgattgaggctttatcgcgtcatcttggcgaagacgaagtttttgatggcttttcagcaatgaaattgcgtaattattatttactcaatccttatgagtccggcgagaaaggatttaaattactgctgaccgagactgataaagacagtttgctggcgttaataaaacaaagaccaatgccagaaaactattcccatcgaataatggaaaactttactttctttgatgaacaaattaccaaactcggtgatgacttgatccccttatgtcgtgggttagcaaagttattaattgtcgatgtggcgcttaatcgtggtcaggataatccgcaactgatttttgaaagtatgaactccaccggtaaggcattaagtcaggccgatctggtgcgcaattttattctgatgggcctcgaaccagaacatcaaacccggttgtatgaagatcactggcgtccaatggaagtcgcgtttggtcagcaaggttacagcgaatattttgacagttttatgcgtcattatctgacggtaaaaacgggggagatccctcggacagatgaagtctatgaggcatttaaactccatgcccgcagccagagtgttgctgaaaaaggcgtagatcggctggttgaagatattcacatctacgcggagtattactgtgcaatggcattgggaaaagaaagtgacaaatcgcttgctacggcttttcaggatttgcgcgagttaaaggtcgatgtggcgtatcctttcttactggcgctttatcatgactataaaaatggcgttttgtctcacgaagatttcctgagcataattcgtttaattgaatcttatgttttccgccgtgcagtatgtgcgattccgacaaattctcttaacaagacgtttgctactttttataaggtcattaataaagaaaaatatctggaaagtattcaggtacattttctgaatctgccttcatatcgtcgtttccccaacgatgatgaatttaaacgggaattaaaagttcgtgatctctataatttccgtagtcgcagctactggttacgacgactggaaaacgataaacgcagagagcgcgtggaagagtttacgattgagcatattatgccgcagaacgaaaatttgtcggctaaatggcgtgaagagctgggaagtgactggcaacgcattcataaagaactgttgcatacgttggggaatctcacattaacgcgctataactcccgctacagtgacagacctttcgcggaaaaacgcgatattgaagacggctttaaacatagcccgctctatttgaatatcggtcttggacagtgcgaaaaatgggatgaagcagccattcgcgcccgtgcagatcgtctggccgatctcgcggttcaggtctggcaagcgcctgctcttcctgaagaggttttagctgtttatcgggcgcagccggagaacaaaaccagttacagcctgagtgattatccttttcttgctgatggttcgcatagccgggtgttatttgatcatcttcgcgatgaagttatgcgcctggacgcagggatcacgcaggaagttttaaagctctatattgcgtttaaagctgaaacgaattttgttgatgttgtaccgcaaaaaagccgactgcggttgtcgcttaatatgcagtttcatgaactggtcgatccgaaaggtattgccaaagatgtgacaaatgttgggcgatggggcaatggtgatgtggaaattggtttcagtgacctcgcacaacttccttacattatgggattaattcgtcaggcatttgaaaaacagatggagagcgcgttggtataa

SEQ ID NO: 9958 - protein, 733 aa, Escherichia coli
MWCNGESPSRNDGIYMSPRQIRGYYCEIIASRKDVRMKATEARLLDFLKRSQQFVITIYQRTYSWTEQQCRQLWDDIIRAGKRDDISAHFIGSVVYIEQGLYQVSGISPLLVIDGQQRLTTAMLLIEALSRHLGEDEVFDGFSAMKLRNYYLLNPYESGEKGFKLLLTETDKDSLLALIKQRPMPENYSHRIMENFTFFDEQITKLGDDLIPLCRGLAKLLIVDVALNRGQDNPQLIFESMNSTGKALSQADLVRNFILMGLEPEHQTRLYEDHWRPMEVAFGQQGYSEYFDSFMRHYLTVKTGEIPRTDEVYEAFKLHARSQSVAEKGVDRLVEDIHIYAEYYCAMALGKESDKSLATAFQDLRELKVDVAYPFLLALYHDYKNGVLSHEDFLSIIRLIESYVFRRAVCAIPTNSLNKTFATFYKVINKEKYLESIQVHFLNLPSYRRFPNDDEFKRELKVRDLYNFRSRSYWLRRLENDKRRERVEEFTIEHIMPQNENLSAKWREELGSDWQRIHKELLHTLGNLTLTRYNSRYSDRPFAEKRDIEDGFKHSPLYLNIGLGQCEKWDEAAIRARADRLADLAVQVWQAPALPEEVLAVYRAQPENKTSYSLSDYPFLADGSHSRVLFDHLRDEVMRLDAGITQEVLKLYIAFKAETNFVDVVPQKSRLRLSLNMQFHELVDPKGIAKDVTNVGRWGNGDVEIGFSDLAQLPYIMGLIRQAFEKQMESALV

SEQ ID NO: 9959 - DNA, 399 bp, Escherichia coli
gtgcgccaacacacccgcaccgctcatcacaatcactatttatggagaatagtaatcatgactgacacgcattctattgcacaaccgttcgaagcagaagtctccccggcaaataaccgtcaattaaccgtgagttatgcgagtcgctacccggattacagccgtattcccgccatcaccctgaaaggtcagtggctggaagccgccggttttgccactggcacggcgatagatgtcaaagtgatggaaggctgtattgtcctcaccgcccaaccccccgccgccgaagagagcgaactgatgcagtcgcttcgccaggtgtgcaagctgtcggcgcgtaaacaaaggcaggtgcaggagtttattggggtgattgcgggtaaacagaaagtcgcctga

SEQ ID NO: 9960 - protein, 132 aa, Escherichia coli
MRQHTRTAHHNHYLWRIVIMTDTHSIAQPFEAEVSPANNRQLTVSYASRYPDYSRIPAITLKGQWLEAAGFATGTAIDVKVMEGCIVLTAQPPAAEESELMQSLRQVCKLSARKQRQVQEFIGVIAGKQKVA

SEQ ID NO: 9961 - DNA, 1368 bp, Escherichia coli
atgagtgctgggaaattgccggaggggtgggaacagattgaaataggcgacattgctgatgtcatctctggtgggacaccaaaatcgggagtcgctgaaaattttgcaccttcgggtgagggagtcgcctggcttacgcctgccgatttgagcggttataaagagaaatatatctcacatggtgccagagatttaactacactaggctattcctcttgttcagcaaaactaatgcccaaaggcactatactttttagtagccgggcaccgattggatatgttgctattgctgcaaatgagattgcgactaaccagggtttcaaaagttttgcttttccttcagacatttttcctgattatgcatattactttctccgcaacatcagacatattgcagaggaaatgggcacaggaacaacttttaaagaaatttctggtagttctgcgaaaacattaccatttgttcttgtaccgtttgccgaacaaaaaatcatcgctgaaaaactcgatacgctgctggcacaggtagacagcaccaaagcacgtcttgagcaaatcccacaaatcctgaaacgttttcgtcaggcggttctgggtgcagcggtgagaggaaaactaactgaagactggagagataattcaagcctgtctgggtggagagaaggcaaacttggggagtttataaaaaaaccaagttacggaacgtcatctaagtctaataaagaaggactcattcctgtattaagaatgggcaatcttcagggaggaaagttggactggacggatctagtctatacgtcagataccatagaaattgaaaagtataaacttgagtacaatgatgtattattcaatcgtacaaatagtcctgaacttgtcgggaaaacagccatatataaatcagagcaaccagctatttatgcaggttatttgattagggttcaatgtttacctgatttaaaccctgactatcttaactaccatttaaatagcattttggggagacaatattgctattcagttaaatctgatggggtcagtcaatcaaatattaatgcacagaaattaattgcatacccaataactgttcccccccttcccgaacaagctgaaatcgttcgccgcgtcgagcaactcttcgcctacgccgacacaatagaaaaacaggtcaacaacgccttagcccgcgtcaacaatctgacgcaatccatcctggcaaaagcgttccgtggtgaactcaccgcccagtggcgggccgaaaacccggaattaatcagcggtgaaaacagcgccgccgcgttgctggagaaaatcaaagctgaacgcgcagccagcgggggtaaaaaagcctcgcgtaaaaagtcctga

SEQ ID NO: 9962 - protein, 455 aa, Escherichia coli
MSAGKLPEGWEQIEIGDIADVISGGTPKSGVAENFAPSGEGVAWLTPADLSGYKEKYISHGARDLTTLGYSSCSAKLMPKGTILFSSRAPIGYVAIAANEIATNQGFKSFAFPSDIFPDYAYYFLRNIRHIAEEMGTGTTFKEISGSSAKTLPFVLVPFAEQKIIAEKLDTLLAQVDSTKARLEQIPQILKRFRQAVLGAAVRGKLTEDWRDNSSLSGWREGKLGEFIKKPSYGTSSKSNKEGLIPVLRMGNLQGGKLDWTDLVYTSDTIEIEKYKLEYNDVLFNRTNSPELVGKTAIYKSEQPAIYAGYLIRVQCLPDLNPDYLNYHLNSILGRQYCYSVKSDGVSQSNINAQKLIAYPITVPPLPEQAEIVRRVEQLFAYADTIEKQVNNALARVNNLTQSILAKAFRGELTAQWRAENPELISGENSAAALLEKIKAERAASGGKKASRKKS

SEQ ID NO: 9963 - DNA, 1590 bp, Escherichia coli
atgaacaataacgatctggtcgcgaagctgtggaagctgtgcgacaacctgcgcgatggcggcgtttcctatcaaaactacgtcaatgaactcgcctcgctgctgtttttgaaaatgtgtaaagagaccgggcaggaagcggaatacctgccggaaggttaccgctgggatgacctgaaatcccgcatcggccaggagcagttgcagttctaccgaaaaatgctcgtgcatttaggcgaagatgacaaaaagctggtacaggcagtttttcataatgttagtaccaccatcaccgagccgaaacaaataaccgcactggtcagcaatatggattcactggactggtacaacggtgcgcacggtaagtcgcgcgatgacttcggcgatatgtacgaagggctgctgcagaagaacgccaatgaaaccaagtctggcgcgggccagtacttcaccccgcgtccgctgattaaaaccattattcatctgctgaaaccgcagccacgtgaagtggtacaggatccggcagccggtacggcgggctttttgattgaagccgaccgctacgttaagtcgcagactaacgatctggacgaccttgatggcgacacgcaggatttccagatccaccgcgcgtttatcggcctcgaactggtgcccggcacccgtcgtctggcgctgatgaactgcctgctgcacgatattgaaggcaacctcgaccacggcggcgcaatccgtctgggcaacaccctgggcagcgacggcgaaaacctgccgaaggcgcatattgtcgccactaacccgccgtttggcagcgccgcaggcaccaacattacccgcacctttgttcacccgaccagcaacaaacagttgtgctttatgcagcatattatcgaaacgctgcaccccggcggtcgtgcggcggtggtggtgccggataacgtgctgtttgaaggcggcaaaggtacggacatccgtcgtgacctgatggataagtgtcatctgcacactattctgcgtctgccgaccggtattttttacgcgcagggcgtgaagaccaacgtgctgttctttatcaaagggacggtggcgaacccgaatcaggataagaactgcaccgatgacgtgtgggtgtacgacctgcggaccaatatgccgagctttggtaaacgcacgccgtttaccgacgagcatttgcaaccgtttgagcgcgtgtttggcgaagacccgcacggcttaagcccgcgcactgaaggtgaatggagttttaacgccgaagagacggaaattgccgacagcgaagagaacaaaaacaccgaccagcatcttgctaccagccgctggcgcaagttcagccgcgagtggatccgcaccgcgaaatccgattcgctggatatctcctggctgaaagataaagacagtattgatgccgacaacctgccggagccggatgtattagcggcagaagcgatgggtgaactggtacaggcgctgtctgaactggatgcgctgatgcgtgaactgggggcgagcgatgaggcggatgcgcagcgccagttgctggaagaagcatttggtggggtgaaggaatga

SEQ ID NO: 9964 - protein, 529 aa, Escherichia coli
MNNNDLVAKLWKLCDNLRDGGVSYQNYVNELASLLFLKMCKETGQEAEYLPEGYRWDDLKSRIGQEQLQFYRKMLVHLGEDDKKLVQAVFHNVSTTITEPKQITALVSNMDSLDWYNGAHGKSRDDFGDMYEGLLQKNANETKSGAGQYFTPRPLIKTIIHLLKPQPREVVQDPAAGTAGFLIEADRYVKSQTNDLDDLDGDTQDFQIHRAFIGLELVPGTRRLALMNCLLHDIEGNLDHGGAIRLGNTLGSDGENLPKAHIVATNPPFGSAAGTNITRTFVHPTSNKQLCFMQHIIETLHPGGRAAVVVPDNVLFEGGKGTDIRRDLMDKCHLHTILRLPTGIFYAQGVKTNVLFFIKGTVANPNQDKNCTDDVWVYDLRTNMPSFGKRTPFTDEHLQPFERVFGEDPHGLSPRTEGEWSFNAEETEIADSEENKNTDQHLATSRWRKFSREWIRTAKSDSLDISWLKDKDSIDADNLPEPDVLAAEAMGELVQALSELDALMRELGASDEADAQRQLLEEAFGGVKE

SEQ ID NO: 9965 - DNA, 3513 bp, Escherichia coli
atgatgaataaatccaacttcgaattcctgaagggcgtcaacgacttcacttatgccatcgcctgtgcggcggaaaataactacccggatgatcccaacacgacgctgattaaaatgcgtatgtttggcgaagctacagcgaaacatcttggtctgttactcaacatccccccttgtgagaatcaacacgatctcctgcgcgaactcggcaaaatcgccttcgttgatgacaacattctctctgtattccacaaattacgccgcattggtaaccaggcggtgcacgaataccataacgatctcgacgatgcccagatgtgcctgcgactcgggttccgcctggctgtctggtactaccgtctggtcaccaaagattatgacttcccggtgccggtatttgtgttgccggaacgtggcgaaaacctctatcaccaggaagtgctgacgctaaaacaacagcttgaacagcaggcgcgagaaaaagcgcagactcaggcagaagtcgaagcgcaacagcagaagctggttgccctgaacggctatatcgccattctggaaggcaaacagcaggaaacagaagcgcaaacccaggctcgccttgcggcgctggaagcacagctcgccgagaagaacgcggagctggccaaacagaccgaacaggaacgtaaggcttaccacaaagaaattaccgatcaggccatcaagcgcacactcaaccttagcgaagaagagagtcgcttcctgattgacgcgcaactgcgtaaagcaggctggcaggccgatagcaaaaccctgcgcttctccaaaggcgcacgcccggaacccggcgtcaataaagccattgccgaatggccgaccgggaaagatgaaacgggtaatcagggctttgcggattatgtgctgtttgtcggcctcaagcccatcgcggtggtagaggcgaaacgtaaaaatatcgacgttcccggcaagctcaatgagtcgtatcgctacagcaaatgcttcgataatggcttcctgcgggaaaccttgcttgagcattactcaccggatgaagtgcatgaagctgtgccggagtatgaaactagctggcaggacaccagcggccaacaacggtttaaaatccccttctgctactccaccaacgggcgcgaatatcgcgcagcaatgaagactaaaagtggcatctggtatcgcgacgtgcgtgatacccgcaatatgtcgaaagccttacccgagtggcatcgcccggaagagctgctggaaatgctcggcagcgaaccgcaaaaacagaatcagtggtttgccgataacccgggcatgagcgagctgggcctgcgttattaccaggaagatgccgtccgcgcggtggaaaaggcaatcgtcaagggtcaacaagagatcctgctggcgatggcgaccggtaccggtaaaacccgcaccgcaattgccatgatgttccgcctgatccagtcccagcgttttaaacgcattctcttccttgtcgatcgccgttctcttggcgagcaggcactgggggcgtttgaagatacgcgtattaacggcgacaccttcaacagcattttcgacattaaagggctgacggataaattccccgaagacagcaccaaaattcacgttgccaccgtacagtcgctggtgaaacgcaccctacaatcagatgaaccgatgccggtggcccgttacgactgtatcgtcgtcgatgaagcgcatcgcggctatattctcgataaagagcagaccgaaggcgagctgcagttccgcagccagctggattacgtttctgcctaccgtcgcattctcgatcacttcgatgcggtaaaaatcgccctcaccgccaccccggcgctgcatacggtgcagattttcggcgagccggtttaccgttatacctaccgtaccgcggttatcgacggttttctgatcgaccaggatccgccgattcagatcatcacccgcaacgcccaggagggggtttatctctccaagggcgaacaggtagagcgcatcagcccgcagggagaagtgatcaacgataccctggaagacgatcaggattttgaggtcgccgactttaaccgtggcctggtgatcccggcgtttaaccgcgccgtctgtaacgagctcaccaactaccttgacccgaccgggtcgcaaaaaacgctggtcttctgcgttaccaatgcccatgccgatatggtggtggaagagttgcgtaccgcgttcaagaaaaagtatccgcaactggagcacgacgcgatcatcaagatcaccggtgatgccgataaagacgcgcgcaaagtgcagaccatgatcacccgcttcaataaagagcggctgcccaatatcgtggtaaccgtcgacctgctgacaaccggcgtcgatattccgtcgatctgtaatatcgtgttcctgcgtaaagtacgcagccgtattctgtacgagcagatgaaaggccgcgccacgcgcttatgcccggacgtgaataaaaccagctttaagattttcgactgtgtcgatatctacagcacgctggagagcgtcgacaccatgcgtccggtggtggtgcgtccgaaggtggaactgcaaacgctggtcaatgaaattaccgattcagaaacctataaaatcaccgaagcggatggccgtagctttgccgagcacagccatgaacaattggtggcgaagctccagcgcatcatcggcctggccacgtttaaccgtgaccgcagcgaaacgatagataaacaggtgcgtcgtctggatgagctatgccaggacgcggcgggcgtgaactttaacggcttcgcctcgcgcctgcgggaaaaagggccgcactggagcgccgaagtctttaacaaactgcctggctttatcgcccgtctggaaaagctgaaaacggacatcaacaacctgaatgatgcgccgatcttcctcgatatcgacgatgaagtggtgagtgtaaaatcgctgtacggtgattacgacacgccgcaggatttcctcgaagcctttgactcgctggtgcaacgttccccgaacgcgcagccggcattgcaggcggtgatcaatcgcccgcgcgatctcacccgtaaagggctggtcgagctccaggagtggtttgaccgccagcattttgaggaatcttccctgcgcaaagcatggaaagagacgcgcaatgaagatatcgccgcccggctgattggtcatattcgccgcgctgcggtgggcgatgcgctgaaaccgtttgaggaacgtgtcgatcacgcgctgacgcgcattaagggtgaaaacgactggagcagcgagcaattaagctggctcgatcgtttagcgcaggcgctgaaagagaaagtggtgctcgacgacgatgtcttcaaaaccggcaacttccaccgccgcggcggtaaggcgatgctacaaagaacctttgacgataatctcgacaacctgcttgataaattcagcgattatatctgggacgagctggcctga

SEQ ID NO: 9966 - protein, 1170 aa, Escherichia coli
MMNKSNFEFLKGVNDFTYAIACAAENNYPDDPNTTLIKMRMFGEATAKHLGLLLNIPPCENQHDLLRELGKIAFVDDNILSVFHKLRRIGNQAVHEYHNDLDDAQMCLRLGFRLAVWYYRLVTKDYDFPVPVFVLPERGENLYHQEVLTLKQQLEQQAREKAQTQAEVEAQQQKLVALNGYIAILEGKQQETEAQTQARLAALEAQLAEKNAELAKQTEQERKAYHKEITDQAIKRTLNLSEEESRFLIDAQLRKAGWQADSKTLRFSKGARPEPGVNKAIAEWPTGKDETGNQGFADYVLFVGLKPIAVVEAKRKNIDVPGKLNESYRYSKCFDNGFLRETLLEHYSPDEVHEAVPEYETSWQDTSGQQRFKIPFCYSTNGREYRAAMKTKSGIWYRDVRDTRNMSKALPEWHRPEELLEMLGSEPQKQNQWFADNPGMSELGLRYYQEDAVRAVEKAIVKGQQEILLAMATGTGKTRTAIAMMFRLIQSQRFKRILFLVDRRSLGEQALGAFEDTRINGDTFNSIFDIKGLTDKFPEDSTKIHVATVQSLVKRTLQSDEPMPVARYDCIVVDEAHRGYILDKEQTEGELQFRSQLDYVSAYRRILDHFDAVKIALTATPALHTVQIFGEPVYRYTYRTAVIDGFLIDQDPPIQIITRNAQEGVYLSKGEQVERISPQGEVINDTLEDDQDFEVADFNRGLVIPAFNRAVCNELTNYLDPTGSQKTLVFCVTNAHADMVVEELRTAFKKKYPQLEHDAIIKITGDADKDARKVQTMITRFNKERLPNIVVTVDLLTTGVDIPSICNIVFLRKVRSRILYEQMKGRATRLCPDVNKTSFKIFDCVDIYSTLESVDTMRPVVVRPKVELQTLVNEITDSETYKITEADGRSFAEHSHEQLVAKLQRIIGLATFNRDRSETIDKQVRRLDELCQDAAGVNFNGFASRLREKGPHWSAEVFNKLPGFIARLEKLKTDINNLNDAPIFLDIDDEVVSVKSLYGDYDTPQDFLEAFDSLVQRSPNAQPALQAVINRPRDLTRKGLVELQEWFDRQHFEESSLRKAWKETRNEDIAARLIGHIRRAAVGDALKPFEERVDHALTRIKGENDWSSEQLSWLDRLAQALKEKVVLDDDVFKTGNFHRRGGKAMLQRTFDDNLDNLLDKFSDYIWDELA

SEQ ID NO: 9967 - DNA, 915 bp, Escherichia coli
atgacggttcctacctatgacaaatttattgaacctgttctgcgttatctggcaacaaaaccggaaggtgcagccgcgcgtgatgttcatgaggctgccgcggatgcattaggactggatgacagccagcgatcgaaagtcattaccagcggacaacttgtttataaaaatcgtgcaggctgggcacatgaccgtttaaaacgtgccgggttgtcgcaaagtttgtcgcgtggcaaatggtgcctgactcctgcgggttttgactgggttgcgtctcatccccagccaatgacggagcaggagatgaaccatctggccttcaattttgtgaatgtcaaacttaagtcacggccggatgccgtcgatttagatccgaaagccgactctcccgatcatgaagaacttgcaaagagcagcccggacgatcggttagatcaggcgctaaaagagcttcgtgatgcggtggctgatgaggttctggaaaacttattgcaggtttctccttcgcgctttgaagtcattgttctggatgttttgcatcgcctggggtatggcggccaccgtgatgatttgcagcgtgttggcggtactggagatggtggcatcgatggtgtgatatcgcttgataaacttggcctggagaaagtttatgttcaggcaaaacgttggcagaatactgtaggcaggccagaattacaggcattttacggcgcactggctgggcaaaaagcgaaacgtggggtgtttattaccacttctggatttacttctcaggcgcgtgactttgcccaatccgtcgagggtatggtgttggttgatggggaacgcctggtgcacttaatgatcgaaaacgaagtaggggtttcttcacgtttgttgaaggtgccgaaactggatatggattattttgagtga

SEQ ID NO: 9968 - protein, 304 aa, Escherichia coli
MTVPTYDKFIEPVLRYLATKPEGAAARDVHEAAADALGLDDSQRSKVITSGQLVYKNRAGWAHDRLKRAGLSQSLSRGKWCLTPAGFDWVASHPQPMTEQEMNHLAFNFVNVKLKSRPDAVDLDPKADSPDHEELAKSSPDDRLDQALKELRDAVADEVLENLLQVSPSRFEVIVLDVLHRLGYGGHRDDLQRVGGTGDGGIDGVISLDKLGLEKVYVQAKRWQNTVGRPELQAFYGALAGQKAKRGVFITTSGFTSQARDFAQSVEGMVLVDGERLVHLMIENEVGVSSRLLKVPKLDMDYFE

SEQ ID NO: 9969 - DNA, 957 bp, Escherichia coli
atgaacccgattgcagttaccctactcaccggttttttaggcgcaggaaaaaccaccctgctgcgccatattcttaacgaacaacacggctacaagattgccgtgattgaaaacgaattcggcgaagtctccgttgatgatcaactgattggcgaccgcgccacgcagatcaaaacgctgaccaacggctgcatctgctgttcgcgctccaacgagctggaagacgccctactcgacctgctggataatctcgacaagggcaatattcagttcgaccgtctggtcattgaatgcaccggcatggccgatcccggcccgattattcagacctttttctcccatgagattttatgccagcgttacctgctggatggcgtgattgcgctggtggatgcggtacatgccgatgagcagatgaaccagttcaccatcgcccagtcccaggttggctacgccgaccgtattctgctgactaaaaccgacgtcgcaggcgaagcagaaaaactgcgtgaacgcctggcgcgcatcaacgcccgtgcaccggtctacaccgtcacccacggcgacatcgacctgggcctgttgttcaacaccaacggttttatgctggaagaaaacgtcgtcagcaccaagccacgttttcactttatcgcggacaaacaaaacgatatttcgtcgattgtggtggaactggattacccggtagatatcagcgaagtttcccgcgtgatggaaaacctgctgctggaatcggcagataaactgctgcgttacaaagggatgctgtggattgacggcgaacctaaccgcctgctgttccagggcgtccagcgcctctacagcgccgactgggacaggccgtggggcgatgaaaaaccgcatagcacgatggtgtttatcgggattcagctgccggaggatgagattcgggcggcgtttgcggggttgaggaagtaa

SEQ ID NO: 9970 - protein, 318 aa, Escherichia coli
MNPIAVTLLTGFLGAGKTTLLRHILNEQHGYKIAVIENEFGEVSVDDQLIGDRATQIKTLTNGCICCSRSNELEDALLDLLDNLDKGNIQFDRLVIECTGMADPGPIIQTFFSHEILCQRYLLDGVIALVDAVHADEQMNQFTIAQSQVGYADRILLTKTDVAGEAEKLRERLARINARAPVYTVTHGDIDLGLLFNTNGFMLEENVVSTKPRFHFIADKQNDISSIVVELDYPVDISEVSRVMENLLLESADKLLRYKGMLWIDGEPNRLLFQGVQRLYSADWDRPWGDEKPHSTMVFIGIQLPEDEIRAAFAGLRK

SEQ ID NO: 9971 - DNA, 204 bp, Escherichia coli
atgtttggtaacttaggacaggcaaaaaaatatctcggccaggcggcgaagatgttgattggcattccagactacgacaactacgtcgagcatatgaagaccaaccatcccgacaagccgtacatgagctatgaagaattcttccgcgaacgccagaacgcgcgctacggcggcgatggtaaaggcggtatgcgctgttgttaa

SEQ ID NO: 9972 - protein, 67 aa, Escherichia coli
MFGNLGQAKKYLGQAAKMLIGIPDYDNYVEHMKTNHPDKPYMSYEEFFRERQNARYGGDGKGGMRCC

SEQ ID NO: 9973 - DNA, 2166 bp, Escherichia coli
atgccaggttttactatggatactaaaaagatattcaagcacataccttgggtgattctcggaatcatcggtgcattctgcctcgcggtagttgcattacgtcggggggagcacgtcagcgccctgtggatcgtggtcgcctctgtgtcggtgtatctggtggcgtatcgctactacagtctgtacatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggtgggtccggttctcgccgcgcagatgggctacctgcctggcacgctgtggctgctggcgggggtcgtgctggccggtgcggttcaggactttatggtgctgtttatctcctctcgccgtaacggcgcatctcttggtgagatgatcaaagaagagatgggaccagtaccggggactatcgcgctgtttggctgtttcttaatcatgatcatcatcctcgccgttctggcactgattgtggttaaagccctggccgaaagtccgtggggggtcttcaccgtttgctcaaccgtaccgattgcgctgtttatgggtatctacatgcgctttattcgtccggggcgtgtgggtgaagtctctgtcattggtatcgtgctgctggttgcctctatctacttcggtggcgtgattgctcacgatccgtactggggtccggcactgacctttaaagataccaccattactttcgcgctgattggctatgcgtttgtttccgcactgctgccagtgtggctgatcctcgcaccgcgcgactatctggcaaccttcctgaaaatcggcgttatcgtcggcctggcgctgggtatcgtggtgctgaacccggaactgaaaatgcctgccatgacccagtacattgacggtactggcccgctgtggaaaggcgctctgttcccgttcctgttcatcaccatcgcctgtggtgcggtatctggcttccacgcgctgatctcttccggcacgacgccgaaactgctggctaatgaaaccgacgcgcgtttcatcggctacggcgcaatgctgatggagtccttcgtggcgattatggcgctggttgctgcgtccatcatcgaaccgggtctttacttcgcgatgaacaccccgcctgctggcctcggcatcaccatgcctaacctgcatgaaatgggtggcgagaacgcgccgatcatcatggcacagctgaaagacgttaccgcacacgcggcagcgaccgtcagctcctggggcttcgtgatttcgccagagcagatcctgcaaaccgcgaaagacattggtgagccttctgtcctgaaccgtgcaggtggtgcgccaacgctggcggtaggtatcgctcacgtgttccacaaagtgctgccgatggctgacatgggcttctggtatcacttcggtattctgttcgaagccctgttcatcctgaccgcgctggatgcgggtacccgttctggccgctttatgctgcaagacctgctgggtaacttcatcccgttcctgaaaaaaaccgactctctggttgccggtatcatcggtactgcgggctgtgtgggtctgtggggctacctgctgtatcagggcgtggtcgatccgctgggcggcgttaagagcctgtggccgctgttcggtatctccaaccagatgctggcagccgtggcgctggtactgggcaccgttgtactgattaagatgaagcgcacccaatacatctgggttaccgttatcccggcagtatggctgcttatctgcaccacctgggcgctgggcctgaaactgttcagcaccaacccgcagatggaaggcttcttctacatggcgagccagtacaaagagaagattgctaacggtactgacctgacggcgcagcagattgccaacatgaaccacatcgttgtgaacaactacaccaacgcaggcctgagtattctgttcctgattgtggtgtacagcatcatcttctacggtttcaaaacctggctgaaggtgcgtaacagcgacaaacgtactgacaaagaaacaccgtacgttccaatcccggaaggcggcgtgaagatctcttcgcaccactaa

SEQ ID NO: 9974 - protein, 721 aa, Escherichia coli
MPGFTMDTKKIFKHIPWVILGIIGAFCLAVVALRRGEHVSALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGPVPGTIALFGCFLIMIIILAVLALIVVKALAESPWGVFTVCSTVPIALFMGIYMRFIRPGRVGEVSVIGIVLLVASIYFGGVIAHDPYWGPALTFKDTTITFALIGYAFVSALLPVWLILAPRDYLATFLKIGVIVGLALGIVVLNPELKMPAMTQYIDGTGPLWKGALFPFLFITIACGAVSGFHALISSGTTPKLLANETDARFIGYGAMLMESFVAIMALVAASIIEPGLYFAMNTPPAGLGITMPNLHEMGGENAPIIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFIPFLKKTDSLVAGIIGTAGCVGLWGYLLYQGVVDPLGGVKSLWPLFGISNQMLAAVALVLGTVVLIKMKRTQYIWVTVIPAVWLLICTTWALGLKLFSTNPQMEGFFYMASQYKEKIANGTDLTAQQIANMNHIVVNNYTNAGLSILFLIVVYSIIFYGFKTWLKVRNSDKRTDKETPYVPIPEGGVKISSHH

SEQ ID NO: 9975 - DNA, 1656 bp, Escherichia coli
atgttaaaacgtatcaaaattgtgaccagcctactgctggttttggccgtttttggccttttacaactgacttcaggcggtctgttctttaatgccttaaagaacgacaaagaaaatttcactgttttacaaaccattcgccagcagcaatccacgctgaatggcagctgggtcgctttgttgcagacgcgtaacaccctcaaccgcgcgggtatccgctacatgatggatcagaacaatattggtagcggttcaaccgttgctgagctgatgcagagtgccagtatttcgctgaaacaggcggaaaaaaactgggcggattacgaagcgttgccgcgtgacccgcgtcagagcaccgccgcagcggcagagatcaaacgtaattacgatatttatcacaatgcgctggcggagctgatacaactgttaggtgcaggcaaaatcaacgagttctttgatcagccgacccagggatatcaggacggtttcgagaagcagtatgtggcttacatggagcaaaacgatcggctctatgatatcgccgtcagcgataacaatgcctcctacagccaggcgatgtggattctggtaggcgtgatgatcgtcgtactggcggtcatcctcgccgtctggttcggtattaaagcctcgctggtagcgccaatgaatcgcctgattgacagcattcgtcatattgcaggcggcgatctggtgaaaccgattgaggtggatggctctaatgagatggggcaactggcagagagtttgcgccatatgcagggagagctgatgcgtaccgtcggtgatgtgcgcaacggggccaatgccatctatagcggtgccagcgaaatcgccaccggcaataacgatctctcttcgcgcaccgagcaacaggccgcttcgctggaagagacggcagccagcatggagcaactgaccgcaacggtgaaacagaatgccgaaaatgcgcgccaggccagccatctggcgttaagtgcttccgaaacggcgcaacgcggcggcaaagtggtggataacgtggtgcagaccatgcgcgatatctccaccagttcgcagaaaatcgccgatattatcagcgtaattgacggcattgccttccagaccaatattctggctttgaacgcggcggttgaggctgcgcgtgcgggtgagcaaggacgcggttttgcggtggtcgcgggagaagtgcgtaatctggcccagcgtagcgctcaggctgctcgtgaaattaaaagcctgattgaagactcggtggggaaagtggatgttggctctacgctggtcgaaagcgccggggaaacaatggcggagattgtcagtgccgtgacccgcgtgacggacattatgggcgaaattgcttctgcttctgatgagcagagccgtggtatcgatcaggttggcttagcggttgctgagatggaccgggtaactcaacagaacgccgcgctggtggaagaatctgccgccgccgccgccgcgctggaagaacaggccagtcgcctgaccgaagcagtggcagtgttccggattcagcaacagcagcgtgaagcatcggctgtggtaaaaaccgtgacgccagctacgccgcgcaaaatggccgtggcagatagcgaggagaactgggaaacgttttaa

SEQ ID NO: 9976 - protein, 551 aa, Escherichia coli
MLKRIKIVTSLLLVLAVFGLLQLTSGGLFFNALKNDKENFTVLQTIRQQQSTLNGSWVALLQTRNTLNRAGIRYMMDQNNIGSGSTVAELMQSASISLKQAEKNWADYEALPRDPRQSTAAAAEIKRNYDIYHNALAELIQLLGAGKINEFFDQPTQGYQDGFEKQYVAYMEQNDRLYDIAVSDNNASYSQAMWILVGVMIVVLAVILAVWFGIKASLVAPMNRLIDSIRHIAGGDLVKPIEVDGSNEMGQLAESLRHMQGELMRTVGDVRNGANAIYSGASEIATGNNDLSSRTEQQAASLEETAASMEQLTATVKQNAENARQASHLALSASETAQRGGKVVDNVVQTMRDISTSSQKIADIISVIDGIAFQTNILALNAAVEAARAGEQGRGFAVVAGEVRNLAQRSAQAAREIKSLIEDSVGKVDVGSTLVESAGETMAEIVSAVTRVTDIMGEIASASDEQSRGIDQVGLAVAEMDRVTQQNAALVEESAAAAAALEEQASRLTEAVAVFRIQQQQREASAVVKTVTPATPRKMAVADSEENWETF

SEQ ID NO: 9977 - DNA, 1272 bp, Escherichia coli
atgagttggttattgattattccgctaatgatcgtctgtttgtttctcaacattcgggtctatctggcgatgtttattggcatcatcgcttactttttattcttctccagcgtaccgattgaaattgccgtgcaaagactaatcgcgccaacgcaaagcccatcattgctggcaattccgttttttatcttgctcggcacactaatgagctacaccggcattgccgaacgcatcctgcacattgccaacgttctggtggggaaaatgcgcggcggactgggcgtggcaaacattctcgtcagcaccatgatgggcggcgtcagcgcctctaaccttgctgacgcggcgatgctgtcgcgcatgatggtgccggagatggaacgtaaaggctacaatcgcgcgtttgccgccgccattaccgctggtggctcgttagtcaccccgatcataccgcctggaatagccctgattatttacggtctggttgccgatgtctctatcggaaaaatgtttatcgccggactggtacctggtttgctatgcgcagtcgtactgatgtttaccgtctaccttgtcgcccgcaaaactaacgctaaaccctcgcgtgaaagctggcctacgggcaaagaggtggtgttctcgctgggacaggcctggcctgcgctgttcctcatttttgctgtggtgggtggtattcgcgctaacattttcaccccaacagaagcaggtgcagtagcggtgctaatcgtgctggcgattggcttttttatctatcgtgaaatgcggatttctcatgtcgtcaaagcattgggcgaaacggcacgcgcaaccgcatcggtgatgctggtaatcatggccagcgccgcattgggatggattttctcaatggaacatgctggtgtcgcagtggcgaattttgtgacttcgctgaccgaaaacaaatacatgttcctgttgattatcaacatattgctgctgacgctggggatgtttctggaaggaaacgccattttgctgatcctggtaccactattaaaaccggtggtcgaacactttggcatcgatccggtgcattttggcatcatcatgatcttcaacctgtcgattggcgcattcacgccaccggtaggtaccgtgatgctgctggtatgtaatatcacgcaagtttcggtgggaaatttctttaaacaatccctgcccctactggcggctctactgttaatgctaatgctggtgacatatatcccggcgatttcactgttcctggtttaa

SEQ ID NO: 9978 - protein, 423 aa, Escherichia coli
MSWLLIIPLMIVCLFLNIRVYLAMFIGIIAYFLFFSSVPIEIAVQRLIAPTQSPSLLAIPFFILLGTLMSYTGIAERILHIANVLVGKMRGGLGVANILVSTMMGGVSASNLADAAMLSRMMVPEMERKGYNRAFAAAITAGGSLVTPIIPPGIALIIYGLVADVSIGKMFIAGLVPGLLCAVVLMFTVYLVARKTNAKPSRESWPTGKEVVFSLGQAWPALFLIFAVVGGIRANIFTPTEAGAVAVLIVLAIGFFIYREMRISHVVKALGETARATASVMLVIMASAALGWIFSMEHAGVAVANFVTSLTENKYMFLLIINILLLTLGMFLEGNAILLILVPLLKPVVEHFGIDPVHFGIIMIFNLSIGAFTPPVGTVMLLVCNITQVSVGNFFKQSLPLLAALLLMLMLVTYIPAISLFLV

SEQ ID NO: 9979 - DNA, 474 bp, Escherichia coli
atgcgtctttttggcaaagtggcagaatttagtgctgcctttgcgctattcgttctggttgtggtgacaattggagcggtatttatgcgttatttcatcggccaaccgcttcaatggacagaagaaatgtcgggaatgctgatgatttgggtggtgatgttaggtggagtggtggcggaacgtgacagggcgcacctgaccattcccttcctgatggagatgcttccaggcaaactcaggcgtgttattgcagtactggtcgcccttctctccatcgcactgctgctttatatggcctggctgggctaccgactagccgaaatggcgcagtttaaagtgacacaaattctgaaagtttcctggttctggatcgatctggcggtccctgtcggcgcactggcaacggctatttataccctctactggttaataaacgatacaaaacaatccgatagcggagacaaaatgcaatga

SEQ ID NO: 9980 - protein, 157 aa, Escherichia coli
MRLFGKVAEFSAAFALFVLVVVTIGAVFMRYFIGQPLQWTEEMSGMLMIWVVMLGGVVAERDRAHLTIPFLMEMLPGKLRRVIAVLVALLSIALLLYMAWLGYRLAEMAQFKVTQILKVSWFWIDLAVPVGALATAIYTLYWLINDTKQSDSGDKMQ

SEQ ID NO: 9981 - DNA, 972 bp, Escherichia coli
atgagcaaaataatagcgatgctaattactgtcagtaccctttttttaccgtcaataatccaggcaaaacctatttcaataaaagttgcctatgaaaataaccctggagaacccctggatgtggtcatgcgttactgggcagacctattaaataaaaaaagtaatggcgaaataacacttgcgctctatcccagctcccaattgggatcaaaacaggatgtcaccgagcaagccatgatgggcatgaatgtcataaccttgagtgatgtggcttttcttgccgattatgaacccgatttggggattttgtttggaccgtatctgactgacgatccgcaaaaactgttcaaaatatatgaaagcgactggtttaaacaaaaaaatgaaagtctgaagaaaaagggaattcatgtggtaatgaataattatctctatggcactcgacagattatttcgaaaaaacccattcgcaccgttgacgatctcgcaggtttaaaaattcgcgttcctaataacgtcatgcaaataaaagccattcaggcgatgggggcaacaccaactcccatgccattaggcgaagtttatcccgcattaacccagggcgttattgacggcgtagaaaacccaatttcagtgctgcaagggcaaaaactgtatgagcaggcaagatatctgacaatggttaactacctgacaaatacctcagtgtggataggtggtgaagccttctttagcaccctttcaccagaacaactggagatgatccaccagaccggctatgaagcgggtgtctatagccagaaactcactcttgagcgtgatgccgaaatgttgaaaaccatgcaggcagccggcgtcgaagtgatctatcccgatactggaccattccagaagaaagcacgcgaagtttactctcaattcccggaatggacaccaggtctgtacgaaaccattcaacagcaactgcaataa

SEQ ID NO: 9982 - protein, 323 aa, Escherichia coli
MSKIIAMLITVSTLFLPSIIQAKPISIKVAYENNPGEPLDVVMRYWADLLNKKSNGEITLALYPSSQLGSKQDVTEQAMMGMNVITLSDVAFLADYEPDLGILFGPYLTDDPQKLFKIYESDWFKQKNESLKKKGIHVVMNNYLYGTRQIISKKPIRTVDDLAGLKIRVPNNVMQIKAIQAMGATPTPMPLGEVYPALTQGVIDGVENPISVLQGQKLYEQARYLTMVNYLTNTSVWIGGEAFFSTLSPEQLEMIHQTGYEAGVYSQKLTLERDAEMLKTMQAAGVEVIYPDTGPFQKKAREVYSQFPEWTPGLYETIQQQLQ

SEQ ID NO: 9983 - DNA, 1674 bp, Escherichia coli
atgaggaagcctgtttattatatggaaatacttttaacaattttaattcttacgttggtagtatcattaaccagcgtgcttacacgtctgtctcctgtccagataccatttcctttaatccagattgccgctggcgcagtactggcccagcctatatttggtctgcatgtggaattcaatcctgaactttttctcttattgtttataccacccctgttgtttgctgaaagttcaaaaatacaacctaaagaattgatcaagcacagccgggaaattatcagcctggcacttgtgttggtactaatcactatttttggtgtcggctatgtgattcatttactcttaccgaatgtgccgctcatcgctgctttcgcattagccgccgtgttgtcgcctaccgatgccgtggcgttgctggggattgtcgggaaagggcgtatcagcaaaaacatccaggaagtgctcgaaggcgaagcgttgatgaatgatgcttccggcctggtggcgttgaaatttgctgttgcagtgacgatgggaacgatggaattcagcgttcatggcgcaaccattgcgttttttgtcgttgcgttgggcggtattgccgtggggatcgctgttacctggttatatggtaaagggctgctgttgatcagccgatatgctcacgatgaaccttccattcagattgtattgatgcttctgttgccgtttattgtttatctggttgcggaacattttggcttatctggcattcttgccgctgtcgccgcggggttaacaaccagtcgcattggtgtagtccaccacgcgcctattcgcctgagaattaaagctaaaagtagctggtcgatgcttgaatatgtctttaacggcatggtgtttctgattttaggcttacaactgccgggcattatttcggaatcactgatccgtgcagaaaacgatccactggtggacaccggatcgctgctccttgatgtcatttggatctacctggcgttaatggttgtgcgcctgggctggctttggctgatgcgtctgtatagccgtaaacgacccggcaaacatccgatgctgtttgctggatataaaacgcgtcatatgctgctggcgacctttgcgggggtgcgcggagctatcacgcttgcgggggtgctttctatcccgttattgctgccggatggcacaccttttcccgggcgttacttgctggtatttctcgccacaggtgtgatcctcttttcgctggtttgcggcattattattctgccgttattactggggaaaaatgtggggattttcagcgataaccgacaaaaagaagaggaagctgccgatctgtttatggctaaaatggccatactgagtgtgcaaaagaccgagcaacgtttgctgcgcgccagaacagaaaacctcgataacgagttgattatggaaacgggggccagagttatcggttatatgcgacatagtgaagaggatatgtcgcctaatgataattccctgcatatgcagcgtgcgaagctggaaagaacatttaatctggcggcgttaaatgccaaacgcgcggctatttaccagatgcgcgcaaggcaagaagtcagtgatgaaacactggcaaaaatagtcagtgaattagatgtgctggaaacgttaatcatggatagccgataa

SEQ ID NO: 9984 - protein, 557 aa, Escherichia coli
MRKPVYYMEILLTILILTLVVSLTSVLTRLSPVQIPFPLIQIAAGAVLAQPIFGLHVEFNPELFLLLFIPPLLFAESSKIQPKELIKHSREIISLALVLVLITIFGVGYVIHLLLPNVPLIAAFALAAVLSPTDAVALLGIVGKGRISKNIQEVLEGEALMNDASGLVALKFAVAVTMGTMEFSVHGATIAFFVVALGGIAVGIAVTWLYGKGLLLISRYAHDEPSIQIVLMLLLPFIVYLVAEHFGLSGILAAVAAGLTTSRIGVVHHAPIRLRIKAKSSWSMLEYVFNGMVFLILGLQLPGIISESLIRAENDPLVDTGSLLLDVIWIYLALMVVRLGWLWLMRLYSRKRPGKHPMLFAGYKTRHMLLATFAGVRGAITLAGVLSIPLLLPDGTPFPGRYLLVFLATGVILFSLVCGIIILPLLLGKNVGIFSDNRQKEEEAADLFMAKMAILSVQKTEQRLLRARTENLDNELIMETGARVIGYMRHSEEDMSPNDNSLHMQRAKLERTFNLAALNAKRAAIYQMRARQEVSDETLAKIVSELDVLETLIMDSR

SEQ ID NO: 9985 - DNA, 906 bp, Escherichia coli
atgagtcgttcgcagaatttacgtcatagcgtcataaatcaggtgattgaagatatggcgaggggcaatattccttctccgctgccttcacaaagcggactggcagaaatgtataacatcagtcgcactacggtacgccacatactccagcatttaagcgcatgtggcgtgctcaccctggtggggaaaaattatgttatcgcccgcaaacccgaacagaacgatggatttgattgcatcacggcctcgctgaaagagcaaaaccgtcttttcgagcaggcatttttcaccatgattaacctgcgccagttacgcgccggagaaagcttttccgaacttcagctggcgcgagcggcaagcgtcagtccggtagtggtacgagaatatcttttgaaattcggtcgttataatcttattcaaagcgaaaagcgcggccaatggagcatgaagcagttcgatcaatcctacgccgagcagctgtttgagctacgcgaaatgctcgaaacacattccctgcaacactttctcaaccttcccgatgatgaccctcgctggttgcaggcgaaaaccatgctcgaacgtcacaggacattgcgcgacagcattggcagcaactttcgaatgttttctcaattagaccgtgattttcatgccatgctgttatccgctgctgacaacatcttttttaatcaatcacttgaaattatatcggtgatctttcattttcactatcaatgggatgaaagcgatctcaaacagcgcaatatcattgctgttgatgaacatatgaccattctcagcgccctgatttgccgtagcgatttagatgcaataacggcgttgcgaaaccatctggataccgccaaacaatcaatgattcgttccatcaggcaacatcaccgataa

SEQ ID NO: 9986 - protein, 301 aa, Escherichia coli
MSRSQNLRHSVINQVIEDMARGNIPSPLPSQSGLAEMYNISRTTVRHILQHLSACGVLTLVGKNYVIARKPEQNDGFDCITASLKEQNRLFEQAFFTMINLRQLRAGESFSELQLARAASVSPVVVREYLLKFGRYNLIQSEKRGQWSMKQFDQSYAEQLFELREMLETHSLQHFLNLPDDDPRWLQAKTMLERHRTLRDSIGSNFRMFSQLDRDFHAMLLSAADNIFFNQSLEIISVIFHFHYQWDESDLKQRNIIAVDEHMTILSALICRSDLDAITALRNHLDTAKQSMIRSIRQHHR

SEQ ID NO: 9987 - DNA, 1023 bp, Escherichia coli
atgtccacaatgaaagtattaatttgtcaggaaataaagaatttagtatgggaagtccgggaaagaccggtgccaggcgataatgaagcattaattaaaattaaaactgtcgggatttgcggtacagatattcatgcctgggcgggcaatcagccattttttagttatccacgcgttttaggccatgaaatatgtggggagattattgaatcaggaaaaaacattcacaattttaatatcggacagcaagttgcggtaattccgtatatttcttgtcagcaatgcccggcgtgtaaaagcggtcgtaccaattgctgtgaaaaaatttcagtcattggcgtgcatcaggatggcggttttagtgagtatttgagcgtgccggtggcgaacattttgcccgcagacggtattgacccgcaggcggcagcattgattgaacctttcgctattagcgctcatgcggtgcgtcgtgcagccattgcacccagcgagcaggtgctggtggtcggggcggggccaatcggtctgggcgcggcggcaatcgctaaagccgatggcgcgcaggtggtggtggcggataccagtccggcgcgtcgtgaacatgtggcaacgcgtctggaattacctgttctggacccgtcagccgaagattttgacgcgcagctgcgggcgcagtttggtggttcgctggcgcagaaagtgattgacgcgacaggtaatcaacatgcgatgaataacaccgtaaatctgattcgtcacggcggcacggtggtatttgtcggcctgtttaaaggtgagttgcagttctccgatccggaattccataaaaaagaaacgacgatgatgggcagccgcaacgccacgccggaagatttcgctaaagtcggtcgattgatggcggaagggaaaatcactgccgacatgatgttaacccatcgctatccgttcgccacgctggcagaaacctacgagcgcgatgtgattaacaatcgtgagttgattaagggcgtaattactttctga

SEQ ID NO: 9988 - protein, 340 aa, Escherichia coli
MSTMKVLICQEIKNLVWEVRERPVPGDNEALIKIKTVGICGTDIHAWAGNQPFFSYPRVLGHEICGEIIESGKNIHNFNIGQQVAVIPYISCQQCPACKSGRTNCCEKISVIGVHQDGGFSEYLSVPVANILPADGIDPQAAALIEPFAISAHAVRRAAIAPSEQVLVVGAGPIGLGAAAIAKADGAQVVVADTSPARREHVATRLELPVLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 9989 - DNA, 387 bp, Escherichia coli
ttggcgcaatcaccatctcttgtctcccgtcagattaaccagcagcttgccgaaaataactatttcttcgccaaaaatgatgaggggttggctacgtttacggcagtcgagactaagattaagcaatacgacgccatgctttataagcagatggaagccactcgtgatgcttaccagcagtacagcaaatctgttagcgcccgcggcgtgaagaggatgaactttattgatttcaatgaagctgttggcatggctatgcgccgtggtgatcagagtgatattcctgaggtttcctacacaccttctccggcctacaaaacattattgagaaacagaaaaaaaacagcgcccaacacttccccggacgctgcatggcaacttgaataa

SEQ ID NO: 9990 - protein, 128 aa, Escherichia coli
MAQSPSLVSRQINQQLAENNYFFAKNDEGLATFTAVETKIKQYDAMLYKQMEATRDAYQQYSKSVSARGVKRMNFIDFNEAVGMAMRRGDQSDIPEVSYTPSPAYKTLLRNRKKTAPNTSPDAAWQLE

SEQ ID NO: 9991 - DNA, 62686 bp, Escherichia coli
tttctctttgttgttacgaccatcttgtgaagtgtttcacgttgtcgtctcaacggaggcgcattatagggatcccaattttttgcacaagtacttttttgatctttttttctgtttgttgctttttcaccctttttgctgcattcgcacacaaaacggtgcttttttgcatgctaaaagacttgcacaaggccaataatgcacccaaagtcattagtaaatcatttattgttgaggtgagtatgtctgatgttttacgcccataccgcgatctttttccacaaatcggtcagcgcgtaatgatcgacgatagcagcgtcgtgattggtgacgttcgtttggctgatgatgtggggatctggccgctcgttgtgattcgtggagatgtacattatgtacagatcggagcacgcaccaatatccaggatggcagtatgttgcatgtcactcataaatcctcgtacaacccagatggcaacccattaaccattggcgaagatgtcactgttggtcacaaggtgatgctccacggctgcaccattggcaatcgagttttggttgggatgggctcaattttacttgatggcgcaatagtagaagatgatgtgatgattggtgcgggtagcctggtcccacaaaataaacggctggagagcggatatctgtatctcggtagccccgtcaaacagatccgcccgttaagtgatgaagagaaggctgggttacgctattccgcaaataactacgtgaaatggaaggacgaatatctggatcaaggtaaccagacccaaccttgatcatcttcactttgttcctgaattaagttttccgcttcttcttccaggtcccagcgatgctgacgaaaactcgctaaccactgttctggcgtatctccagtaaagcgatacgccagactctcgccagagatcgcacatgtcagttgcataccattcacgagagcgggaaaacatacacatcttttattctcgtcccactcttccctatccggaaactggatggcctgattcacgctgacaattcctgttgcaatagtttgatgaccggttctacatcaggcagaacgccatgccaaagaaggaaggcatgagccgcctgtgccaccagcattcctaaaccatcagcattacgctttgagcctcgctgctcacaccatgccagaaaaggagtttttcctttctgatagaacatgtcatagcaataaatgcctggatgaatgagcgatgacgggatcgccggaatatcaccactgatgccactggatgttgcattaataatgagatcaaactcatgaccttccagttcgtccatacccaacgcctgaatactgccagtgtgcgcaaacaatttagtcaactcttctgcgcgagataccgtccgattagtgattgtcaccgcacagtccagggaaaggagtggcagtagtacgccgcgagatgctccaccagcgccaatgagcagaatacgtaaaccaggacggataaaagacagacgttccagatcgcttaacaaacctataccatcggtattgtcacccagcaggcgtccatcttctaaccgcttgagggtattaacagcaccagccaacgctgcccgttcagtaagctcatccgctctggcaaaagcctcttctttaaaaggtaccgtcacattcgcacctttaccaccagcactaaagaaagcgttcagtgtgttgatgaaatcattgatgggtgccaacacgcgtccatagggatgttcaatattcagttgctgagcaaattgctgatgaatgaatggcgatttgctgtgggctatcggattaccaaaaacagcataggtttccattatgttacccctgtcgaaacagttcacccgtcagggcatcgcggatttctgaaggatttaaacgcccccccgtttcaccaggcacaaccgggaacgccgcgccaaattgtgcgcgaacttcgtctactgttcgacaaggtggcaatccactcaagttggcactggtagaaaccagcggtttaccataagcctggcacaaagcaaccaccaacggatggtcggtgactcgtacagcaagcgaatcaaagcggcccgtcaaccagcgcggtgttgtcgcaggcgcgggaaaaacaaaggtgacaggacctggccagcgagaaaatatagtttcacgctgcgcgtcagtcagcatggtgtcatcaatatagggtttaagctgctcgtaatttgcggcgattagaatcagccccttatcaaccggacgctgttttaactccaacagtcgcatcactgctgtttcgctatcaggatcgcacccgacaccgaaaacggcttccgttggataggcgatgacacgttcttcattgaggacatctatcgcagctgcgatagcgtctccttgcaggttattattcacgttattattccgccgaaatcggctttccacattgtttactggcacaaaagtgttttacaccctgcgcggttttcttttcgatgagtagcggataatggcactcagggcattctccagctatgggtttgaagttaatggcaaattgacactccgggtagcgatcacaggagtgaaatgttttgccataacgggagcggcgctgaaccagatggcccgtccggcattgggggcatgtaattgctgtttcgtccggtttatcgataagttcggtatgttcgcattcagggtagttactgcaaccaataaacataccaaagcgtccctggcgtaataccagatttgcgccacatgcagggcaaacctgcccctccagaactttgacaatatgtccatccgctgaagatttcagaggacggacgtagtcacacgccggatactgtgagcatccaagaaacggaccgtgtttcccggatcgaataactagttcagccccgcactttgggcaggactcattattacgcaccgtgaacagtgctgatttcgccataactacttatgctgaattaaagaaatgattaatgcagcataccttcattcacttcaaagagtaattcttccatttgctggtacgcattttcgcagcccggaatattgaacaacaccatcaggattacccatttcaggtcttccaggtcgaactcagcggtatccagcgcgagcactcgctctatcaccatttcacgggtttcaaggttaagcacctgaatttgctcaaggaaaagcagaaaaccacgacagctggcatccagtctttcacactcttcaggggtataaatacgcatggagagtggatcagaggccagttgcatcggttctgccagtccttcctgataatccgcaagcttttccagccaaagcagggcattgtagatatcttctcgatcaaatcctgcgtcggtaagatcctgttcaagtttgtcttgatccacacgcaactcagcttctgtgtgaatataggtttcaaacaaatacattagtacgtcgaacatggcatgccctcctcaatcggacatagccgccgggtacagctgcgatccatcctgctaactccagttcgagtagttgagtaactacctctggcacaggttggccggcacgttcagcgacgacgtcaacaggtgttacctcatctcctacgttagccaggagctcaggaaatggcaatgccacgtcttcctgatctggtgaataaaatgaattttcaggggcgtctggcaaccagtgcaatccaaattgcaagttttccagaatttcttccggttccgtcacaagaatcgcaccttgttttattaaccagtgaggcccttcgcttcccggattccctattggacctggcaaagcaaaaacttcacgcccctgctcaagcgcacaacgtgctgtcaccagcgaaccactgcgcaaagccgcttccaccaccagtacacctttacttagaccactgataatgcgatttcttcgtgggaaattgtaagcaaggggtggaacatcgaggggaaattccgagacgagagcaccaccttgctcaagtagactggcagccagtggagcatggcggcggggatgaatggtattaagtccattccccaatacagcaatgctaacgccatttacctgtaaggccgctttatgcgccacaccatcgattccacgcgccagtccactcgtaattgtcactccacgcgtcgccagagtttcgcaaaataatcgtccccatcgctcgccataccatgaatgcgcccgactccccactacggcaagctgaaatgaatgcaacgcgtgcagttctccttcaacaaacagtgcgccggggtaatctgtcgtcgccagaagttgaggaggataaaattcgctgtccgcagggattaaatgatggttgggttgctccaaccaacaaagtgagctttcgatactctttcgcggaaatgaaagaaagcgttgtgcctgccgcaatgtaagccctgtttgctgcaatacaaccgcatcaatatgcgactgttttgccagccagtgagctatacggaccatatcatcgccatacaagctgctgatgctaattaaacgcagccaaatttctgtatcaaccatccttatctccctgccataagcagccttagcaatctttgcgattggtcagtgatgctgtcaatcagagggggatttgtctagaatagaagaaataatctttctaactcctgaacacatctctggagatttatgtcagttttgcaagtgttacatattccggacgagcggcttcgcaaagttgctaaaccggtagaagaagtgaatgcagaaattcagcgtatcgtcgatgatatgttcgagacgatgtacgcagaagaaggtattggcctggcggcaacccaggttgatatccatcaacgtatcattgtaattgatgtttcggaaaaccgtgacgaacggctggtgttaatcaatccggagcttttagaaaaaagcggcgaaacaggcattgaagaaggttgcctgtcgatccctgaacaacgtgctttagtgccacgcgcagagaaagttaaaattcgcgccctggaccgcgacggtaaaccatttgaactggaagcagacggtctgttagccatctgtattcagcatgagatggatcacctggtcggcaaactgtttatggattatctgtcaccgctgaaacaacaacgtattcgtcagaaagttgaaaaactggatcgtctgaaagcccgggcttaaggataagaattaacgtgtcagaatcactacgtattatttttgcgggtacacctgactttgcagcgcgtcatctcgacgcgctgttgtcttctggtcataacatcgttggcgtgtttacccagccagaccgaccggcaggacgcggtaaaaaactgatgcccagcccggttaaagttctggctgaggacaaaggtctgcccgtttttcaacctgtttccctgcgtccacaagaaaaccagcaactggtcgccgatctgcaggctgatgttatggtcgtcgtcgcctatggtttaattctgcctaaagctgtgctggagatgccgcgtcttggctgtatcaacgttcatggttcactgctgccacgctggcgcggtgctgcaccaatccaacgctcactatgggcgggtgatgcagaaactggtgtgaccattatgcaaatggatgttggtttagacaccggtgacatgctttataagctctcctgcccgattactgcagaagataccagtggtacgctgtacgacaaactggcagagcttggcccacaagggcttattactacgttgaaacaactggcagacggcacggcgaaaccagaagttcaggacgaaactcttgtcacttacgccgaaaagttgagtaaagaagaagcgcgtattgactggtcactttcggcagcacagcttgaacgttgcattcgcgctttcaatccatggccaatgagctggctggaaattgaagggcagccggttaaagtctggaaagcatctgtcatcgatacgacaacaaaggctgcgccaggaacaatccttgaagccaataaacaaggcattcaggtagcgacaggtgatggcatcctgaatctgctctcaatgcaacctgcaggtaagaaagcgatgagcgtgcaagacctcctgaattctcgtcgggaatggtttgtaccgggcaaccgtctggcctgatagtccactcttctaagcccggtcttaccgggcatctttatatttatacttatgaaaaaacaacgtaatttacgtagcatggcggcccaggccattgaacaagtcgttgagcaagggcaatcactgagcaacattctgccaccgctccagcaaaaagtttccgataaagataaagctcttctccaggagttatgctttggcgtactgcgtacgctctcacagttagactggctgattaataagctaatggcccgtccgatgacaggcaaacagcgtactgttcattacctgattatggttggtttgtatcaactgctttatacccgcattccacctcatgccgcgctggctgaaacggttgaaggcgcagttgcaattaagcgcccgcaacttaagggattgattaacggtgtattacgtcagttccagcgtcagcaagatgagttattagccgagtttaatgccagtgatgcacgttatctgcatccttcctggttgctgaagcgtctgcaaaaggcgtatcccgagcagtggcaatccatcgtcgaagccaataaccagcgtccgccaatgtggctgcgcgttaatcgtacgcatcattcccgcgacagctggcttgcattgctggatgaagcaggaatgaaaggtttcccgcatgcggattaccctgatgctgtacagctggaaacacctgcacctgttcatgcgctacccggttttgaagaaggatgggttaccgttcaggatgcttcagcacaaggttgcatgacctggcttgctccacaaaatggtgaacacattctggatctttgcgccgccccaggcggtaaaacaacgcatattcttgaggttgctccagaggcgcaagttctggcggtcgatattgatgagcagcgcctctctcgcgtttacgacaatttaaaacgccttggtatgaaggcaaccgtaaaacaaggtgatggccgttacccttcccaatggtgtggtgagcaacagttcgatcgcattttattagatgcaccttgttcggcaactggtgtaattcgtcgccatccggatattaaatggttacgccgcgatcgcgatatcccagaactcgcgcagttgcagtctgaaattctcgacgccatctggtcgcatttaaaatccggaggaaccctggtctatgccacctgttcgatgttaccggaagagaatagcctgcagattaaagcctttttgcaacgtaccgctgatgccgaactttgcgaaacaggaacaccagagcaaccgggtaaacaaaatttgcccggtgccgaagagggcgacggcttcttttacgctaagctaatcaaaaagtgatgagataacgggtcgcgactgatgaaaattatcattctgggtgccggccaggttggcggcacactggcggaaaacctggttggcgagaacaacgatattactgttgtcgataccaacggtgagcgtctgcggaccttacaggataaatttgacctgcgagtcgtgcaagggcatggctctcatccacgcgtattgcgggaggcaggtgccgacgacgccgatatgctggttgctgtaaccagttcagatgaaaccaatatggttgcctgccaggtagcctactcacttttcaacacccctaatcgcatcgctcgtatccgctcaccagactacgtgcgcgatgccgataagctatttcattcagatgctgttccgattgatcatctgatcgcaccagagcagttggttatcgataatatttaccgactgattgagtatcccggcgcattgcaggtggtgaacttcgctgagggtaaagtcagcctggctgtggttaaagcctattatggcggcccgctgattggtaatgcactttcgaccatgcgcgaacatatgccacatatcgatactcgtgtggcagcaattttccgccacgatcgccccattcgtccgcaaggttcgaccattgttgaagctggtgatgaagtgttctttattgccgcttcacagcatatccgcgcggtgatgagtgaattacagcgactggaaaaaccgtataagcggatcatgctggttggtggcggtaatatcggtgcagggctggcgcgtcgtctggaaaaagattacagcgttaaactcatcgaacgtaatcagcagcgcgctgccgaactggcggaaaagttgcagaatacgatcgtcttttttggtgatgcgtcggatcaagaactgctggccgaagaacatatcgatcaagttgatctgtttattgccgtcaccaacgatgacgaggccaatatcatgtccgccatgcttgccaaacgtatgggtgcgaaaaaggtgatggtattgatccaacgtcgcgcttatgtggatctggttcaggggagcgtgatcgatattgcgatttcaccacaacaagcaactatttctgcgttgcttagccatgtgcgaaaagcagatattgttggtgtttcctcattacgccgcggcgtagcagaagctattgaagccgttgctcacggtgatgaaagcacctcacgcgttgtcggcagagtcattgacgaaatcaagctaccgccaggaacgattattggagcggtggtacgtggaaacgatgtgatgattgccaatgacaatctgcgcattgagcaaggcgatcacgtaattatgttcctcacagataaaaagtttattaccgacgtcgaaagactcttccagccaagtcctttcttcttgtaattaataaggcgtctaatgacgccttattatttccctttgattattaaggattaattaaatccattcctggcaggaaaatggcttaacatttgttagacttatggttgtcggcttcatagggagaataacatgagcattattaaagaatttcgcgaatttgcgatgcgcgggaacgtggtggatttggcagtgggtgtcattatcggagcggcattcgggaagattgtatcttcactggttgccgatatcatcatgccacctctgggcttattaattggcgggatcgactttaaacagtttgctgtcacgctacgcgaggcccaaggggatatccctgctgttgtgatgcattacggtgtcttcattcaaaacgtctttgattttctgatagtagcctttgccatctttatggcgattaagctaatcaacaaactgaatcggaaaaaagaagaaccagcagcagcaacacctgcaccaactaaagaagaagtattactgacagaaattcgtgatttgctgaaagagcagaataaccgctcttaacaagcgtctgaaagcagaaggccagtggtaaaaaagtgatttactttcttgccactggcctcccagttcccccgattgccatgttttccttttcgcatgtaactgcctttccctttcttatttttctctactcgctgtcggaataagggatcatgtagtaatgcttctatcgcattatcctttatctgccctttagtatgctgatatcggctcataaaaactccagttggttatttaacggcgcgagtgtaatcctgccagtgcaaaaaatcaacagccactcttaacgccactcgccccttgttcaagagcttcaagaatcgagcaataaacactgctatgggcggtcccacaacaggtatcattaaggcgttgcaaggaacgctgcatactctgcaactcggctatacgagcttcgacttcctgcaatcgttcctgcacaatgccttttgactcctgacaggtatggtgttccggatcgatacggatcgacagcaactcgcggatcgactccagactgaaacctagttgtctggcatggcggataaatttcaatcgctggagatcgctttcggtatacaggcgaaacccaccttcggtgcgtacttcatgctccatcatctgctgcttttcgtaataacgaatcgtgtcgggtgttacttccgccatttttgccagctcaccaatgcgatacatacatactccactagttatcgttgattttgttcaacaacttgtcagcataatcgccgcgtaaaaaatcggtactcaatccagcttgtcgcagcttcaattccagtaatgacaatcgacgactaacctcttgatattgcggatcatcatgacggatacctttgagaatatccagaagctgtattgcttccctcctatgctcaagttctggcggtaagcaaccagcattcttcagcaagcgataccccgcacgtaattccggtggcacatgagaatcatcatccagtatcaatggttcgccgctacctaccaggttatcaaactcacctttcgcttgcgcttctgctatatgacgctctgcccactggtcaagtaaccacataaatactccaggggatgaataaaaagagtacagctattgtagataagtggggatgctacgggtataaaaaaacccgccggggcgggtttttttacgttgcttcagattactctgcagcagcttctgctttctctgaacgatcaaccagctcgatgtaagccatcggcgcattgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacagtccacgggaagccagcacgtctttaatctcagtaagagattttttaccaaggttaggcgttttaaggagctcaacctcggtacgctgtaccagatcaccgatatagtggatagcttctgctttaaggcagttagcagagcggacagtcaattccagatcgtcaacagggcgcagcaggatcggatcgaactctggtttctcttctttcacttcaggctgacgtacatcacgtaagtcaacgaaagcttccagttgttcagccagaatggttgccgcacgacgaatcgcctcttcaggatcgattgtgccgttggtttccatttcgatgaccagcttgtccaggtcggtacgctgttctacacgcgctgcttcaacattgtaggcaatacgctccacagggctgtagcatgcgtcgaccagcagacggccgattgggcgctcatcttcttccgaatgaattcgggtagaagccggcacataaccacgaccgcgctgaactttgatacgcatgctaatagacgcgttctcatcggtcaggtggcagatcacgtgctgcggcttgacgatttcgacatcaccgtcgtgggtgatatcggctgcagtcacagggccaatgccagatttattcaaggtaagaataacttcatctttgccctgaactctcaccgccagccctttcaggttgagcaggatttccaggatatcttcctgaacgccttctttggtgctgtactcatgtagtacaccatcaatctcaacctcggtcaccgcgcaacccggcatcgatgagagcagaatacggcgcagtgcgttacccagagtatggccaaagccacgctctaaaggctcaagggtcaccttggcgtgcgtcgaactcacttgctcgatatcaaccaggcgcggttttagaaactctgtcacagaaccctgcattgtgtcctctctttggtactaagctttacttggagtaaagctcgacgatcaggtgttcgttaatgtccgcagacagatcagaacgctccggcttacgcttaaacgtaccttccatcttgccagcatcaacttccagccaggttggcttttcacgctgctcagccagctccagagcggctttcacgcgagactgcttcttcgctttctcacgaatgcttacaacgtcattcggactaacctgataagaagcgatgttaacaacacgaccgtttaccataattgctttatggctaaccagctgacgtgcttctgcacgagtggcaccgaagcccatacggtatacaacgttgtccagacgaccttccagcagagccaacaggttttcaccggtgttgcctttcagacgtgctgcttctttgtagtagttacggaactgacgctccagcacaccatagatacggcgaactttttgcttttcacgcaactgcacaccatagtcagacagacgcggtttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaacaaacctggaaaacgaggcgttatacgcgacgttttttcggcggacgacaaccgttatgagggatcggagtcacatcagtaatgttagtgatgcggaaacctgcggcgttcagagcacgaatagtagattcgcggcctggacccggacctttaaccataacttccagattcttgatgccgtattctttcacggcgtcagcgcaacgctctgctgcaacctgtgctgcaaacggagtggatttgcgagaaccacggaaaccggaaccaccggctgttgcccaacccaacgcgttaccctgacgatcagtgatagtcacgatggtgttgttgaaagaagcatggatatgagccacgccgtcagagacttgttttcttacacgtttacgtgcacgaattggtgcctttgccattattcaatcaccccgattatttcttgatcggtttgcgcggacccttacgggtacgtgcgttggtcttggtacgctgaccgcgaaccgggagaccacgacgatgacgcaaaccgcgatagcaaccaagatccatcaggcgcttgatgctcatgctgatttcacggcgcagatcaccttcaacgacaaatttggcaacttcgtcacgcagcgtgtcgatttgtccttcagacagctcactgatcttaacatcttcagcgatacccgctgcagccaggatggctttagaacgggtcttgccgacgccataaatcgaagttaatgcgattacggcatgcttatgatcaggaatgttaatgcctgctatacgggccactatgcactcctactatttaatatgtacgttccatgctgaaaagcccgttttcaggatactcaaatggaaacgcacagacatacaaaagattggctggctaatctagccagctcaacccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcgggcgaccaattatcggccgtagcctttcaggttcgccttcttcaatgcagactcatactgactggacatcatcagagtttgcacttgagccataaagtccataatcacgacaacaacgataagcagtgaggtcccaccgaagtagaacggtactttcattgcatcacgcatgaactccgggatcaggcagataaaggtaatgtacagcgcaccaaccaaggtcaggcgggtcattactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccgcccccgaaccatgacgcgatggtcgccgggaacagaataatactggaagcgaagattgccgggattacccccgccatattcactttcagcggtaaatgtgtgctctgtgcagcatagacacgacgaccttgctgacgtttcgcgtagtttaccacaatgcggcgttgaccacgctcaacaaatacaacaaagaacgtcactgcaaatactaatactgcaaccaacagcaacacgaggaagtgcacgtcgccttgacgcgcttgctcgatagtatgggcaatggctggcgagagtcccgcgacaataccggcgaagataatgatgaaataccgtgccgatacctcgttcagtgatctgttcgcccaaccacatcaggaacatgatttcctgtgaccagacttacacagcggtgaagtagaatgcaaagcccgggttaatgaccaggccttgcataccaggcatattcggcagaccggtagcaataccgatcgactggaatattgccagcaccagagtaccgtagcgggtgtactggctgatcttacgacgaccagactccccttctttcttaatttctgccaacgttggatgaaccaccgtcagtagctggataatgatcgacgccgaaatatacggcatgatccccagagcaaagatagaagcacggctgagagcaccaccagagaacatgttaaacatctcaatgatggtgcctcgctgttgctcaagcagtttggcaagtacagcggcatcaataccagggatcggaataaaagagccaatacggaacacaatcagcgcaccgataacaaacagcagtctgcgtttcagctcgcctaagccacctttggcactttgaaaatctaatcccggttgtttagccatctgctacttattcctcgattttaccgccagcagcttcgatagcagcacgagcgcctttagtaacacgcaggccacgaacagttaccggagtcgttacttcgccagccaggatcactttcgcgaactcgatctggataccgataatgttagccgctttcagcgtgttcaggtctacaacaccgccttctactttagccaggtcagacagacgaacttcggctgtaatcgctgctttacgagaagtgaagccgaatttcggcagacgacggtacagaggcatctgaccaccctcgaaaccgcgacgtacgccaccgccagaacgagatttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgatcataccgcgaatagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatttctggagaattcatattttccaggccatcgatagttgcacgaaccacgttaatcgggttggtggaaccatacgctttagccagaacgttatgaaccccagcgacttccagaacggcgcgcattgcaccaccggcgatgataccggtaccttcggaagccggctgcatgaatacgcgagaacccgtatgaacacctttaacagggtgttgcagagtaccgttattcagcgcgacgttaatcatattgcgacgggctttttccatcgctttctggatcgctgctggaacttcacgcgctttaccgtaaccaaaaccaacgcgaccgttaccatcgccaactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggatacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagggtattatctgcatgtttaacttcaacagcatcgttgagagtacgagtcagctcgccgtttttacctttgatcgtaataacctgaccgttgatttttacgtcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagacccgccataactttcggcagctcatctttacgtttatagatgcgcagacctgggcggctgacacgctgaatgctttctacaacagctttgccctggaaatacttcagagtaagttccagttcaggcttggtgtcgccttcaactttaaaatcttcaataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccgggatttcaccgcgcatagcggcttcacggaccttaatacggctcaacccgaacttccgcaggaaaccatgcggacgacctgtttgacggcagcggttacgctgacgagacgggctggaatcacgcggcagagtctgcagcttgagaacagcgttccaacgatcttcgtcggaagcgttcacatcagagatgatcgctttcagttcagcgcgtttcgcgaagtatttatcagctaaagctacgcgttttacttcgcgtgctttcattgattgcttagccatttagtaaccctaccttacttgcggaacgggaagtcaaaggcagccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccaaattacttgatagtttcgctgttagacttgaagaaacggacttttttaccgtcttcgaatctaaagcctacacggtcagccttgccggttgtcgcattgaagattgctacgttggaaacctgaatagcggcttctttttcaacgatgccacccggttggttcagggccggaaccggcttctgatgtttcttaaccaggttgataccttcaacaatgaccttgccggaagacaggacattcttaactttaccgcgtttacctttatctttaccggttaacacgataacttcgtcatcacgacggattttcgctgccatgattcgctccttagagtacttctggtgccagagagataattttcatgaacttctcactacgaagctcacgagttaccggcccaaaaatacgcgtaccgataggctgctcgctgttgttgttcagaagaacacaagcattaccatcgaagcgaatgacagaaccgtccgggcgacgaacacccttcttggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaatcaggtcgttaaaaatccccatatcgagggcgcggcattataacaccgcttcaaggatatgggtagaaaaaataaacggctcatttctgagccgtttattcgtatcgagagagtgtactgtattacagaaccgctttctctacaacgcgaaccagcgtccaggatttagtcttggacagcggacggcattcgcggatttcaaccacgtcaccgataccgcattcgttgttctcgtcatgtacgtgcagtttggtcgtacgcttgatgaatttaccgtagatcgggtgtttcacaaaacgttcgatagcaacaacaatggatttctccattttgtcgctaacaacgcgaccttgcagagtacggattttatcggtcattacgcacccgccttctcgttcagtaaagtcttaacgcgtgcgacatcgcgacgcacttgcttcaacaggtgagactgttgcagctggccacttgcagcctgcatacgcaggttgaactgctcacgcagcaggttcagcagctcggtgttcagctcttcaacgctcttctcacgcagctcttttgctttcattacatcaccgtcttagttacaaaggtggttttaatcggcagtttcgctgctgccagcttgaatgcttcacgggccagctcttccggaacaccgtccatttcatacaggactttacccggctgaatcaaggcaacccaatactccacgttacctttacctttacccatacgcactgccagcggcttttcagtgatcggtttgtccgggaacacacggatccagatcttaccttgacgcttaactgcacgggtcatagcacgacgtgctgcttcgatctgacgtgcagtcagacgaccacggccaacagctttcagaccgaagctgccgaagctaacatccgtaccctgcgccagaccgcggttacggcctttgtgcattttacggaattttgtacgctttggttgtaacatcagcgacgctccttatttacggcctttacgctgctgctttttaggctgagcagccggtttttccggttgttcaacagcagccataccacccaggatctcgcctttgaagatccacactttaacgccgattacaccgtaagtggtgtgcgcttcagaggtgttgtagtcgatgtcagcacgcagagtgtgcagcggtacgcgaccttcgcggtaccattcggtacgtgcgatttccgcgccgcccagacggccgctaacttcaactttaatacctttagcgcccagacgcattgcgttctgtacagcacgcttcatagcacgacggaacataacgcgacgttccagctgagaagtgatgctgtcagcaaccagttttgcgtccagttcaggcttacgaacttcggcgatgttgatctgtgcaggaacgccagcgatgtccgctacgaccttacgcagtttttctacgtcttcaccttttttaccgataacgatacccgggcgagcagtgtgaatggttacacggatgctcttagccggacgctcgataacgatacgagatacggacgctttagccagttccttagtcaggtactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccgaccatttcgtcggttacaaataccggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgaacgccccacggagttaccgggtgcttaccaaagttacgaccttcaccaccaccatgtgggtggtctaccgggttcatcgcggtaccgcgaacggtcggacgaacaccacgccagcgtgcagcacctgctttacccagaacgcgcagcatatgctcagcattgccaacttcgcccagagttgcacggcagtctgcttctactttacgcatttcaccagaacgcagacgcagggtgacataagcaccatcacgagcaacgatctgaacgtaagtaccagcggaacgtgccagctgaccgcctttacctggtttcatttctacgttatgaacagtagaaccaaccgggatgttgcgcatcggcagggtgttacctggtttgattgcagcatcaacgccagactgaatctggtcgccagctttcaggcctttaggggccaggatgtaacggcgttcaccgtctttgtacagaaccagcgcgatgttcgcggaacggttcggatcgtactcaagacgttcaacaactgccgggataccgtctttgttgcgtttgaagtcaacaatacggtaagcctgcttgtggccaccaccgatatgacgagtggtgatacggccattgttgttacgaccaccggatttgctgtttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttagcaactttgagtacgatggtgttggatttttccatcgcagtagacgctttttcagaaacgtgcggtgcacgcagcaccttcagcagacgttcttcacgaatcatgccagcatctcctcaacttgcttaacagcatcagcagtcattacgactttgtcgaaggcgatcaggctaaccgggtcgataccagttgcatcgcgtacgtcaaccttgtgcaggttgcgcgcagccaggaacaggttctcgtccagctcaccggtgatgatcagcacatcttccagagccatgtctttcagtttctgtgccagcagcttagttttcggcgcttctacagagaacttctcgacaacgatcagacgatcctgacgtaccagttcggacaggatgcttttcagcgcgccgcggtacatcttcttgttaactttttgactgtggtcctgcggacgagcagcaaaggtcacgccaccagaacgccagatcgggctcttgatagaaccagaacgcgcacggccggtgcctttctggcgccacggttttttaccggaaccagttacttcagcacgagtcttctgagcacgagtaccctgacgagcaccagctgcataagcaacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcgcctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgccagctttagcgaagtgtccagcttcaggcttggtcacacggttagcttttttagcaccggtggtcacctgaatagcacggtagccatcgttagccaggtctttaacctgagtaacgcggtttgcttcaacttcgattacggttactgggatagaaacgccgtcttctgtgaagatacgggtcatacccacttttttaccgactaaaccaatcattgtttcaacctctcaatcgctcaatgacctgattaacccaggctgatctgcacgtctacaccggcagccagatccagacgcatcagagcatcaacggttttctcggttggctcaacgatgtcaaccagacgcaagtgagtacggatttcgtactgatcgcgcgcgtctttgttgacgtgcggggagatcagaacagtgaagcgctctttgcgtgtcggcagcgggatcggaccacggacctgcgcaccagtgcgcttagcagtctcgacgatttccgcggttgcttgatcgatcagacgatgatcaaacgctttcaggcggatacggattctttggttctgcatgagaccagagctccaattattttataaacgaaaatgattactcctcagacccattacgattgatgggagagtgtaaccgttcttacgtagctccccgattgggagcattgttaggtagccaaattcggctaactgaggttcagattgaacctgctgtcaactacgacaagcccgcgcattatacatacttaaccaccgaacgcaagcgtattgctagtaaagtaaacagcctttgggttatctctcaagttcgttcagcgcatttttgacacgctctcttaaaccggctttctcgtcgctttcttctacagtattttcttcgtcttcagaagaagagggggcattctcaaccgcgacgcctggttcatcttcctcctcgacggattcgacgacggggagtggctgttttttgaaaaaatagtgttgtgttgattgtttaaaagcgggcgtttcagcatctacagtgacttctgcttttactatccaaagtgcccatagctgccgggcatacccaccaaccaacaccattcctgcaaaccacaggcaaatcagcaataaacaaatgacatatattatggtgctgtgtttttgtcgggagaagataccagggtgacccgtttctttctgctcacgcgcggcgatatagaattcaaacatgtcatttccccttcactgttgtttctggggaaatatttgcttcatcccgatataagtaggcactctcccccgccacctgccagagatgtactaacgttgaaaagccaacaacaccgtcagttttcaagtgatggcttttttgaaattgctttattttttctaccaacaagggacgccactctgccgaagattctgtcgaaatatgcaatgcgcggtttaacatcgtttccagccagagaatctcttcctcgctgctatcacgcataatggtactctccccttccggcgacattttccacaacagaagataatcacccgtccataccaactcaaaccatttatgtgtcagcgtccaggtttgctgccctacgagtacatcaacggtagcatcaccgacgcgaacgaccacaacaggcaattttttgtccccgactttaagcgatgcgatccagggcaaattctgatctaccaatgtttgtaaagaagcgttcccacttttacataccagccccgctcttactgcctgatcgcaccaggccgaatcggctggaacctcgtacccccatacgccgtataacacgcttagcgcctcactatcgcgcatcaccacatgagcaatatccttagtcatatcttgtttaactactggcgttacgggtatcagccacgcaggaacgggtaacggagctgtgaaagaggacagcagtagccaaccacaggtaagtgcgagaatggttccactcatcaccacggcaagctgcattttccgggggcgcttatcacctaatacgcggtaaatcattcgccattgttttgcagtgaaaacgcgggtctgctcggcttgctgtaataagctaattgtttcgccggcaagcgccagctttctgcgatctccccgacataataaagctatccgtttcagaactctggcggttaaaaggagatcgggctggtcaatattctgaccttcaaggatgcttgccttaagctcgtgctccgtcagacgacctgtcgagacaagttcaatgccctgttttttaaaatcacgttcaacttttcgatcgggtctgccgatcagcaaaaattgaccgtcaggaataagagatatcgcgcgttggagatcatcaagtatgcggcggtgattcaggtgagcattttcaataataataagagggcagcgactatcagttcgatgaagtgcatgcagtaattgacccgccatctcatctcgcgtccaggcgctgtcacggcagccctgttcagccgcattatcgtcggtaacgatccatgcggccttaccttgccaggaaacaacgaggcttaaagtaatcacacggcgatgtttatctttttgtagttgctgcgccagccaggtttttccacttccagcctcacccaacaaatagcacagacgccaggtctgacgtttctcacgcaaccaggaaagaatgacttctcttctcgtagacatagaacttcctgttttaattattgattatccttaatcataaaaataatgtatgtatttattaattaaatacatattactaatataaataaattttgcttgattcatgcaagcggcattaatactatttatactaacgtcaatatacaacccacccaatctattttattagaacatacatcgtgcccacactacctttccctttccatctggcgaatcataataaagatgctgccatcaatatattgattatatttataagcatagggttgattatttttaatgtgaattatttccatacaactatagttaaaaatgaacagatcattaatcaaccaacaaatgcatttcagtctgaattcagccttgccgctttatggcgcaacgaaaatcatgctggggtaaaagatgcaaatcccgtggcagttaatcaggaaacacctaagctctctatagcgcttaatggcattgtactcacatcgaatgatgagacttcttttgtcttaattaatgaggggaacgaacaaaagcgatactccctcaacgaagcccttgagtcagcgccgggaacgtttattagaaaaataaataaaaccagcgttgtgtttgaaactcacgggcattacgaaaaagtaactctccatccagggctacctgacatcatcaagcagcctgattcggaaaatcaaaatgtactcgccgattatattatcgccacacctatacgtgatggagaacagatatacggtcttcgattgaatcctcgtaagggtctcaatgcatttaccaccagcttgctgcaacctggggatatcgccctcaggatcaataatctttcgctgacccaccctgatgaggtttcacaggcattaagtttactgctaactcaacaaagtgctcagtttacaattcgtcgcaacggcgtaccccgcttgataaatgtttccgtcgcggaacttacaggaatgaatggacagcgcaatgaagggactcaataaaatcacctgctgcttgctggcagcactactcatgccttgtgcaggacacgctgagaacgaacaatacggcgctaacttcaataacgccgatatccgccagttcgtggaaatagtgggtcagcatcttggcaaaacgatcctgatcgacccttcggtacagggaaccatttccgtacgcagtaatgatacgtttagccaacaggagtactaccagttctttttaagtattcttgatctttacggttattccgtgatcacactggacaatggttttctgaaagtggtgcgctcagctaatgtaaaaacatcgccagggatgattgctgacagttctcgtccaggcgtaggtgatgagttggtcacccgaatcgtaccgcttgagaacgttcctgctcgtgacctggctcccctgctccgccagatgatggatgcgggtagcgtcggtaatgttgtgcattatgaaccctccaacgttcttattctgaccggtcgtgcctccaccattaataaactgattgaagtcataaagcgcgttgatgtcatcggcacagagaagcagcaaattattcatctggaatatgcatcagcggaagatctcgccgagattcttaatcaattaatcagcgaaagccacggtaaaagccagatgcctgccctcctttccgcgaagattgtggcggataagcgaaccaactctcttatcatcagcgggccggaaaaagcacgccagcgcataacttcattactgaaaagccttgatgtagaagagagcgaggaaggaaatacccgggtctattacctgaaatatgctaaagccacgaatctggtggaagtgctaaccggtgtttccgaaaagctgaaagatgaaaaagggaattcgcgtaagccttcttctacttctgcgatggataatgtggccattaccgccgatgaacagaccaactcgttggtcattaccgctgaccagtccgtccaggagaaactcgccacggtaattgcgcgtctggatattcgccgtgcacaggtgctggttgaggcaatcatcgtcgaagttcaggatggaaatggactcaacctcggcgtgcaatgggcgaataaaaacgttggcgcacagcaatttaccaatacgggattaccggtttttaacgctgcgcaaggtgtagctgattataaaaagaatggcgggatcaccagcgcgaatcctgcctgggatatgtttagcgcctacaatggcatggctgcaggcttcttcaatggcgactggggcgtattgttgactgcgctggccagtaacaataaaaatgacatcctcgccaccccgagcatcgtaacgctggataataaactcgcgtccttcaacgttggtcaggatgtgccggtgctatccggctctcagaccacttctggggataacgtctttaatactgtcgaacgcaaaacggtgggcacaaaactcaaagtcactccgcaggtcaatgaaggcgacgcggtactgctcgaaatagagcaggaggtttccagcgttgactcttcgtctaattcgacgctcggcccgacatttaacacccgtactattcaaaacgccgtgctggttaaaaccggtgaaacggtggtcctgggcggattgctggatgatttttctaaagagcaagtgtcaaaggttcctctgcttggcgatattcctttagtgggacaactcttccgctatacctcgaccgagcgcgctaaacgcaacctgatggtatttatccgtccgacgattatccgtgacgatgatgtttatcgctcactgtcaaaagagaaatacacccgctaccgccaggagcaacagctgcgaatcgacgggaaatcaaaagcgctgattggctcggaagatttgccggtgctggatgagaacacgttcaacagtcacgctcctgcgccatcgtcacggtgaggcattcttatgagaattcactcaccgtaccccgccagttgggcgctggcacaacgaattggttatctctattcagagggcgagattatttatctcgccgatacgccattcgaacggttactcgatattcaacgtcaggttggccagtgccagaccatgaccagcttgtcacaggctgattttgaagcccggctggaagcggtgttccatcagaataccggtgagtcgcaacagattgcgcaagatatcgatcaatccgtcgatcttctctcgctttcggaagagatgcccgcaaatgaagatctcctgaatgaagattcagcggcaccggttatccgcttgatcaatgctattttgagtgaggccatcaaagaaaccgcctccgatatccacattgaaacctatgaaaaaacaatgtcgatccgttttcgcatcgacggcgttttgcggacaattttacagccaaacaaaaaactggcggcactgcttatctcccgaattaaggtcatggctcgtcttgatatcgccgaaaaacgtattccacaggatggacgtattagtttgcgtatcgggcgacgtaacatagatgtccgcgtatccacactgccgtccatctatggtgaacgcgccgtgctccgtctgctggataaaaacagcctccagctttcattgaacaacctggggatgacggcagcggataaacaggatttagaaaatctcatccagcttccacacggtattatcctggtgaccggaccgacaggctccggtaaaagtaccacgctctacgccattctttcggcgctgaatactcccggccgcaatattctgacggtagaagatcccgtggaatatgaactggaaggcataggacaaacgcaggtgaatacccgtgtggatatgtctttcgctcgcggcctgcgcgccatacttcgccaggacccggatgtcgtcatggtgggggaaattcgtgatacagaaaccgcgcaaattgcggttcaggcctcgctcaccggccatctggtactctcaacactccacactaacagtgcatcaggcgcagtgacccggctccgcgacatgggcgtcgaatcattcctgctttcgtcttcactggcagggattatcgcgcaacgtctggttcgtcgtctgtgtccgcaatgccgacaattcacgcctgtatcgccgcaacaagcgcagatgtttaaacatcatcagctcgcggtgacgacaattggcactcccgtaggctgccctcattgccatcaatccggctaccaggggcgcatggcgatccacgaaatgatggtggtgacgccggaattgcgggccgctattcatgaaaatgtggatgaacaagcactggagcgactggtccggcaacaacacaatgccttaatcaaaaatggcctgcaaaaagtgatacgcggtgacacctcctgggatgaggttatgcgcgtcgccagtgccacgctggagaacgaagcatgaattatcgctatcgcgccatgacccaggatggtcaaaaattgcaggggatcattgatgctaacgatgaacgtcaggcacgactgcggctgcgtgaagaagggcttttcctgttggatattcgcccccaaaaaagttcgggagtaaaaacacgtcgcccgaggatcagccatagtgaactaacgcttttcacccggcagttggcaaccttaagcgcagcggcattacccctggaagagagccttgccgtaattggtcaacaaagcagtaataatcgactggctgacgtgttaaatcaggtacgcagcgccatccttgaagggcatcccctttccgatgcgttacaacattttcccacgcttttcgattcgctctaccgtaccctggtaaaagcgggcgaaaagagcggtctgctggccccggtgttggaaaagctggctgattacaatgaaaaccggcagaaaatccgcagcaagctcattcagtcactgatctacccctgcatgctcactacggtggcgattgtggtcgtgattattctcctcactgctgtcgtgcccaaaattaccgaacagttcgtgcatatgaagcagcaactgccactgagtacacgcattcttttaggtctgagcgacacgttgcaacgtaccggcccgacattattagcgacagtatttattgtcgctgtgggtttctggctctggttaaaacgcggcaataaccgccaccgttttcatgccatgttactgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgcctggcaaatgcggcagaaaacgttcgccagggtaacagcattcatctttcactggaacaaaccgcaattttcccgccgatgatgctctacatggtggcctctggcgaaaaaagcgggcaactcggcacgttaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaaggaaatcatatgcgcgcaacggataagcaacgcggttttacattactggaaattatggtggtaattgtcatcattggcgtactcgccagcctggtggttcccaacctgatgggcaataaagaaaaggcggataaacaaaaagccgtcagcgatattgtggcgctggaaaacgccctggatatgtacaagctcgacaatcatcgctatccaaccacaaatcaggggcttgaatccttagtagaagcgccgacactgccaccgctggccgcaaactataacaaggaaggttatatcaagcgtctgcctgccgatccctggggcaatgattatgtcctcgttaatcctggtgagcatggtgcatacgatctgctttcagcaggacccgatggtgaaatgggaaccgaggacgacatcaccaactggggtttgagcaagaagaaaaagtaagtcagcgatgaatcagcaacgcgggtttaccctgctggagatgatgctggtgctggcgctggtcgctatcacggcaagtgtggtgctcttcacatatggtcgggaggatgccgccagcactcgtgcgcgcgaaacagcggcgcggtttaccgctgcacttgaattagccatcgaccgcgccacgctcagtggtcagcctgtcggtatccatttctctgattcagcatggcgcattatggtaccgggcaaaacaccatcagcctggcgctgggttccattacaagaagatgccgcagacgagagcaaaaatgactggggtgaagaactctcaattcaacttcagccatttaaacctgatgacagcaaccaaccgcaggtggtgattctggccgacggacaaatcacgcccttctctttgttgatggctaatgccgggaccagtaagccgctcctgacgttagtcagttcaggctcatggcccctggatcaaacgctcgccagagatacccgcccatgaacaaacaatcagggatgacactgcttgaagtcttactggcgatgagtattttcaccgctgttgcgctgactttaatgagcagtatgcaagggcaacgaactgccatcgagcggatgcgtaatgagacgctggcattgtggatagcggataaccagcttcagtcacaagattcattcgacgaggaaaacacgtccagttctggcaaagagttaataaatggcgaagagttaataaatggcgaagagtggaactggcgcagcgatatccactcaagcaaagacggcacgcttctggaacacaccataacggtgacattacccagcggtcagacaacctcgcttacgcgctatcaaagcatcaataataaatccgggcaggcacaagatgattaatcgccagcagggtttcacattgctggaagtcatggcggcgctggcgattttctcaatgcttagcgtgctggcgtttatgattttttctcaagcttccgagttgcatcaacgttcacagaaagaaatccagcagttcaatcagctacagcgcaccatcaccattcttgataacgatctcctgcaactggtcgcccggcggaatcggagtacggataaaatcatggtgttgggtgaagaagcgatttttaccacgcaaagtcgcgatccgctggcccctctcagtgaagcacaaaccttactcactgttcactggtatctgcgaaatcatacgctctaccgtgctgttcgtacttctgtggatggcaggaaggatcaacccgcccaggcgatgctggaacatgtcgagagctttcttctggaaagtaacagcggagaaagccaggagcttcctctctcagtcacgttacatctgaagactcagcaatatggggcgttacagcgccgttttgcattacctgagcagttagcgagagaagagtcgccagctcagacgcaggccgggaataataaccatgaataatgaacaacgcggcgtagcactgctcattgtactcatgttactggcgctcatggctgctctggctgcagacatgacgatcagttttcacggccagcttcatcgaacccgccaggtaaaccatcatttgcaacggcaatatgatattgagctggcggagaaacttgcgcttgccagcctcacccaggacgttaaagataacgacagacaaaccacgttgcagcagtactgggcacaaccgcaacagttgcagctggaaaatggcaatacagtgaagtggcagttacgcgatgcccagcactgttttaatctcaatgccttagcaaaaatatctgacgccccgctggcttcccctgatttccccgcccaggtattcagtgccctgctgattaacgccggtatcgatcgcggaaacaccgatgagatcgtgcaatcaatcgctgactatattgatgccgatgattcgccacgctttcacggcgcagaagataacttttaccaaagccaaacgccgcctcgccatagcgccaatcaaatgctttttctgaccggtgaattgcgtcagataaaaggcataaccgaaaacatctatcagcggcttatcccgtatgtctgcgttctcccgacctcggaacttagcatcaatcttaatatgctaacggagaacgatattccgctcttcagagcattattcctcaataacatcacggatgctgacgctcgggtcttattacaaaaaaggcccagggaaggctggctcaccacagatgcatttctttactgggcgcagcaggatttctccggcgtgaagcccctggttgctcaggtgaaagggcatctctttccctatagccgctattttacgctgagtacggaaagtatcagcgacgaacaatcccagggatggcaaagccatatttttttcaaccgtaaacagcagagcgcccaaatctatcggcgtacgctgcaactctactaatcataaggatcgtgatgcctgaatcgttgatggtaatacgttctttctcgacgctgcgtaagcattgggaatggatgacgttctccgcagatagcgtatcttcggtacatacgctcacagacgatcttccgctggagtcgctggccgatcagcccggtgccggaaatgttcaccttttgatcccacctgagggtcttttatatcgttccctcacgctgcccaacgccaaatacaaactcaccgcgcaaacattacagtggttggcggaggagacattacccgacgccagccaaaattggcactggatggttgtcgataaacaaaacgaaagtgtcgaggtgataggcattcagtcggagaaactcagtcgttatcttgagcgtttacatactgccggactcaacgtgacgcgggttttgccagatggctgctatcttccctgggaagtagatagctggactctggttaaccagcaaacaagctggcttattcgcagtgccgcacatgccttcaacgaactggatgaacactggttacagcatcttgctaaccagtttccgccagagaatatgcgttgttatggtgtagcgcctcacggcgttgcagcggccaatccacttatccagcatcctgaaataccatcactgagtttgtattctgccgatattgcattccagcgctatgacatgctgcatggtgtttttcgtaaacagaaaactgtaagcaaatcgggaaaatggctcgcccgcctggcagtaagctgtctcgttctcgccattctttcttttgttggcagccggggcatcgcgttctggcaaacgcttaagattgaagatcaacttcagcaacaacagcaagaaacctggcaacgttatttcccgcagatcaaacacacccacaactttcgtttttactttaagcagcaactcgctcagcaatatcctgaagctgtaccgttgctctatcatttacaaacacttctgcttgaacaccctgaactgcagttaatggaggcgaactatagccagaggcaaaagtcgctgaccttaaaaatgagtgctaagagtgaagccaatatcgatcgtttctgtgagttaacacagtcctggcttccgatggaaaaaacagaaaaagatccggtcagtggtgtatggacagtaaggaactcagggaaatgattaaatcatggtgggcagaaaaatccacatcggaaaaacagatcgttgcggcattggcggttctctcgctcggcgttttttgttggcttgcggtgataaaaccgatagatacctacattgaagagcatcagtcccacgcgcaaaaaattaagaaggacatcaaatggatgcaggatcaagcgagcacccatggtttactcggtcatccagcgcttacgcagcccatcaaaaatatccttctcgaagaagcaaaacgtgagaatttgactatcacgctggaaaacggtccggacaatactctgacaattaaccctgtcacagctcccctcgaaaacgtctcccgctggctcactacggcacagataacatacggtattgttattgaagaccttcagtttactcttgccggaaacgaagagatcaccctcaagcatttgtccttcagggagcaacaataatgacaatgctactgccgctcttcattctggttggttttattgcaggttattttgttaatgtcatggcctatcacctctcgcctttggaggataaaacggcgttaacgtttcgccaggtattggttcatttctggcaaaaaaaatatgcctggcatgatacagtgcccctgatactttgcgttgctgctgctatcgcctgcgccctggcacctttcacgcccattgtgactggcgcactctttctctatttctgtttcgcactcacgctcagtgttattgattttcgcactcagctcctgcccgacaaactcaccttaccgctgctctggcttggcttggtatttaatgcgcagtctggattaattgatttacatgatgcggtttatggcgcggtcgctggctatggggtgctgtggtgtgtttactggggcgtctggttagtttgtcacaaagagggattgggctacggtgatttcaagctactggccgctgcaggcgcgtggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctgggatatctggcctggatctcttattaaccgggagggttctccctcccgacacggctcaaccttcttcgcgaatctgtgcttgcagataattttgcagtcccatcttctgaatcagatcaagttccgtttccagccagtcgatatggccttcttcatcgcgcaaaatttctatcatcatatcgcggctgacgtaatcatgaacgctatcggcataaccaattgcctcacgcaaattcttcgcgccatccagctcaagtgccagatcagaacgcagcatttcctcaacatcttcaccaatgttcagtttgcccaggtcctgtaagtttggaagaccttccagaaaaagaatgcgctcaatataacgatcggcgtgtttcatctcatcaatggattcatgatactccacatcattgagacgtttgagaccccagtttttaaacatccgggcatgaagaaagtactgattgattgcgacaagctcatttcccaacagtttgttgagataatttataactttagtatcacctttcattttttgactccttcgcttccactctttgaagcgtagaacggcttacgagtaagtcaaaaaacacactccgtttatgcggactccttaaactccggcagttgcattaattcatcctccatcacttcacgcgcggcccggacacatttaccgcactgattgccgaccggaatgaatttttttaattgctggaacgagtggggggaaaactgacgcacagcctgacgaatttttttatcgctgataccattacaaagacaaacgtacatagagactcccgtatacttttttcaaaaataaatgaaaatagttcttatttcaattacggaaagactcttttttaagcaaagaatagaaatatgaataaaaataatgggctaccaaaagtagcccattgacaaaaaatgcggcgataccggaaggtatcgccaacacatttattgcttagtaaacggcgcgaagatttcgctaaatgcgtacttcggtgcctgttctttagtcaggccgtggaattccggagacaggttagtgccgcctggcaggtcgcgcgcgattgaccagataccaaccataccgagattacgcttctgcgcatcctgcatgaccagacgagcatcagagagatagaacacctcgccctgaacgtcgttcacgccaaccatcggcgtggtacccatcatagcgtcaatttctgcatcgctcttgttgggatggaggcctttcaattgtgaatgcaggttggcaatcgcagacgttgcacacttaccgtgaatgttctggccttcggtatttgcagactgacaaatcgcgttaccgtagtccattgtcatcacgttcacacccgccagctcaacacctttcgctttggcatcgctcaggacattcatcccttccggcgtcaggcctgtcggcagaattggcaaggtataccagatagcaatatctttgccttctgacttccatttatcctgcactttcttcacagcaaggttacgacgttcaatagatgcctgatccgcaacccaggtgccttcgatatcgaagtccaggactctgaggttcaggttatcaacgatgtcataataatgctgcattagatcgtcaacgttcttacaggaagctgccagcggggcattattagcaccaccgatagacagcatcacatcaccgccagcctcacgcagagctttgattttgctgtactgagcgtaattctgcataccgtaagcggtaccccatgtcggtagacaggtgttcgcatctttactcaccacaaacgccagcgtgaagtggttgacgttatgactcttagccagcgcagccaaatccgggatcgtattcagcgtaaagtcgacatacggtgcataaacgtgtttcggccacgctttcttcggcgtacctacgcgctctttggttccggtccagtcaacaaaaacacgccacgggttgctgtcagaaggagaaactttctgcactttactctgagaaatgtagttctcaccgttaaagcgaatcagcgtatcactggcataaagcgtttctggattaaactgcggcgcattattcagctcttcgttgctatagctctgagtcttacctaacggcttccacgggcgactattgctaccggtggcgttttggttcgcaatcagagcagggttgtcactttgcgtccagaacagcgcttcataagcctgcccatcaacaacaacgcgatcacctttcacgtacacggtggaagcggaccatgctttcgccggttcgtatttcttccacgggttatcgccgccggggacaaagccccatgcgtcttgatcgacagaggttttataatgtgcatcgttataatctacgatgctgttcgcgctgtacgctttgctggcctggaaaccatccgcaataatgacgccgccattatcaatttcacaggtagtcgggttaccgtactgactcatttccgcagcggtagctgtacgcacgaggcgccatgggttattggagttttctacactggtgccacgcgggcaatcttcagaaccaacccaccaggcattctgataaacattaccattgaagataacatggtaaatttcgctgccttcctggccactccacgcctgcagtgagtaatcgttactgctatccgctggtgttgatggctcgttgttatccggagttggagtaactggagtttccggtgtttccggagttggatcaaccggagtcacagcaccgccattattatccggcttaacggaacaggaggctgggttaccatactgagtgatttctgttgccgttgccgcgcgaacataacgccatgggttgctggcatcgttttctttcgcatcgcctgggcaatttgccgcgcccacccaccaggcgttcttataaatgccgccgttgtagataacgtaccatgtagaagaaccttcctgacctttccaggctacgacagcatagttgtcgtttgacttatcagctggggctggctgaacatcaggagccggtttaacgtccggtgccggtttcacatccggtgcaggctgtggtgctgaagtacaagactgtggattactggtttctgagatttccgttgccgtagcggcacgaacataacgccatgggttgctggcatcattgcctttcgcatcacccgggcagttagaagaggctacccaccaagcatttttatataccgcaccattaaagacgacataccaggtttgaccgccctgctgtttattccaggcaactacagaagaattagacggaacagtgccctgtgctggtgtagccgaagcgccattagcgggcgtattagatgctggcgtatttgaagttgaagaagatgagcttccgctcttttcgcaggaaagtgtattgccaaactgactaatttcagcagctgttgcggtacgctttaaacgccacgggttagttgcatcatttgctttcgcttttcccgggcaatttgtagaagaaacccaccaggcattttcataaattttgccatcgaaaataacctgatatttattaccaccttgttggttattccatgcttccattgccaatgctggcagagcggaacacaccagccccataccaatcatagatttagtaaatatatttaatttcattataatcccttgtaacgtaaaaactgcaaaacaaaagtcctacgcaggaattatttacgttttacgagaacccttcaatatgaattaaagtgcggcatgaaaaataagaaaaaagcctgacaaatgaagcattttaaaaacagaaacattcatatttaaaatattaaattgaattgatattttaaatatgaataatttattcgttctgacagtacgaataagatatgcagtcaacaaatgcaaaaagggcgccgaagcgcccttttcaattcaaaactaattaacgtgtaattagcccagaactttagcaacaacgcccgcgccaacggtacggccgccttcacggattgcgaaacgcagaccatcgtccatcgcgatcgggtggatcagggtaacaaccattttgatgttgtcgcccggcattaccatctctacgccttccggcagttcgatggtaccagtcacgtcagtagtacggaagtagaactgcggacggtagcctttgaagaacggagtatgacgaccgccttcatctttggacagaatgtacacttcagattcgaacttggtgtgcggcttgatggtgcccggcttagccagtacctgaccacgttcgatttcttcacgtttgataccgcgcagcagaacacctacgttctcaccagcacggccttcgtccagcagtttgcggaacatttcaacgccagtacaggtagacttctgagtctctttgataccaacgatttcaacttcttcaccaactttgatgataccgcgttctacacgaccggtaacaacggtaccacgaccggagatggagaatacgtcttcgatcggcagcaggaacggcttgtcaatcgcacgctctggttccggaatgtaggaatccaggaagccagccagttccaggattttcgcttcccactctgcgtcgccttccagcgctttcagagcagaaccacgaacgatcggagtgtcgtcgcccgggaagtcgtactgagacagaagttcacgaacttccatttcaaccagttccagcagctcttcgtcatcaaccatgtcgcatttgttcaggaacacgatgatgtacggaacgcctacctgacgacccagcaggatgtgctcacgagtctgcggcatcgggccgtcagtcgcagcaactaccaggatcgcgccgtccatctgagcagcaccggtgatcatgtttttaacatagtcggcgtgccccgggcagtctacgtgcgcgtagtgacgggtcggggtgtcgtattcaacgtgagaagtgttgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatagtgtatgatgcgcgacctttggtcagagaacgcagctgagttgcatatccgaacatttcagacagcggtacttcagcgtggatcttaacgccagtaacttcagattcctgacctttgagcataccacgacgacggctcaagtcaccgataacgtcaccggtgttctcttcaggagtttctacttcaaccttcatgatcggctcaagcagaactggtttagctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgattgcagctgcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtacacacggaagaaggtcaggttaccaacaaacgggtcggtagcgattttgaacgccagtgcagagaacggctcgtcatcacttgcgtgacgctcagccggagtgtctttaccgtcgtccaggataccgttgatcgcaggtacgtcaaccggggatggcaggtaatcaattaccgcatccagcatcgcctgaacacctttgttcttgaacgcagaaccacaggttaccaggatgatttcgttgttcagaacgcgctgacgcagagcacctttgatttctgcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatacgcggaactttatatttgtttgcctgacgccatacggtttcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggattaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcagcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccaccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggagtgcttaaccgtaagtctgacgaaatcagtatagtcaatgggaatgatgtcgttcgaaattcgaccagtcaaaccgcgggcaataaggtcttcgttcagagcatagaccttaatgggggcattacgcagactttcaaggtagcggttgccgtcaactgcggcagttacgccatcttgcaataatagcagttcgtcaccttcactgagcagacgcagcagcgcagcaaagtccgtcagccagggtgaacgatgtaatgtgtgcagcataacgcctcaaaacctcaaaataacatcgtagttggcgagttcgcggcgtaaggcatctgcttcgagcggcgtggcttcgaccacaaaaggtgtctgcggatctaacccgcgttcgcgcagtgaagccgcacaaacccagcactgttcaatgtcatacagacccaacaatttaaaagtggcaatgtaatcacgcgccagcactgcatcgggcttttgtcctggcagcagctgaaaaacgccatcagcaataaagaagacggccagatcgtcagttaatgcggaagttgcgagtaaagcatctaatccctcgcggccagccgcggtgccatgaggcacagtagaaaaaacaaacgcaattcgtttcatcagaactgtaccaccctgtcacaggtcagcgaggcttccgccagcgcgccaagtccgcttaaggtaaatcccgtctgaaggtttgacgaagccagccccagtcttccggcttccgtttcatcaacaacgccacggcgtaatgccgccgctacgcagatattcagcgccacaccatgttgcatattcaactgttgccagctgcgcacaaggtcaaattcgtcgcttgccggtgaggtcaattggttagcgttatagaccccttcccgatagaaaaaaacgctgcttaactcatggccttctgctattagcgcctgcgcaaactgaaaagcactactcgcctgttgcgtaccgtatgctggcccggtcaccacgatggcaaaacgcattacttatcttgcccctggaaatcaccgctcttgaactggcggatgtagagatagacagtgtgtttggagatgttcaggcggtcagcaacctggttgatcgcgtctttaatatcgaagatccctttctcgtagagatttagcacgatctgacgatttttggcgttattagaaacattgcgatcggcattcacttcttcgatggtaaactccagcgtttgggtaaccagatcttcaacagaagaggcaaagttgacgcttgaaccgacatccggagtttccggcggcacaaaagtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcagtaattggcgaaccaatcttccggcctgtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcaaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcggttcttagtgcttattttttagcagagtctgcggctttcgcatcagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccgggataacaccgtccagacggaaagagagcggttcaccacgggtgtaagagttgtcgaactctttaccgtcgatcagcgtacctttgtagttcactacaacagtatcgctgtctttcggggcttcgcctttaccggcttctactacctgataaaccagaccagtggaagaggttttcacacctttctctttggcaaatttctcgcggtactctttaccttttgcttcgttatcagccgcgtctttttccatcttcgcctgagcagaagacttcacacgagcttcgaatgcttgcagagtctgttcgatctcttggtcggaaagtttgctcttatcagcaaatgcatcctgaacaccagcgatcagctgatctttatccagtttgatgcccagtttttcttgttctttaagagagttttccatgtaacgacccagcgaagcacccagtgcataagctgatttctgatcgtcatttttgaacgctgctttgctgtcagcagttgtagcaggttttgcagcttcagcagcaaaagtgattggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagttaaaagccagccagccgtcgaacatcgcgtcgcaggctgaagaaacgcctccgccacattattaaggcgtaaaaaaagcggggattccccgcttttttgtcaccttttcggtattagtggcaaccgcaaccgccgttgcctttaccgccacagcagccttcgccaccgtgttcatgaccgtgatcgtggccatgaccaccgcagcaaccgtcgtggtcgtgatcgtggtggtgatcgtgcgcgccgtgaacgtgaccatgagccagttcttcttcggtcgcttcgcgaatcgccacaacttcaacgttgaatttcaggttctgaccagccagcatgtggttaccatcaaccactacgtgatcgtcttcaaccgcagtgatttcaaccggtaccggaccctggtcggtttcagccaggaaacgcatacctacctgcagttcatcaacgcccataaatacgtctttaggaacgcgctgcaccaggttttcgtcgtactgaccgtaagcgtcgttcgcgccaacagcgacatcaaatttgtcgccaacttcatgaccttccagcgctgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccgatcacttgctcatctttgcggacgtgatcgcgggcttctttgtctgcttctcgcatctgatgtccacacttaacacattctacgatatcaatattattttcgcgccacatcgccattgaatcctgtgcctgacaggccgggcattttgcgcccgcaataaaacgttttcggattgccatctttaccctctactcaaattcatcccagccgtccagctggcgtcgttcttgttgcatttcacgctggaaaatctcttccagttcacgtcgggcttccctggcgcgagaaatttgtacggtatcagcatgcatcgggattaactcccgcagcattcgcatatccaggcggcgaaaatgcagttgcgcgcgctgcgcctgatgcggatgcatgccaagcgtgaccagcgtcttgcgccccagctctaacgcactggagaatgtttcacgggaaaactgcgtcacccctgcctgtaataactcatgcgcttccacacgtccgcgcgctcgcgcaagaatatgcaaatgcggaaagtgctgctggcatatttccaccagcttcatagtgtcttccggctcgttacaggtaatgacgatagactcagcggcctctgcacccgcagaacgtaaaagatctacctgcgtggcgtcgccgtaataaactttgtagccatatttgcgcatcaggttaacggcactgatatcccgctccagtacagtaatgcgcattttatttgccatcagcaaacgaccaatcacctgaccaaaacgcccaaagcccacgacaatgacctgcggtttatcatcgttgacccatggtttttcgtcttcttcttccggtccgttaaactggcgggatagccatttatcgaccagcttcatcagcagcggcgtggtcatcatggaaagcgtcaccgtcaccagcaacagcgccatctggtcgccctggaataagcgttgtgaagaagcggtagaaaagaggacaaaggcaaactcaccgccctgactcaacacgccagcaaactgcatccgctcagaactgcgcacgccatacaatcgcgccagcagatacagcacgagaattttcaccgccaccagcacaaccacacttatcactacccacaacagatgggtataaagcaccccgaggttgagcgacatgccgacagagataaagaacaaaccaagcagcaagcctttgaagggatcgatagccgtttccagttcatggcgatattcactttccgccagtagcacacccgcaataaacgtaccgagcgccatcgacaaccccagcgcatccataaacaatgcggaacccaacaccagcagcagcgtcgcggcggtgaacacttcccgcacaccagaagctgcaataaaacggaataccggacgcagtaaatagcgcccgccaatcagcatgccgacaaacgccagcaccttcatgccgatcttcatccagtcgaaatgttcgtctgccgaacccgccaacaacggcactaacgccagtgccgggatcaccgccagatcctgaaacagcagtaccgagaaacctaactggccggattcgctgcgattcatccctttctcacgcatcaattgcaacgccattgcagttgaagacatcgcaaggccaatgccaccgaccaccgccgcctgccatgagaaatgggtcagcatcaataatcctgccagcaacgccgcgcttaacagcacctgtgccgcgcctacgccaaaaatcgaacgccgcagttgccaaagcttggagggattcaactcaaggccgatgataaacatcaggaataccacgccgagttccgaaaagtggaggatctcatcgacgtcgctaataaaccccagcccccacgggccaatcgcaatccccgccagcaaatatcccaacactgcaccaatacccagccgcgatgccagcggcaccgcagccaccgccgcgaagagaaacagcactcctgcgagtaaaaaatcagaaccttccatcagcagcctcctggagacagcggatttgccagccagtcaccgtaggctctggcgtggctcgccagctcctgtgcgctttgccgtctcgcccagtaaataatgatggggcttaaccaatgcatccggcacatgcccgccgccagttcaaaggggcgcagaacatcgctcatcggatagcgattcaacgcgtcataacggtaagcactttccggctccccggtggtaatcacgctacgccagtactttcccgccagttggtttccccccggtccgctggcaaaaccacggcttaatacccggtccagccactctttcagtagcgccgggcagctataggtataaagaggatgctgaaagacaatcacctcgtgctcgcgcagtaatgcctgctcacgagggatatcaataaaaaagtcgggatagtgcgcgtaaaggtcgtgcacggtaacattgctgagctgcgtggccggtttaagcagaacccggtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcgccttatgattgttttttcctcgttacaaattcgtcgcggcgtgcgcatcctgctggataatgccaccgccaccatcaaccctgggcagaaagtcggcctggtgggtaaaaacggctgtggtaaatctactctgctggcattgctgaaaaatgaaatcagcgccgacggcggcagctacacctttccggtaagctggcaactggcgtgggtgaatcaggaaacaccggcgttaccgcaagcggcgctggaatatgtcattgacggcgaccgtgaatatcgtcaactggaagcgcagctacacgacgccaacgaacgtaacgacgggcacgccattgcgaccattcatggcaagctggatgctattgacgcatggagtattcgctcccgtgccgccagcctgctgcacggcctcggtttcagcaatgaacaactggagcgcccggtaagtgatttctccggtggctggcgtatgcgtcttaaccttgcccaggcgctgatttgccgttcagacttgctgctgctcgacgaaccgactaaccacctcgatctcgatgccgttatctggctggaaaaatggctgaagagctatcagggcacgctgatcctgatctctcacgatcgcgatttcctcgatccgatcgttgataaaattattcatatcgaacaacaaagcatgttcgagtacaccggcaactacagttcgtttgaagtacagcgcgccacccgtctggcgcagcaacaagcgatgtatgaaagccagcaggaacgcgtagcgcatctgcaaagttatatcgaccgtttccgtgccaaagccaccaaagcgaagcaggcccagagccgcattaagatgcttgagcgtatggagctgattgcccccgcgcacgtcgacaacccgttccgctttagcttccgcgcgccggaaagcctgccaaatccgttactgaagatggcaaaagtcagcgcaggctatggcgatcgcattattctcgactcgattaaactgaatctggtccccggctcgcgcattggtctgctaggccgcaacggcgcgggtaaatcgacattaatcaaactgttagccggcgaacttgcgccagtcagcggtgaaattggtctggcgaaagggatcaagctcggctacttcgcccagcatcaactggaatacctgcgcgccgacgaatcgcctattcaacatctggcacgtttagcgccgcaggagctggagcaaaaactgcgtgactacctcggcggctttggtttccagggcgataaagtaaccgaagaaacgcgccgcttctccggtggggaaaaagcccgcctggtgctggcattaattgtctggcagcgtccgaatctgctgctgctcgacgaaccgaccaaccaccttgacctcgacatgcgtcaggcactcaccgaagcattaatcgagttcgaaggcgcgctggttgtcgtctcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaacgcgaacagcgcccaggcacgtaaagatcagaagcgtcgggaagcggagctgcgtgcgcaaacccagccactgcgtaaagagattgcccgtctggaaaaagagatggagaagctgaacgcgcaactggcgcaggcggaagagaaactcggcgacagcgaactgtacgatcaaagccgtaaagcggagttgaccgcctgcctgcaacagcaagccagcgccaaatccggcctggaagagtgcgaaatggcatggctggaagcccaggagcagcttgagcagatgctgctggaaggccaaagcaactgatggcgcagataacaacgaccgatgccaatgaatttagcagcagtgctaaattcacccctatgcgcggctttagcaattgtcatctacaaaccatgctgccgcgtctgttccgtcgcaaggtgaaattcaccccgtactggcagcggctggagttgcccgacggcgattttgtcgatctcgcgtggagtgaagatcctgcacaggcgcggcataaaccgcgtttagtggtatttcacgggctggaaggcagtctcaatagcccttacgctcacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgagtttggtcatgcgccaacggctgccgtcggctattcgctcggcggtaatatgctggcctgtttgctggcaaaagaaggcaatgatctcccgattgatgcggcagtgattgtctctgcgccgtttatgctggaggcctgtagttaccatatggaaaagggcttttcccgcatttatcagcgttacttgctgaacctgttaaaagccaatgccgcgcgcaagctggcagcctaccccggaacactgccgattaatctcacgcagttaaaatcggtacgtcgcatccgtgaatttgacgatctcatcaccgccagaattcacggctacgctgacgctatcgactattatcgtcagtgtagcgccatgccgatgctcaatcggatagccaaaccgacactgattattcacgccaaagacgatccgtttatggatcatcaggtgatcccgaaaccggaaagtctccccccgcaggtggagtatcagctgactgaacatggcggtcatgttggctttattggcggtacattacttcatccgcaaatgtggctggagtcacgcattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtctccgacgtcaaacgccagctacagtgcggagaagcggtgctggtatggtcggagctgcacgaaacggtcaatatcatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagccgaggtggaaggcgacagttttcaccgttatacccgcccggaaatggacatggcgatccgcaaagcgcgcgacgccgggcggcatatcagctacttcggccccgaagcgaacgacttcggccttctggaacaaaccttcattgaatacggtcagagtggcaaagggaaatctcgcaaatatctgcatacctacgatgaagccgtaccgtggaatcaggtaccggggacattcaccccctggcaatctttaccggaacccactgatgtactgttttatgaaggtttacacggcggcgtagtcacgccacagcataacgttgcgcagcatgtggacttactggtcggcgtggtgcctatcgttaaccttgagtggattcaaaaactgatccgcgacaccagcgagcgcgggcactcacgagaagcagtgatggactcggtagtgcgttcaatggaagactatatcaactacatcacaccgcagttttcccgcacccatcttaacttccagcgcgttcccaccgtcgacacctcaaacccgttcgcggcaaaaggtatcccgtcgctggatgaaagctttgtggtgatccattttcgtaatctggaagggatcgatttcccctggctgctggcgatgttgcaaggctcattcatttcccacatcaatacgttagtggtgcctggcggcaaaatgggtctggcaatggaattaattatgctgccgctggtgcaacgattgatggaaggaaagaaaatcgagtaacgctgctattacgccggataaaatactatccggcttcacaacgggatagttaaatcacgcggcaaccacttcatacgagtgagtaatattcaccgctttttccagcatcagcgccactgaacaatatttctcggcagaaagatcaactgcacgcgcaaccgctgcgtctttcaggtcgcgaccggtgacgataaaatgcagattaatgtgcgtaaacaggcgtggtgcctcttcgcggcgctcagaggtcaattttacttcacaatcgaccacatcctgacgccctttttgcaggatagaaaccacatcgatggcactgcaaccacccgctgccatcaacaccatttccatcgggcttggtgctttatcgcctgagttgccgtccattaaaatctggtgaccagaggcggattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatatattgatgtactgcatgtatgcaaaggacgccacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtctgtctgcacagatggcgcgtcgtctgcaagtcacttcagagaaagtgggcaacctggcgttcctcgacgtgacgggccgcattgcacagactctgctgaatctggcaaaacaaccggatgctatgactcacccggacggtatgcaaatcaaaattacccgtcaggaaatcggtcagattgtcggctgttctcgtgaaaccgtgggacgcattctgaagatgctggaagatcagaacctgatctccgcacacggtaaaaccatcgtcgtttacggcactcgttaatcccgtcagagtggcgcgttacctggtagcgcgccattttgtttcccccgatgtggcgcagactgatttatcaccccgatatcaactatgcacttcgacaaacgctggtgctatgtttgcccgtggccgttgggttaatgcttggcgaattacgattcggcctgctcttctccctcgttcctgcctgttgcaatattgcgggccttgatacgcctcataaacgttttttcaaacgcttaatcattggtgcgtcgctgtttgccacctgtagcttgctgacacaggtgctactggcaaaagatgttcccctgccctttttgctgaccggattaacgctggtacttggcgtcactgctgaactggggccattgcacgcaaaattgcttcccgcatcgctgctcgctgccatttttaccctcagtctggcgggatacatgccggtctgggaaccgttgctcatctatgcgctgggcactttgtggtacggattgtttaactggttttggttctggatctggcgcgaacaaccgctacgcgagtcactaagtctgctgtaccgtgaactggcagattactgtgaagccaaatacagcctgcttacccagcacaccgaccctgataaagcgctgccgccgctgctggtgcgccagcaaaaagcggtcgatctaattacccagtgctatcagcaaatgcatatgctttccgcgcaaaataataccgattacaagcggatgctgcgtattttccaggaggcgctggatttgcaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccaacgcgttttacgatggaaaagcaaattggcgcactggaaaaaatcgcccgccaacacccggataatccggttgggcaattctgctactggcatttcagccgcattgctcgtgtgctgcgcacccaaaaaccgctctatgcccgtgacttactggccgataaacagcggcgaatgccattacttccggcgctgaaaagttatctgtcactaaagtctccagcgctacgcaatgccggacgactcagtgtgatgttaagcgttgccagcctgatgggcaccgcgcttcatctgccgaagtcgtactggatcctgatgacagtattgctggtgacgcaaaatggctatggcgcaacccgtctgaggattgtaaatcgctccgtgggaaccgtggtcgggttaatcattgcaggcgtgacgctacactttaaaattcccgaaggttacaccctgaccttgatgctgattaccaccctcgccagctacctgatattgcgcaaaaactacggctgggcgacggtcggttttactattaccgcagtgtataccctgcaactgttgtggctgaacggtgagcagtacatccttccgcgtcttatcgataccattattggttgtttaattgctttcggcggtactgtctggctgtggccgcagtggcagagcgggttattgcgtaagaacgcccatgacgctttagaagcctatcaggacgcgattcgcttgattctgagcgaggacccgcaacctacgccactggcctggcagcgaatgcgggtgaatcaggcgcataacactctgtataactcattgaatcaggcgatgcaggaaccggcgtttaacagccattatctggcagatatgaaactgtgggtaacgcacagccagttcattgttgagcatattaatgccatgaccacgctggcgcgggaacaccgggcattgccaccggaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacaacgggttattggtcatctgaacaccatgcacaccatttcgtcgatggcatggcggcagcgaccgcatcacgggatttggctgagtcgcaagttgcgggattcgaaggcgtaatacaggctaaaccatcggatgaggtgttcacgccgcatccgacatcttttgcctgatgcgtcttatttacgccccaatcaccttcgccaccgcgtgggcgaaacgatgcatcccttcatcgatatccgcatcttccaccaccagcgacggcgcaaaacgcatcacatcaggcccggcattcagcaccattacgccttcctctgcaccggcatacaggaaatcacgcgcccgacctttgtactgtggtttcagctctgcgccaatcaacagccccataccgcgaatatcgctaaacacatcgtactgctgatcgatcttctgcaaatggtcaacaaaacgctggcgtttcgcctgaataccttccagcacttcaggggtattgatgatatcaaacgccgcgcccgctactgcacaggccagaggattaccgccgtaggtggaaccgtgagaaccaggatgaaacgcggaagcaatctccgccgtggtcagcatggcgctaaccgggaagccgccacctagcgctttcgcagaggtcagaatatccggcgtcacgccgtagtgcatataagcaaacagatcgccggtccgccccatcccgcactgcacttcatcaaacaccaataatgcctgatgctgatcacacagctcgcgcaagccctgcaaaaactctggcgtcgctgccgtcacgccgccctcgccctgaatcggctcaaccaccaccgcacaggtatggtcatccatcacggcttttactgcgtgaagatcgttaaaaggcacgtggatgatgtctgccggttttggcccaaagccgtcggaatattttggctgcccacccaccgaaacggtaaacagcgagcgaccatgaaaagcgttatggaaggcaataattttggttttgaacgggctatgacgcacacaggcgtaatggcgtgccagtttaaaggcggtttcgttagcttccgtgccggagttcataaacaccacgcgttcggcaaacgttgcctcaatcagtttacggccaagacgcagcgccggctcattggtgaaaacgttactaatatgccacagagtttcgccctgggtttttaacgcgttcaccagcgcaggatggcaatggcccaacgccgtaactgcaatgccacccgcgaaatcgacatactccttgccctgttgatcccagattcggctgccctgaccttttaccggaataaactctgccggagcataaatcggcagaatcacttcatcgaaagtcgcgcgtgtaattgctgtttgttcaattgccatctcatgatcaccctgttacgcataaataaatatgaaattataatcacaaaatatgcataaaaaatcactgaatggcaatcagaaatcagcgatgcagaaaattagccagcagttgatgtccttgttcgctaagaatactttctggatggaattgcacaccttccagatcccactggcgatggcgaatccccataatctcgcgggtttcgctccaggccgtcacttcaaagcactccggtaatgagtcaggttccaccaccagcgaatggtagcgtgtcacggtgagtggatttgccagccccttaaatacgcccacaccattatgtgtaatcggcgaggttttgccgtgcatgacctttgcggcgcgcacaactttgccgccaaatgcctgcgccattgcctgatgaccgaggcagacgccaagaatcggcaagcgtccggcatagtgacgaataacgtcaagggagatcccggcttcatctggcgtacaggggccgggtgagatgacaattttttgtggtttaagggcgtcgatatccgccaacgtcaacgcatcgttgcgcttaaccaacacatccgcccccagttcacaaaagtactggtagaggttccaggtaaaagaatcgtagttatcaataagcaggatcatggcggctccggtacgaaagaaccgcgctattttactcagattccccggcttcgcttaccactttgctaaatatcatctgcagcgcggtgagatcccccattgccccattctgatttgcctgattccaggcctctttttcgataccctgccagctcagttgatatccggcatgaatcgccagttgctcgaagaagatccgctgtgccaaaccacttcccacccggaagggatgcagcacgttgatttcacaatagtaatgcgccagccgctcgacgaatttatctttctcaaggctagtcagatacttctcttcctccaaatcctgcatcagggcattgccctctttttcgagataggcaaagtggcagaacggcgtatctccctgataaatatcgacttcgcgcagttgccccgcccagtcgaaaatatcctgatacaactggcgatgaagagtacgcaaatgcggtaaaccccgaaccaacgggccaagttcaatggtcgcagcacgcagcgccgtcatttcgtaagcggcctgttccagccgctgctgctggcggatgttcagccggttacgcatgatatcaaggcctggataaagatacggatcgcgcccttcgccgaatttatcgctcatagtgcctcctcagcgcttcaaggcgcgctaaagcctctgcggcagtaagagtgactaaaggcatctcgacgccttcaagacggcgactggcctggaaattacgattacgctgaagctcccagagacgggacttttgcttatcggtgagtttcttcacttgatgcctccctgaacgtgtccatt

SEQ ID NO: 9992 - DNA, 41353 bp, Escherichia coli
tactgaatgggtggatattgtcaatgaagagaacgaagtcattgcacaagccagccgggaacaaatgcgggcacagtgtctgcgtcatcgtgcaacttatatcgtcgtgcatgatggcatgggcaaaattctggtccagcgtcgtaccgagacaaaagactttttacccggcatgttagatgcgaccgcaggcggtgtagtccaggccgatgagcagctgctggaatccgcgcgtcgcgaagcggaagaagagttgggcattgccggtgtcccctttgccgagcacgggcagttctatttcgaagataaaaattgccgtgtctggggcgcgttgttcagctgcgtctctcacggtcccttcgctctacaggaagatgaagtcagtgaagtttgctggctgacgccggaagaaatcaccgcacgctgcgatgagttcactccagactcgctgaaagcgctggcgttgtggatgaagcgcaatgccaaaaatgaagccgtagagactgaaacggcagaatgaaaaaagagccgcaatcgcggctcttaacatttttagtggtagcccatcaactgagcgccgatcaccacgacgctggacataataaacagcagtccaagcagggtcgcacccaccttcagccagttacggaagtccacccggcaaacaccgagcgtcgccattaacgaagctgaggttgggtaaatgatgtggctgaagccatcaccaaactggaacgccagcacggtaacctgacggttaacaccgaccagatcgccaagcggtgccagtaacggcatggttaacgccgcctgaccagaaccggacgtcacgaagaaattaaataccgcctggaagagcaacataaaccaggccgcgactgcgttatccagaccgctaatggcattggcaatgctgttgaggatggtatttaacacgctggcatcacccgcttcaccattaccgaccagcagcaaaatccctttggcgaaacccaccagcagggcaggggcgatcatcattcgcgccccttcggtaaaggatgaagccatggtattaaccgtcatgccgttaaggcggaaaacaacgccgatgatgccaatcaccagacccatggtgaagaactggctggcaatttcaggaataaaccaggcattaacgatcacgccccaaataacccagaccattacggcggtcaggacaatcaataccagccagtcaccaaaggtaaacggacgttgttcaacatcagcctgcttttcacgaaagaagcggtcggactcatgcacgcgtgacagaagaggattctttttcactcgtgaggcgtacaccatggtaaagatcaggccaatcagagtggcgataacccacaccacgatgcgcaacccggagccagaaagcaccggaacgccggcaataccctgagcaacaaccacacaaaacgggttcatccacgaactggcaaaaccgatttgcgtggcaatataggtcacaaggacggtggtaatactgtcatagcccagccggaccattagcggtgcgatgataatggcaaaggcgacggcctcttctcccataccaaatattgcgccgccaagtgaaaacagaataaacagcgcaggaataaagagaatttcatttccgcgggtatggcgaataagcgccaggataccgttatcaatggttcctgtacgcatcacaatgccaaacgcgccgccaatcaccagcataaacatgatgatgccaacggctgtcccgtatttcgatcctgaggttaacccttcaaacgggaagttcatcagacccgggcgttcatcgcccgtcgtgaacagctgtacgcggtgatactcaggttcgcctgcttcgttagtcagaatgcgaaatgagtgtggatctacgactttgcgtgtttttgtttgaccatcaacctgatactgcacttcctgactgtcaaacatgcccaccggaactacccaggtggcaaggctggttaaaatggcaacaaaaaagataatcaccaacgtatcgggcattgcccatcttcttgttggtttagattcagtgattgcggacatagcgcaaatattcccttgcacaaaacaaagtggtaagtatgcaaagtgagatggcgcaattcattgatgcagcgcagttaagcaagataatcagaaaggattaatgcaaattaatagaataaaaaaccggaaatagtgactatttccggttcagatatccgcagcgcaaagctgcggatgatgacgagattactgctgctgtgcagactgaatcgcagtcagcgcgatggtgtagacgatatcatcaaccagtgcgccacgggacaggtcgttaaccggcttgcgcataccctgcagcatcggtccgatagagatcaggtcagcagaacgctgtaccgctttgtaggtggtgttaccggtgttcagatccgggaagatgaacacggtagcgcgacctgcaaccggagagttcggtgctttggatttcgcaacgtcagccattaccgcagcgtcgtactgcagcggaccgtcgatcatcagatcaggacgtttttcctgcgccagacgagttgcttcgcgaactttttctacgtcgctaccagcaccagaagtaccggtggagtaggagagcatagcaacgcgcggttcgataccgaaggccgcagcggaatcagcggactgaatcgcgatttctgccagctgttctgcggtcggatccgggttgatcgcacagtcaccgtaaacgtaaacctgttccggcaacagcatgaagaacacggaagataccagggagctgcccggtgcagttttgatcagctgcagcggcggacggatggtgtttgcggtggtgtgaacagcaccggaaaccagaccatcaacttcatcttgttccagcatcagcgtaccgagaaccacgttgtcttccagctgttcgcgggcaacggtttcggtcatgcctttgttcttacgcagttcgaccagacgaccaacatagttttcgcgaaccacttctggatcaacgatttcaatgcctgcacccagttctacaccctgagaggctgcaacacggttgatctctgctggattacccagcagtacgcaagttgcgataccacgttcagcacagatagcggctgctttaacggtacgcggttcgtcaccttccggcagaacgatacgtttgcccgctttgcgcgcaagttcggtcagctgataacggaacgctggcggagacagacgacggctgcgctcagaagtggcagtcagagaatcgatccagtcagcgttgatgtagttagcaacgtattcctgaactttctcgatacgctcgtgatcgtcaaccggaacttccaggttgaagctctgcaggctcagagaagtctgccaggtgttggtgttcaccataaataccggcaggccggtagcgaaagcacgttcgcacagtttagaaatgcgcgcgtccatttcgtagccgccagtcagcagcagggcaccgatttctacgccgttcatggcagccaggcacgcggcaaccagcacgtcagggcggtctgcggaagtcaccagcagagaaccggcacggaagtgctccagcatgtgcggaatgctgcgtgcgcagaaagtgacggatttaacgcggcgagtattgatgtcgccttcgttgatgatggtcgcattcaggtggcgagccatatcgatcgcacgagtcgcgatcaggtcaaagctccacggcacagcgccgagaaccggcagagggctggattcttgcagcttcgccggatcaacgttgttcacttttgctttggtggagtcgtcaaaaatctcggacagatccgggcgagtacgaccctgctcatcaaccggagcgttcagtttgttaacgataacgccggtaatattggtgttttttgcaccgccgaagctgttgcgggtcagttcgatacgctctttcagctgttccggggtgtcagtgccctgagacataacgaagacgatttccgcattcagcgttttagcgatttcgtagttcagagactgggcaaactggtgtttacgtgtcgggaccagaccttcaaccagaacgacttcagcgtctttggtgttagcgtggtagttcgcgatgatctcttccatcagcacatctttctgattgctggaaagcagaccttcaacgtagctcattttcagcggttcagcggccgtcgtggtggaagagttcgcacgcacgatagtcgtagtctgatcgggcgcatcgccaccggtacgcggctgagcgataggtttgaaaacgctcagacgaacgcctttgcgttccattgcacggatcacgccaaggctgacgctggtcagaccgacgctggttccggtagggatcagcataataatacgggacacggtttatcctctttcgttaccgccgatttggcgggttacaaaacagcaccgccagctgagctggcggtgtgaaatcaggcagtcaggcggctcgcgtcttgcgcgataaccagttcttcgttggttgggataaccaccgcaggacgggtaccttctttgttgatgaaaccagatttgccgaaacgtgcagccaggttgcgttcatgatcaacttcaaagcccagcacgcccagtttgcccagagacagttcacgaaccatcgcggcattttcaccgataccaccggtgaatacaacagcgtccagacgaccatccatcagcgcagtgtaggcaccgatgtatttggccaggcggtggcagtaaacgtccattgcgcgcttcgcgtcttctttcgtcgcgtagttgtcttcaacatagcggcagtcgctggtcacttcggtcagacccagcaggccagactctttggtcagcagtttgttgattgcgtcaacgctcatgcccagggtgtcgtgcaggtggaagatgatcgccggatcgatatcaccagaacgggtacccatgaccagaccttccagcggggtcaggcccatagaggtgtcaacgcatttaccgttgcggatagcagaaacggaaccaccgttgcccaggtggcaggtgatgatgttcagttcttctaccggtttgttcagcatttttgccgcttcctgggttacatagaagtggctggtgccgtgcgcgccgtaacgacggatgccgtgctctttgtacaggttgtacggcagggcgtagaggtaagactcttccggcatagtctggtggaacgcggtgtcaaatacagcaacgtttttgtctttcagctgtgggaaagatttcagagcttcttcgataccgatcaggtgagccgggttgtgcagcggtgcaaaagaagctgcatctttgataccctgaataacagactcatcgatcactacggagctggtatacttttcgccgccgtgtacgatacggtgaccgatagcagtcagctgcgcagacagttctggtttttgtgccagaatagtattaacgataaagttgagcgcttcgctgtgagcggcgcctgcacctaaagccgcttcctgtttattgccgtccattttccatttgatacgtgcttcgggcaggtggaaacattcggctaaaccagaaaggtactcttcaccatttactgcatcgatgatggcaaatttcagtgaagaactaccgcagttcagaaccagtactaacttactcgacatggaagtacctataattgatacgtggctaaaaaaacgtcagggagccatagagcgtagcgcatgatgacaccgacatttatgattaacatcatgcactgcaaattttttttgcatgatggaagaaatatcttgagtctatgccattttgcgtaattttcagccaatggcataatgtatatgaatttgacgactcaatgaatatgtactacttaggccttcaggctgctaaaggatacctgatagtgggtatggaagacaaaatgttttgaacgttgtcccgctgagttgtgaatttgcacaaatttttgaatctttatatgtgaagttgaggtgaagcatgtcaacgccggataatcgttctgttaatttttttagcttgtttcgccggggacagcattactcaaagacgtggccgctggaaaaacgccttgccccagtctttgtcgaaaatcgcgttatcaagatgacgtgttatgcgatccgttttatgccgccgatcgccgtatttactctctgctggcagattgccctgggcggtcagcttgggccggcagttgccactgcgctgttcgccttaagtttacccatgcagggattgtggtggctgggcaagcgttctgtaacgccattacctcctgcaatcctcaactggttttatgacgttcgcggtaaattgcaggagtctggacaggtgttggcacccgttgaaggcaagcctgattaccaggcattagctgacacgcttaagcgtgccttcaaacaactggataaaactttccttgatgatttgtaattgacccctgattacgcatataaaagaaggcatactcagccttcttttttttcaccgtagtagagtgatacaggagtcaataatggaaatgaccaacgcgcaacgtcttattttgtctaaccagtacaagatgatgactatgctcgatccggcaaatgctgaacgttaccgtcgcctgcaaacaatcattgagcgtggttatggattacagatgcgtgaactggatcgcgagtttggcgagctgaaagaagaaacctgccgcactatcatcgacattatggagatgtatcatgcgttgcatgtttcctggtctaatttgcaggaccagcaatccatcgatgaacgtcgtgtcaccttcctcggctttgacgccgccactgaagcacgttacctcggttatgtccgctttatggttaatgtggaagggcgctatacccattttgacgctggaactcacggttttaacgcccaaacgccaatgtgggaaaaatatcagcgcatgcttaatgtgtggcatgcctgcccgcgtcagtaccatttgagcgccaacgaaattaatcaaattattaacgcctgaggaggcccgcgtgcggtgcaaaggttttctgtttgatcttgatggaacgctggtggattccctgcctgcggtagaacgggcgtggagcaactgggccagacgtcatgggttatcgccggaagaggtgctggctttcattcacggtaaacaggcgatcacctctctgcgccattttatggcgggcaaatccgaggcagacattgccgccgagtttacgcgtctggagcacatcgaggccacggaaaccgaaggtattaccgcgcttccgggggcaatcgccttactcaatcatttgaataaagcaggtattccgtgggctattgtgacttctggctccatgccggtagcgcgagcgcgtcataaaatagcggggcttcccgcgccagaggtgtttgtaaccgctgagcgggtgaagcgcggaaaaccagaacctgatgcgtatctgttaggcgcgcagctgctggggcttgcgccgcaggagtgtgttgtggtggaagatgctcccgctggcgtgctttcaggtctggcggcgggttgccatgttattgcggttaatgccccggcagataccccgcgcctgaatgaagtcgatttagtcctccacagtctggagcaaattactgtgaccaaacagccaaatggcgatgttattattcagtgaaacacctgatcatgatttagccccgtctcgtcggggcttttttatggcagaatcaagttatccccctcaattaacaaggataagttgtgaacggtgaattgatttgggttctttcattactggccgttgccatcgtcttgtttgcgacgggcagagtgcgtatggatgcggtcgctttgtttgttattgtcgcgtttgcattaagcggaacgctgacggtccccgaagtattttccggcttttccgatcctaacgttgtcctgattgccgccttgtttattattggcgatggtttggtccgtaccggtgttgccactgtaatggggacatggctggtcaaagtggcgggcaacagtgaaatcaaaatgttggttttgttgatgctgaccgtcgcggggcttggcgcgtttatgagttcaaccggcgttgtcgctatctttattcccgtggtgttaagcgttgccatgcgtatgcaaacgtcgccgtcgcgcctgatgatgccgttaagttttgccgggctgataagcggcatgatgacgctggtggcgacgccgccgaacctggtagtcaacagtgaattgctgcgtgaaggctatcatggttttagtttctttagcgtaacacctattggcctggtcgtgctggtgctgggtattttgtatatgttagtgatgcgtttcatgctgaaaggggatacccagaccccgcagcgcgaaggctggacgcgccgaacctttcgcgatcttatccgtgaatatcgactgaccgggcgtgcgcgacgtctggctattcgccccggatcgccaatgattggtcaacggctggacgatctcaaattacgtgaacgttatggtgctaacgtcatcggtgttgaacgctggcggcgttttcgtcgcgttatcgtgaacgttaatggggtttctgaatttcgcgcgcgtgacgttttgcttattgatatgtctgcggctgatgtcgatctccggcaattttgtagtgagcaattgctggagccgatggtactgcgcggcgagtatttttctgaccaggcccttgatgtgggcatggcagagatttcattaattcctgagtcagaacttattggtaaatcggtgcgcgaaattggttttcgtacccgctacggattgaatgtagtggggctaaagcgcaatggcgtggcgctggaaggttcgctggcggatgagcctctgctgctgggcgatatcatcctggttgtgggtaactggaaactgatcggtatgctggccaaacagggccgcgacttcgtagcgctgaacttaccggaagaggtgagtgaagcatcgcccgcgcacagccaggcaccccatgcgattttctgtctggtgctaatggtggcgttaatgctgaccgatgaaattcctaatcctgttgccgctattatcgcctgcctgctgatggggaaattccgctgtatagatgctgaaagcgcctataaatccattcactggccgagcattattttgatcgttgggatgatgccatttgctgtggcattacagaaaacgggaggtgtcgcgctggcggtgaaagggctgatggacattggcggcggttacgggccacatatgatgctgggttgtttgtttgtcttgtcagcggttattgggctatttatctctaataccgcgacggcggtgttgatggctccgattgcgctggctgctgccaaaacgatgggtgtgtcgccttatccatttgcgatggtcgtggcgatggcagcatccgccgcctttatgacgccggtttcttcaccggttaacacactggttttaggtccgggaaattacagcttcagtgactttgtgaagttgggggtaccgttcaccattatcgtgatggcggtttgtgtggtgatgatcccgatgctgtttccgttttgacaagagcctgatgtcgcatccggcgcttattgcctgatgcgacgcagactccgactgcttacagcggtgaatcctggctaatctcatcgagcgaaagatggaagctgggaacaaatacttccatgaagtagtccatctcctggctgcggcgcgcttcaagcgtcgcttccagtcgcgtttttgccagcaagaattcattatttccggccgcaagttcttccaggcatttcagatatgcacacagtgcatctgcctgtttcaccagcgatttttcttcatcgctatatgcatgctcgtcaattaacggcgcaaagatatcctgcagctcttccggaaccatatcgaccagtttttgctgagcgattttttcaatagccttgtattcctgagcgatttgcgaattgaagtatttcaccggagtagggagatctccggtgagcacttctgaagcatcgtggtacatcgccagtaaagcgatacgttcggcgttgacattaccgccaaatttacgatttttgatagctgccagcgcatgggcgaccatcgctacctgcaaactgtgttcggacacattttccgtccgcacgttgcgcattagcggccagcggttaatgagtttcaggcgggagagatgggcaaaaaaatggctctgtttcatagtgaccttacgtatgatgacatcatcaggtcattgtggcgggataacactgccggatgcaatctccggcagtgaaattaagattacagctgatgataaccagaaaggaaacgcgcgaacttgctcaaagacagctcgatatcatcgacacgcggtagcgtgacaatgcggaagtgatccggccacggccagttgaatgccgtcccttgcaccaacaggactttttcctgcaacaggaaatccagcaccattttctgatcgtcgtgaatgttaaagcgtttggcgtcgattttcgggaacatatacagcgcaccacgaggtttcacgcaggaaacgcccggaatatcgttgatcaattcccacgcgcggttacgctgctcataaagacgaccgccaggggtaataaattcactgatgctctgataaccacccagtgcggtctgaatggcgtgttgcgcaggaacgttagcacacaggcgcattgaagccagcatttccagaccttcgatgtaacctttggcgtgttttttcggcccgttcaacaccatccacccctgacggaagcctgcaacgcggtacgttttcgacagtccgttaaaggtaatggtcagcaggtcaggtgccagcggcgcaatggagtgatgctcagcgtcgtcgtagagaattttgtcataaatttcatcggcgaagataatgagattatgctgacgtgcaatctccacaatctccattaaaagctctttggaatataccgcgccggttgggttatttgggttgataataacgatcccacgcgtacgaggcgtaattttagcgcgaatatcatcgaggtctgggaaccagtcagaggattcatcgcaaagataatgcaccgctttaccgctggagagcgaaaccgctgcggtccatagtgggtaatcaggtgcaggaaccaacatttcgtccccgctgttcagcaatgcctgcattgcctgaacgataagctccgatacaccattgccgatgtaaatatcttccacggtaacatcacgcatgccacgagcctggtagtgctgcatgatggctttacgcgcggagtaaagacctttggaatcgcaatacccttgagcggtaggcaggttgcgtatcacgtcaacgagaatttcatctggcgcgtcaaaaccgaacggggcagggttgccgatgttcagtttcagtaccttgttaccttcttcttccaggcgttttgcttctttcagcaccggaccacggatgtcataacagacattctctaatttgctggatttttcaatgggggacatgaatcttgaccttttttgctgttatcgccactccctgccgtggaagtcagcttagaacaatgtactcccccaggacggtgttttgaaggtctgcagaataagattttgccagaggggaaggctcgattgtgctgttaataacttaataatggcaaaataatgaggtgcatatgcttaataagtaatgttatgtagtgaattgttctgattcttaattgtaagtgtggtttttttatctgtaagataattgtgtgaaaatgcctcgtttaagaattcactactgaatcgcgatgatgatatttccgcattacggagagtttaacagcgtgatgatttccgaggtgtcacaatgggggcaaggcgtgaaactattgttaagcggaattaatgaatggggatgatgctaattaattattatttaatattcaaaaaggttttgttgtgcttattaataatagaagattactttgcctaacataacataactttgcatcagataattcgcaatgacccttataaataaaaggtttttggggtaaaatgcttgcataaatgacggatccctgctcttgatgccgcctcaccattgctgtttgtacgtgttcgcgtatgaccagcgatgctgtacgagagtggaacaaggactcacatttacatttatacaaacacgcgcatgtcataaatagaaaagagtgagtaacttaatagatatgcgatccctgaagatatattctgtgatctacttcaggcattataacggaacaatgtgagtcacttttttagtgcaactcatatgcatttttactttcgtccgggttccggatgaaactgccagggaggcacattacaaatggaattgcttgtttgtgtgtgcacagcattaaccagctcagtatgagccgccagtaagtgataatatatgataagtgcaaatcgtccgataattaacctcgacctcgatctgctgagaacatttgttgctgttgccgatctgaacacttttgctgccgcagctgccgctgtgtgtcgtactcagtccgccgtaagtcagcaaatgcagcgtctggaacaactcgttgggaaagaactgttcgctcgtcacggtcgcaacaaactgttaactgaacatggcattcaacttcttggttacgccaggaaaatcctgcgttttaatgatgaggcctgctcatcattaatgttcagtaatcttcagggcgtgttaactatcggtgcttcagatgaatctgccgatacgatcttacctttcctgttaaatcgcgtgagttcggtttatccgaaactagcgctggatgtccgcgttaaacgtaatgcctacatggcagaaatgctggaatcccaggaagtggatttgatggtaaccacccatcgtccttctacctttaaggcattgaacctgcgtacctcgccaacacactggtactgcgcagcggaatacgtattgcaaaaaggtgagccgatccctcttgtgttgctggatgatccaagtccgtttcgcgatatggtgctggcgacgcttaataaagcagatattccctggcgactggcttatgtcgcctcgacgcttccggccgttcgtgcggcagtgaaagccggtcttggcgtgacggcaaggccggtcgagatgatgagtccggacctgcgtgtgctgagtggagtagatggcttaccgccgctacctgataccgaatatttgctgtgctatgacccgtccagtaataatgagctggcccaggtgatctatcaggcgatggagagctaccataatccgtggcaatacagcccaatgtctgctccggaaggagatgactcattgttgattgaaagggatatcgagtaatcgacggacgatagataattcctgagacaatagtgtaaaaacgaaccgctgggtttattttaaaccccagcggcttttttttagtaaaaagctttcctcgtatcgtgcagaacgcacaaaactgttcatttttcaatcaccagagattcacgccccgtacgcacaaataatcacctgaaaaaaatctcctgctacaataatgttaaaaaatacgtgaatttgttgctgcatttttgttatagaatgacaaaagcgtgtcacagatcaagaaaatactctcttttggggggaggaatcgacacaaattcctgtcaaaatagacccgtattttttccattgcttcacaacggacacgattcaacaacatctaattttcctggagtcgtcaatgatctggggagaaagggcgccaaatgcaaatgttgttgtcattgtgtaaatcagtgtgaagaaacctttgttaaagttgacaaaaggttatagaaaggagtaaaagaccacatcaattagctgtataaaatagtttctgcagttattgtaaggttttttttattcctccccatgaatcgatgtggcgtccatctgccgtaaagagcagagaatcaggcgctacttttgatgagtaagcaatgagtatgtcaacatccactgaagtcatcgctcatcactgggcattcgctatctttcttatcgttgccattggcctgtgttgcctgatgctggtaggcggttggtttttaggcggtcgcgcacgcgcgaggtcaaaaaacgttccgtttgaatccggtatcgactcggtcggctccgcccgcttacgcctgtccgccaagttttatctggtggccatgttcttcgttatcttcgacgttgaagcgctgtatctgttcgcatggtcaacctctatccgcgaaagcggctgggtaggctttgtggaagctgcaatttttatttttgtgttactggcaggtctggtttatctggtgcgtattggcgcgctggactggacgcccgcgcgttcacgccgcgagcgtatgaacccggaaacgaacagtatcgctaatcgtcaacgctaaccgcgaggcattaagatggattatacgctcacccgcatagatcccaacggtgagaatgaccgttaccccctgcaaaagcaggagatcgtaaccgaccctctggagcaagaagttaacaaaaacgtgtttatgggcaagctcaatgacatggttaactggggtcgtaaaaactcaatttggccgtataacttcggtctttcctgctgttacgttgagatggtgacttcgtttaccgcggtgcatgacgtggcgcgttttggcgctgaagtattgcgtgcttcgccgcgtcaggctgacctgatggtggttgcaggaacctgctttaccaaaatggcaccggttattcagcgtttgtatgaccagatgctggaaccaaaatgggttatctcaatgggtgcctgtgccaactccggcggtatgtacgatatttattccgttgtgcagggcgttgataaattcatcccggttgatgtgtatatcccgggctgtccgccgcgtcctgaagcgtacatgcaggcactgatgctgttgcaggaatctatcggtaaagaacgtcgtccgctctcctgggtggttggcgatcagggcgtttatcgcgccaatatgcaatcagagcgcgaacgcaagcgcggtgaacgcattgccgttaccaacctgcgtacacctgacgagatttaatttgcgcctgtcggcaaagggaattttcttcgcttattcctaaatctatttcgcgaagcttactgcgccgacagtcaccacggaccatttgcaatggtgaacaatatgaccgacttaaccgcgcaagaacccgcctggcagacccgcgatcatcttgatgatccggtgattggcgaactgcgcaaccgttttgggccggatgcctttactgttcaggcgactcgcaccggggttcccgttgtgtggatcaagcgtgaacaattactggaagtgggcgatttcttaaagaaactgccgaaaccttacgtcatgctgtttgacttacacggcatggacgaacgtctgcgcacacaccgcgaagggttacctgccgcggatttttccgttttctaccatctgatttctatcgatcgtaaccgcgacatcatgctgaaggtggcgctggcagaaaacgacctgcacgtaccgacctttaccaaattattcccgaacgctaactggtatgagcgtgaaacctgggatctatttggcattacattcgacggtcacccgaacctgcgccgcatcatgatgccgcaaacctggaaaggtcacccgctgcgtaaagattacccggcgcgcgctaccgaattctcgccgtttgagctgaccaaagccaaacaggatctggagatggaagccctgaccttcaaaccggaagagtgggggatgaagcgcggcaccgaaaatgaggacttcatgttcctcaacctcggtccgaaccacccgtctgcgcacggtgctttccgtatcgttttgcagcttgatggcgaagagattgtcgactgcgtaccagacatcggttaccaccaccgtggtgcggagaaaatgggcgaacgccagtcctggcacagctacattccgtataccgaccgtatcgaatacctcggcggctgcgttaacgaaatgccttatgtgctggcggtagagaaactggctgggatcaccgtgccggatcgcgttaacgtcattcgcgtaatgctctccgaactgttccgcatcaacagtcacctgctgtatatctccacctttattcaggacgtcggcgcgatgacgccagtgttcttcgcctttaccgatcgtcagaaaatttacgatctggtggaagcaatcactggttttcgtatgcacccggcgtggttccgtattggcggcgtagcgcacgacctgccgcgcggctgggatcgcctgctgcgtgagttcctcgactggatgccgaaacgtctggcgtcttacgagaaagcggcgctgcaaaacaccattctgaaaggtcgttcccagggcgttgccgcttacggcgcgaaagaggcgctggagtggggcaccaccggcgcgggcctgcgtgccaccgggatcgacttcgacgtgcgtaaggcgcgtccttattctggctatgaaaacttcgacttcgaaattccggtgggcggtggtgtttctgactgctacacccgcgtaatgctgaaagtagaagagttgcgccagagtctgcgtattcttgagcagtgcctcaacaacatgccggaaggcccgttcaaagcggatcacccgctgaccacgccgccgccgaaagagcgcacgctgcaacatatcgaaaccctgatcacccacttcctgcaagtgtcgtggggtccggtgatgcctgccaatgaatccttccagatggttgaggcgaccaaggggatcaacagttactacctgaccagcgacggcagcaccatgagttatcgcacccgtatccgtacgccgagttatgcgcatttgcagcaaattccggcggcgatccgcggcagcctggtgtctgacctgattgtttatctgggcagtatcgattttgttatgtcagatgtggaccgctaattatgcacgagaatcaacaaccacaaaccgaggcttttgagctgagtgcggcagagcgtgaagcgattgagcacgagatgcaccactacgaagacccgcgtgcggcgtccattgaagcgctgaaaatcgttcagaagcagcgtggctgggtgccggatggcgcgatccacgcgatcgccgatgtgctgggtattccggcgagcgacgtcgaaggcgtggcaacgttttatagccagatcttccgtcagccagtaggccgccatgtgatccgttattgcgacagcgtggtctgtcacatcaacggttaccagggtattcaggcggcgctggagaaaaaactgaacatcaaaccagggcaaacgacatttgacggtcgcttcacgctgctgccaacttgctgcctggggaactgtgataaagggccaaacatgatgatcgatgaggacactcacgcgcatctgaccccggaagcgatccctgaactgctggagcggtataaatgaaaaacattatccgtactcccgaaacgcatccgctgacctggcgtctgcgcgatgacaaacagccagtgtggctggacgaatatcgcagcaaaaacggttacgaaggcgcgcgtaaggcgctgaccgggttgtctccggacgaaatcgttaatcaggtaaaagactctggtctgaaagggcgcggtggcgcaggcttctcgactggcctgaagtggagcctgatgccgaaagacgaatccatgaatatccgttacctactgtgtaacgccgatgaaatggagccgggcacctataaagaccgtctgctgatggagcaactgccgcacctgctggtggaaggcatgctcatctccgcgtttgcgctgaaagcttaccgtggctatatcttcctgcgcggcgaatatatcgaagcggcagtgaatctacgccgtgccattgccgaagccaccgaagcgggtctgcttggcaaaaacattatgggaacaggttttgatttcgaactgttcgtccataccggggcagggcgctacatctgcggtgaagaaacagcgttaatcaactccctggaagggcgtcgcgctaacccacgctcgaaaccgcccttcccggcaacctccggtgcatggggtaaaccaacctgcgttaacaacgtcgaaaccctgtgtaacgttccggcgatcctcgctaacggcgtggagtggtatcagaacatctcgaaaagtaaagatgctggcaccaagctgatgggcttctctggtcgggtgaaaaatccgggtctgtgggaactgccgttcggcaccaccgcacgcgagatcctcgaagactacgccggtggtatgcgtgacggtctgaaattcaaagcctggcagccaggcggcgcggggactgacttcctgaccgaagcgcaccttgacctgccgatggaattcgaaagtatcggtaaagcgggaagccgtctgggtacggcgctggcgatggcggttgaccacgagatcaacatggtgtcgctggtgcgtaacctggaagagtttttcgcccgtgagtcctgcggctggtgtacgccatgtcgcgacggtctgccgtggagcgtgaaaattctacgtgcgctggagcgtggcgaaggccagccgggcgatatcgaaacacttgagcaactgtgtcgattcttaggcccgggtaaaactttctgtgcccacgcacctggtgcagtggagccgttacagagcgccatcaaatatttccgcgaagaatttgaggcgggaatcaaacagccgttcagcaatacccatttgattaatgggattcagccgaacctgctgaaagagcgctggtaaccgaatttcgattaacgctcagtctctgactgagaaaactggaagcatgctaatggctacaattcatgtagacggcaaagaatacgaggtcaacggagcggacaacctgctggaagcttgtctgtctctgggccttgatattccttacttttgctggcatccggcgctgggaagcgtcggtgcttgccgccagtgtgcggtgaagcaataccaaaacgcggaagacacgcgtggtcgcctggtgatgtcctgtatgacaccggcttccgatggcacctttatttccattgacgacgaagaagcgaaacagttccgtgaaagtgtggtcgagtggttaatgaccaaccacccgcacgactgtccggtatgtgaagagggcggtaactgccatcttcaggatatgactgtgatgaccggacacagcttccgtcgctaccgtttcaccaaacgtacccaccgtaatcaggatttagggccgttcatctctcacgaaatgaaccgctgcatcgcctgctaccgctgtgtgcgttactacaaagattacgctgacggtacggacctgggcgtttacggtgcgcacgacaacgtctacttcggtcgcccggaagacggcacgctggaaagcgaattttccggtaacctggtcgaaatttgcccgaccggcgtatttaccgacaaaacgcactccgagcgttacaaccgtaaatgggatatgcagtttgcgccgagcatctgccagcaatgttccatcggctgtaacatcagccccggcgagcgttatggcgaactgcgtcgtatcgaaaaccgttacaacggtacggtaaaccactacttcctctgcgaccgtggtcgtttcggttacggctacgtcaacctgaaagatcgtccgcgtcagccagtacagcgtcggggcgatgatttcattaccctcaacgccgaacaggcaatgcagggcgcagcagatattctgcgtcagtcgaagaaagtgatcggcattggttctccgcgcgccagcgtggaaagcaactttgcgctgcgtgagctggtgggcgaagaaaacttctacaccggtatcgctcacggtgagcaggaacgtctgcaactggcgctgaaagtgctgcgtgaaggcggcatttatactccggctctgcgcgaaatcgaatcttacgatgcggtactggtgctgggcgaagacgttacccagaccggcgcgcgcgtcgcgctggcagttcgtcaggcggtgaaaggtaaagcgcgcgaaatggcggcagcacagaaagtggctgactggcagattgcggcaatcctcaacatcggccaacgtgcgaagcatccgctgtttgttaccaacgttgatgacacccgtctggatgatatcgcggcgtggacttaccgcgcaccggttgaagatcaggcgcgtttaggttttgccatcgcccatgcgctggataactccgcgccagcggttgacggtattgaacctgagctgcaaagcaaaatcgacgtcatcgtgcaggcactggcaggtgcgaagaaaccgttgattatctccgggacgaacgccggtagcgctgaagtgattcaggctgcggctaacgtggcgaaagccctgaaaggtcgcggcgctgacgtcggtatcaccatgattgcccgttccgtcaacagcatggggctgggcattatgggcggtggatcgcttgaagaagcgttaaccgaactggaaaccggacgcgccgacgcggtggtggtgctggaaaacgatctgcatcgtcacgcttccgctacccgcgtgaatgctgcgctggctaaagcgccgctggtgatggtggttgaccatcaacgcacagcgattatggaaaacgcccatctggtactttctgctgccagctttgctgaaagcgacggtacggtgattaacaacgaaggccgtgcccaacgtttcttccaggtttacgatccggcttattacgacagcaaaactgtcatgctggaaagctggcgttggttacactcgctgcacagcaccttgctgagccgtgaagtggactggacgcagctcgaccacgtgattgacgctgttgtggcgaaaatcccggaactggcaggtatcaaagatgctgcgccggatgcgacattccgtattcgtgggcagaaactggcccgtgaaccgcatcgctatagcggtcgtaccgccatgcgcgccaatatcagcgttcatgagccgcgtcagccgcaggatattgacaccatgttcaccttctcgatggaaggtaacaaccagccgaccgcgcaccgttcgcaagtgccgtttgcctgggcgccaggctggaactccccgcaggcgtggaacaaattccaggacgaagtgggcggcaaactgcgttttggcgatccgggcgtgcgtctgtttgaaaccagcgaaaacggcctggattacttcaccagcgtaccggcacgcttccagccgcaggacgggaaatggcgtatcgcgccgtactaccacctgtttggcagcgatgaattgtcacagcgtgctccggtcttccagagccgtatgccgcagccgtacatcaaactcaacccagcggatgccgcgaagttgggtgtgaacgctggtacacgcgtctcctttagttacgatggcaacacggtcacgctgccggttgaaatcgccgaagggctgacagcagggcaggtgggcttgccgatgggtatgtccggcattgctccggtgctggctggcgcgcatcttgaggatctcaaggaggcacaacaatgagttggatatcaccggaactgattgagatcctgctgaccgtccttaaagcggtggtgatcctgctggtggtagtcacctgtggggcattcatgagctttggcgaacgtcgcctgctgggtctgttccagaaccgttatggacctaaccgtgttggctggggcggttcgctccagctggttgcggacatgatcaaaatgttctttaaagaagactggatcccgaaattctcggatcgtgtcatctttaccctggcaccgatgattgcctttacctcgctgctgctggcctttgcaattgtgccagtcagtccgggttgggtggttgccgacctgaacatcgggattttgttcttcctgatgatggcaggtctggcggtttacgcggtgctgtttgcgggctggtcaagtaacaacaaatattcgctgctgggggcgatgcgtgcttctgcgcagaccctgagctacgaagtgttcctcgggctttccctgatgggcgtggtggcgcaggccggttcattcaacatgaccgacatcgtcaatagccaggcgcatgtgtggaacgtcatcccgcaattctttggttttattacctttgccatcgcgggcgtggcggtgtgtcaccgtcacccgtttgaccagccggaagccgagcaggaactggcggatggttaccacattgaatattccggtatgaagttcggtctgttcttcgtgggcgaatacatcgggattgtgaccatctctgcactgatggtgacgctgttcttcggtggctggcaaggcccgttgttaccgccattcatctggttcgcgctgaaaaccgcgttctttatgatgatgttcattttgattcgtgcgtcgttaccgcgtccgcgttatgaccaggtaatgtccttcggctggaaaatctgcctgccgctgacgctgatcaacttgctggtaacggcggctgtcattctctggcaggcgcaataaggggcaataagaccatgaccttaaaagaattgttagtaggtttcggcacccaggttcgtagtatctggatgatcggcctgcacgcgttcgccaaacgcgaaacgcgaatgtacccggaagagccggtctatctgccgccccgttatcgtggtcgtatcgttctgacccgcgatccggacggcgaagagcgttgcgtagcctgtaacctctgcgcggtagcctgcccggtcggctgtatctcgctgcaaaaagcagaaaccaaagacggtcgctggtatccggaatttttccgcatcaacttctcacgctgcattttctgtggtctgtgcgaagaagcctgtccgaccacggcgattcagttaaccccggatttcgaaatgggggaatacaagcgccaggatctggtttacgagaaagaggatctgctgatctccggtccgggcaaatacccggaatataacttctaccggatggcaggtatggcaatcgacggcaaagataagggcgaagcagagaacgaagccaagcctatcgacgtcaagagcctgttaccgtaaggagaggggcaatggagttcgctttttatatctgtggcctgatagccatacttgcgaccttgcgagtgatcacccataccaatccggtacacgcgctgctgtacctgattatttcgctgctggcgatctctggggtgttcttctcactgggcgcttacttcgccggtgcgctggaaattatcgtctatgcgggtgccattatggtgctgttcgtgttcgtggtgatgatgctcaacctgggcggttcagaaatcgaacaggaacgccagtggctgaaaccgcaggtgtggattggtccggcgattttgtcagccatcatgctggtggtgattgtttacgccattctcggtgttaacgatcaaggtatcgacggtacgccaatcagtgctaaagcagtgggtattacgctgttcgggccttacgtactggcggtggaactggcttctatgctgctgctcgcgggtctggttgtggccttccacgtcggtcgtgaagagcgtgcgggtgaagtgctgagcaatcgtaaagacgacagcgcgaaaagaaaaacggaggagcacgcatgatccccttacaacatggactgatcctcgcggcaatcttattcgttcttggcttaaccggtctggttatccgtcgcaatctgctgtttatgctgattggtctggaaatcatgattaacgcctctgcgctggcctttgtggtcgccggaagctactggggccagaccgacggtcaggtgatgtacattctcgccatcagcctcgcggcggcggaagcgagtatcggccttgcgctgctgctgcaacttcaccgtcgtcgccagaacctgaacatcgattcagtaagtgagatgcgcggatgaacatgcttgccttaaccattattttgccattgattggcttcgtcctgctggcgttctcccgtgggcgctggtctgaaaacgtctcggcgatcgtcggcgttggctctgtgggcctggcggcgctggtaactgcctttatcggcgttgacttcttcgctaacggtgagcaggcatacagccagccgctgtggacgtggatgtcggtaggcgactttaacatcggttttaacctggtgctggacggcctgtcgctgaccatgcttctcggtggtcactggtgtgggtttccttattcacatgtacgcctcctggtatatgcgcggtgaagagggctactctcgcttcttcgcttacaccaacctgttcatcgccagcatggtagttctggtgcttgccgacaacctgctgctgatgtacctcggctgggaaggcgtgggcctgtgctcctatctgctgatcggtttctattacaccgatccgaagaatggcgcagcggcaatgaaagcgttcgtcgtgacccgtgtgggtgacgtcttcctcgctttcgcgctgttcattctttacaacgaactgggcaccctgaacttccgcgaaatggtggaactggcaccagcgcactttgctgacggcaataacatgctgatgtgggcgacgctgatgctgctgggcggtgcggtcggtaaatctgctcagttgccgttgcagacatggcttgccgacgcgatggcgggcccgacgcctgtctccgcgctgatccacgccgcaacaatggtaaccgcgggtgtctacctgatcgcccgtacccacggtctgttcctgatgacgccggaagttctgcatctggtgggcattgttggggcggttacgctgctgctggccggttttgcggcgctggtacagaccgacatcaaacgtgttctcgcttactctaccatgagccagattggctacatgttcctcgcgcttggcgtgcaggcatgggatgcggcgattttccacttgatgacccacgcgttctttaaagcactgctgttcctggcatccggttccgtcattctggcctgccatcacgaacagaacatctttaagatgggtggtctgcgtaaatctattccgctggtttatctctgcttcctggtgggcggcgcagcactgtcggcactgccgctggtcactgcgggcttcttcagtaaggatgagatcctcgcgggtgcgatggcgaatggacatatcaatctgatggtggcaggtctggtcggtgcatttatgacctcgctttacaccttccgtatgattttcatcgtcttccacggaaaagaacaaattcacgctcacgccgtgaaaggggtaactcacagcctgccgctgattgtgctgctgatcctttccaccttcgttggcgcactgattgtaccgccgctgcagggcgtgcttccgcaaacgacggagctggcgcacggcagcatgttgaccctggaaattacctctggcgtggtcgcggtggtcggcattctgctggctgcctggctatggctgggtaaacgtactctggtgacctccatcgccaacagtgcgccgggccgtctgctgggtacctggtggtacaacgcctggggctttgactggctgtacgacaaagtgttcgtcaagccgttcctgggtattgcctggttgctgaaacgcgatccgctgaactcaatgatgaacatcccggctgtcctttcccgctttgcaggtaaaggtctgctgttaagcgagaacggttatctgcgctggtatgtggcatccatgagcatcggtgcggtcgtggtgctggcactgttgatggtactgcgttgagttaaggattgtgggattgcccctgggcatataagaacgtaggtcggataagccgtcttcgcggcgcatccgacactacccccagtccgaagagaattttctgtcgtgagaattcgttgaaaatccggtcctgacgggacttttacaaggaataaagatcgccatgttactaccctggctaatattaattccctttatcggcggcttcctgtgctggcagaccgaacgctttggcgtcaaggtgccgcgctggatcgcgctggtaaccatgggattgacgctggcgctgtcgctgcaactgtggttgcagggcggttattcactgacgcaatccgccggaattccgcagtggcagtctgaattcgacatgccgtggatcccgcgttttggtatctctattcatctcgccattgacggtctgtcgttgctgatggtcgtgctgaccggtctgctcggtgtgctggcggtactctgttcgtggaaagagatcgaaaaatatcagggcttcttccacctcaacctgatgtggatcctgggcggcgttatcggcgtgttccttgccatcgacatgttcctgttcttcttcttctgggaaatgatgctggtgccgatgtacttcctgatcgcactgtgggggcataaagcctctgacggtaaaacgcgtatcacggcggcaaccaagttcttcatttacacccaggcgagtggtctggtgatgttgatcgccatcctggcgctggttttcgttcactacaatgcgaccggcgtctggaccttcaactatgaagagctgctgaatacgccgatgtctaacggcgtggaatacctgttgatgctgggcttcttcatcgccttcgcagtgaaaatgccggtggttccgctgcatggctggttaccggatgcgcactcccaggcaccgaccgccggttccgttgacctcgcggggatcttgctgaaaaccgccgcttacggtctgttgcgtttctccttgccgctgttcccgaacgcgtcggcagagtttgcgccaatcgccatgtggctgggtgttatcggcatcttctatggtgcgtggatggccttcgcccagaccgatatcaaacgtctgatcgcctacacctcggtttcccacatgggcttcgtgctgattgctatctacaccggcagccagttggcctaccagggcgcggtaatccagatgattgcgcacggcttgtcggcggcgggtctgtttattctttgtggtcagctttatgaacgtatccatacccgcgacatgcgcatgatgggcggtctgtggagcaaaatgaaatggctgccagcactgtcgctgttctttgcggtggcaacgcttgggatgcctggcaccggtaacttcgtcggcgaatttatgattctgttcggcagcttccaggttgtcccggtgattaccgttatctctacctttgggctggtctttgcatctgtttattcgctggcgatgctgcatcgcgcttacttcggcaaagcgaaaagccagattgccagccaggaactgccagggatgtcgctgcgtgagctgtttatgatcctgttgctggtggtgctgctggtactgctgggcttctatccgcagccgattctggatacctcgcactccgcgattggcaatatccagcagtggtttgttaattccgttactactacaaggccgtaaatcgccatgacaataactccacaaaacctgatcgcactgctaccgttgctgatcgtcggcttgacggtggtggttgtgatgctctccattgcgtggcgacgcaatcatttcctcaacgctacgctctcggttattgggcttaacgcggcgctggtttcgctctggtttgtcggccaggcgggcgctatggacgttacgccgctgatgcgcgttgatggtttcgccatgctttacaccgggctggtattgttggcgagcctcgccacctgtactttcgcctacccgtggcttgaaggctataacgacaacaaggacgagttctacctgttggtgttaattgccgcgctgggcgggatcctgctggcgaatgccaaccatctggcgtctctgttcctcggtatcgaactgatctctttgccgctgtttggcctggtcggttacgctttccgccagaaacgttcgctggaagccagtatcaaatacaccatcctttctgccgcagcgtcttctttcctgctgttcggtatggcgctggtgtatgcgcagtctggcgacctgtcgtttgtcgcactgggtaaaaacctcggcgacggtatgctcaacgagccgctgttgctggcaggttttggcctgatgattgttggcctcggtttcaaactctctctggtgccgttccacctgtggacgccagacgtataccagggcgcgcctgcgccggtttccactttcctggcgacggcgagcaaaatcgctatcttcggcgtggtgatgcgtttgttcctttacgcaccggtgggtgacagtgaagcgattcgcgtagtgctggcgattatcgcctttgcctccatcatcttcggtaacctgatggcgctgagccagaccaatatcaaacgtctgctcggttactcatctatctctcacctcggctatctgctggtggcgctgattgcgctgcaaaccggcgagatgtcgatggaagcggtaggggtttacctggtcggttatctgttcagcagcctcggcgcgttcggcgtggtcagcctgatgtccagcccgtatcgtggcccggatgctgattccctgttctcttaccgcggtctgttctggcatcgtccgatcctcgcggcagtgatgacggtgatgatgctttcactggctggtatcccaatgacgctgggctttatcggtaagttctacgtgctggcggtcggtgtccaggcacacttgtggtggctggtgggtgccgtggttgttggttcggcaatcggcctttactactacctgcgcgtggcggtgagcttatacctgcacgctccggaacaaccgggtcgcgatgcaccatcaaactggcagtacagcgcaggcggtatcgtggtgctgatctctgcactgttggtactggtgctgggtgtatggccacaaccgctgattagcattgtgcggttagcaatgccgctgatgtaaacagtcagtttgtaagtcagaaagccgccgacatgttcggcggttttttttggtgccctgacaccatcacccaacaataaccgtcagcgcatgattcccttgtcgcagcatacgtcgatacgcgctaatcagcttttccatatcaagcatgatcgaagcaaagagttgcccctctaactcttctgaaaaggttactcccggataaatctccatttcattgagtcgcttaatggaaaactgtttacgcagctcacttcgatccagtgattccagtcggtcgattgtcgcggctaactcctgattccaggtcaatcccaggaagccatctatgccatcttctaggctgtgttcaccaagcacggcgcgactcagcgggtcattcttcgcgggatcaaaagcagaggtgcctgtcagcccaaagtgtaaaaaatcccagcgtttatcaatatccagtcggcgtaatcctgaaagcgtgtcatgtatattatccatcaaaggttttttagtagactcaagcagttggttaatcttttctgagtcaatttctgcaaaatagccaatcattcccatttatttttcctccgttgaatttcatgtttcgcatcttaaaacagacgaaagaaaataaaatgcgcatgttgctttttctggatccgcctcgagaaatttttattatttactgttgtataacaaggttgtaactccatccactacctgagccattttctgataatttaatctgtctgcgatatcaccgggcaagtggtattgcttattacgataaaaagcggtgtcagtaatcattacggcgggaatatcgtgttgccaataattaaggtgatcagagaaatcaataccgggaataaaacctggggcattcatagaataaacagataaatcccgggatgacaacaatgccgcttttacctgacgaacggcgttgatatcctgcattctgccgaccacggcaataaagtctccccgatcgggataaagccaggacattgccgggtaagggtaatcctggctaccaggcgtagagtcgtaataaccaatcatctccagcgctatcattaatttcactggacgctcaagcgaagctgcatgtaccgcgctccccatttcatcgctacgaaagaagggcggttcttccgacgcataggcgaccagttggacgccaatccctggagtctgctgctgtaacaaacgtgccagttcgagtaatcctgccacgccgctggcgttatcatccgcgcccggcgtataggtcaattgatcgttttcataactactgacagagtcatagtgcgcaccaataataatcagcggtccatcggcaggaccataattagcaacaatgtttttgtaggggccacccgtaatggggacatcctgcgcggtaactctggcaccgttactgataaagacctcttttatatactctgcggacctattcagattatcaatattgtcggcgctacgtggatgcactgtttgtgtaagataacgaactgttttttctaattgctcaggacttgcgtgtcggggcattggcggtaatgcattcacccagggttggtaaaaaataatcagagggagtgaaaacagaaataatataataaaagcaaaatttatttttttcatatgcaaattattaatgggttgcgttgttgaatcattatttgttatgggtttcgatattgtattttattaagattagcaggattatacaaagagtgtattttatgtcggggccctgaatttatttaaaaggattttatatgcgaaataaaaatataatcatgttgcttataagtagtttgattttgtcaggatgtgggccggaacctgaggataagaaaagtcagcaacaacaatctactacacccactgaccagcaagtgcttgccgcgcaacaagcggcaacaaaagtggctgagcaaagcgccgccaaagccgctgcagacgcgaaagccttagcccagcaagaagtgcaacaatattcagacaaacaggctttgctggggcgattgcaggcggctccaaaatatcaacatgcagccagagaaaaagcagcctcccaaatcgcaaatccaggaaccgctcgctaccagcagttcgatgataatccggttaagcaggtagcgcaaaacccgttggcgacgtttagccttgacgtcgataccggcagttatgcgaatgtgcggcgtttccttaatcaagggctgttacctccgccagacgctgtgcgggtggaggagatagtcaattatttcccgtctgactgggatatcaaagacaaacaatctattccggcctctaagccaatacctttcgctatgcgctacgaattggcacctgcaccctggaatgaacagcgaacattgctgaaagttgatatcctggcgaaagatcgcaaaagtgaagagttacccgcttctaatctggtctttcttatcgacacgtctggttcaatgatttctgatgaacgtttgccacttatccagtcttcgttgaaattattggtcaaagaacttcgtgagcaggataacattgccatcgtgacctacgctggcgactctcgtattgcgttgccttctatctccggtagtcacaaggcggaaattaatgctgcaattgattcgctggatgcagaaggcagtaccaatggcggtgccgggctggagatggcttatcagcaggcagcgaaggggtttattaaaggtggtatcaatcgcattttattggccactgacggtgactttaacgttggcattgacgatccaaaatcgattgaatcaatggtcaaaaaacagcgtgagtccggtgttactctgtcgacgcttggcgtgggggatagcaattataacgaggcaatgatggtaagaattgccgatgttggtaacggcaactatagctacattgataccctctcagaggcgcagaaagtgttgaacagtgaaatgcggcagacgttgattaccgtagcaaaagatgtcaaagcgcaaattgagtttaaccccgcgtgggtaacggaataccgtcagataggttatgaaaagcgccaacttagggcagaggattttaataacgacaacgttgatgcgggtgatattggcgcaggtaaacatataacatttttatttgaattaacgctgaaagggcaaaaagcatcaattgataagttacgctatgccccggataacaaatcagcgaaatcggacaaaacaaaagaacttgcctggttaaagattcgttggaaatccccacagggaaaagaaagtcagttagttgaattcccgttggcattcgcaataaaggcaccttcagaagatatgcgttttcgcgcagcagtggctgcatatgggcaaaagttacgcggttctgaatacctgaataatacctcctggcagcagatcaaacagtgggctcagaaggcaaaaggggaagatccacagggttacagagcggaatttattcgcctgattggactggcgaaagatctggacaattcacaaaactaaaaatgataattctgtttgcctgatatcgacatcaaacgtatccggcaaacagatgaaaaaatgtcaaataaatgcgttggtatcgttaaattaatctgctaactaaccaccgctttcgacttaaatgctaaacaccgcgaaatcattcgccagttcagtcgccgggaaaattgaccgacattcacgtaacaggtgctgacaacctttgtcatcatagcgcgagctgacgtgggtaatgattagcttaccgactccagcctcacgggctagtgccgccgcctggcgtgtagaactatggccgcgactgttggctttggcctccatcgccatatccagagtcgcttcgtgaaccattacgtcgacgcctttagccagctccagcgcggcatcgcaggggccggtatcgccgaaaatagcgagcgctttacccggcactggaacggctaagtaatctgcgccattaatctgccttccatcatccagcatgattgttttgcccgcttttaattcctgaaacagcgggccaggcggcacgccagcagcttttaatgcctgggcatttaatgcacctggtttatcatgttcttcaatacgataaccataacattccagtgggtgttccatcggataagcggtcactttgcgcaggccatcatcgaaaatttcgccagcaccaatttcgacaatttccagcggataatcggtccatgagccgctaatccgcagcgcggtctccacaaattcacggataccgtgcggaccataaatcgttaagggttggataatgcctgacatagaacgactgcacagtaagccgggtaaaccaaagagatgatcgccatgaaggtgactgataaaaatcttgtccagttttccagggttaaaggcggtatgcagtagctgatgctgggtgccttcaccgcagtcaaataaccaaagtccgctctgggtcggatgttgcaggttaagcaatattgccgtgacattacgcgtacgggttggcacaccggctgaagtacctaaaaaaattaattccatgagttcatcacgctgctgaaaatattccggctagtataaagcaaacagcacaaaggagccttccatgatcgactggcaagatctgcatcattctgatttatccgtttctcagctttatgccttattacaactgcgttgtgcggtatttgtagtggaacaaaactgtccttaccaggatatcgatggtgacgatctggagggagaaaatcgccacattctcggttggcataacgggacactggtggcgtatgcgaggattctgaaaagtgacgacgaactgcaacccgttgtgattggtcgggtgattgtcagcgaagccttacgcggtgaaaaaatcggtcagcaattgatgagtaaggcgctggaatcgtgtactcgccgctggccggagaagccgatttatctgggggcgcaggcgcatttacaaaacttttatgggcaatttggtttcatccctgtgaccgatatttatgaagaagatggtatcccacacattgggatggcacgcgaggtaattcaggcgtaatcaataacccttgtctatagttagtgacaggttttacacaaatggagaacgagaatgtctaatcagtttggtgatacacgtattgatgatgacctgacgctgcttagtgaaacactggaagaggtgctccgctcctctggcgatcccgccgatcagaaatatgttgagctgaaagcgcgtgcagaaaaagcgctggatgatgtgaaaaaacgggttagccaggcttcagacagttattactatcgggcgaagcaggctgtttatcgtgctgatgactacgtccacgaaaaaccctggcaaggaattggtgtgggtgcggccgttgggctggttctgggactgttgctggcacgccgttaaaacctccctacaccggggtactgcattttttttgtcgtaccccgtataatgtgaggcttttaacagggagaggtccgcgtgcaatcacttactacggcgctggaaaatctactgcgccatttgtcgcaagagattccggcgacacccggcattcgggttatcgatattcctttccctctcaaagacgcttttgatgccttgagctggctggccagtcagcaggtgtatccgcaattctactggcaacaacgtaatggtgatgaagaagctgccgtcctgggtgcgattacccgttttacgtcgttggaccaggcacaacgttttcttcgccagcacccggaacacgccgacttacgcatctgggggttgaatgcgtttgacccgtcgcagggcaatttacttttaccacgcctggaatggcgacgttgtggcggtaaagccacgctgcggctgacgctattcagcgaaagctcccttcagcacgatgcaatcaaggcaaaagaatttatcgccacactggtgagtatcaagcccctgcctggattacatttaaccaccacgcgagaacaacactggccggacaaaacgggctggacgcaattaatcgaactggcaacgaaaaccatcgccgaaggcgagctcgacaaagttgtgcttgctcgggcaaccgacctgcatttcgcaagtccggtcaatgcggcagcgatgatggctgccagtcgtcggctcaatctgaattgctaccatttttacatggcctttgatggcgaaaatgcttttcttggttcttcaccggaacggttatggcggcggcgtgacaaagcgctgcgtaccgaagcgctggcgggaacggtagcaaatcatcctgatgataagcaggcgcagcagttaggtgagtggctgatggcggatgataaaaaccagcgcgagaacatgttggtggtggaagatatctgccaacgattgcaggccgatacccaaacgctggatgttttaccgccgcaggtactgcgtctacgtaaagtacagcatcttcgccgctgtatctggacttcactcaacaaagcggatgatgtgatctgtttacatcagttgcagccaacggcagcagttgctggcttaccgcgcgatctggcgcgacagtttatcgcccgtcacgaaccgttcactcgagaatggtacgccggttctgcgggctatctctcattacagcaaagtgaattctgcgtttccctgcgctcagcaaaaatcagcggcaatatcgtgcggctatatgctggcgcaggcattgtccgtggttccgaccccgagcaagagtggcaggaaatcgacaacaaagcggcagggctgcgtactttattacaaatggaatagtaatgagtcgcatcattaccgattcatatcaataatctatttttgtagctccttatacttagccgcaatattgataccggacaaactcatgtcagtaagcgcatttaaccgacgctgggcggcggtcattctggaagcattaacgcgtcacggcgtcagacacatctgtatcgcccctggctcgcgttctacaccgttaacgttagcggcggcggagaattccgcatttattcatcatacccatttcgatgagcgtggactggggcatctggcactggggctggcgaaagtcagcaagcagccggtggcggtgattgtgacctccggcacggcggtagcaaatctctatccggcactgattgaagctgggttaaccggagaaaaactgatcctgttaaccgccgatcgcccgccggagctgattgactgcggcgcgaatcaggcgattcgtcagccgggaatgttcgcctctcaccccacgcacagtatttcactgccgcgcccgacccaggatatccccgcacgttggctggtttctaccatcgaccacgctctcggtacgcttcatgctggtggagtccatatcaactgcccgtttgctgaaccgctgtatggcgaaatggacgacaccgggattagctggcaacagcggctgggcgactggtggcaggacgacaaaccgtggctgcgtgaagcgcctcgtcgggaaagtgaaaaacagcgtgactggttcttctggcgacaaaagcgcggcgtggtggttgccgggcgcatgagtgcggaagagggcaaaaaagttgcactgtgggcgcaaactcttggctggccgctgattggcgacgtgctgtcgcaaaccggacagccgctgccgtgtgccgatctctggttaggcaatgccaaagcgaccagcgaactgcaacaggcacaaatagtggtgcaactgggaagcagcctgacggggaaacgactcctccaatggcaggcaagctgtgaaccagaagagtactggattgttgatgacattgaagggcgacttgatccggcacaccatcgcggacgtcgcttaattgccaatattgccgactggctggagctgcatccggcagaaaaacgccagccctggtgcgttgaaatcccgcgcctggcggaacaggcaatgcaggcggttattgcccgtcgcgatgcgtttggcgaagcgcaactggcgcatcgcatcagcgactacttgcctgaacaggggcaattgtttgtcggtaacagcctggtggtgcgtctgattgatgcgctttcgcaacttccggcaggttacccggtgtacagcaaccgtggtgccagcggtatcgacgggctgctctcgactgccgccggcgttcagcgggcaagcggcaaaccgacgctggcgattgtgggcgatctctccgcactttacgatctcaacgcgctggcgttattgcgccaggtttccgcaccgctggtattaattgtggtgaacaacaacggcgggcaaattttttcgctgttgccaacgccgaaaagcgagcgcgagcgtttctatctgatgccgcaaaacgtccattttgagcacgccgctgcgatgttcgagctgaaatatcatcgtccgcaaaactggcaggaacttgaaacgacactagtcgatgcctggcgtacgccgaccaccacggtgattgaaatggtggttaacgacaccgatggtgcgcaaacgctccagcaacttctggcgcaggtaagccatttatgatcctgcacgcgcaggcaaaacacggcaaaccaggtttaccctggttggtgtttttgcacggtttttctggcgattgccatgaatggcaagaagtgggcgaggcgtttgccgactactcgcggttgtatgttgatctcccaggtcacggtggttcagcgacgatcagcgtcgatggatttgatgatgtcaccggcttattgtgtaaaacgctggttagttacaacatacttaacttctggctggtggggtactcgcttggcggacgggtggcgatgatggcggcttgccaggagccggcggggctttgtggagttgttgtcgaaggcgggcatcctggattgcaaaatgctgaacaacgcgcggaacgtcagcgttccgatcgccaatgggcgcagcgttttcgtacagaaccgttaacggcggtatttgccgattggtatcaacagcctgtttttgcctcgctcaatgacgatcaacgccgggagctggtggcgctgcgcagcaacaataatggcgcaacccttgccgccatgctggaggcgacttctctcgccgtccagcccgatttacgtgctaaccttagcgcccgcacatttgcgttttattatttatgtggtgaacgtgacagcaaattccgcgctctggcggcggaactggctgccgactgccatgtcattcctcgcgccggacataacgcgcaccgggaaaatcccgctggcgtaatcgcaagtctggcgcagatcttgcgtttctgactaaaggacacaatatgatttatcctgatgaagcaatgctttacgcaccggttgaatggcacgactgctccgaaggttttgaggacattcgttatgaaaaatccaccgacggtatcgcaaaaatcaccattaatcgtccgcaggtgcgcaatgccttccgtcctctgacggtaaaagagatgatccaggcgctggcggatgcgcgttatgacgacaacatcggcgtgatcattctgactggtgcaggcgataaagcgttctgctccggtggtgaccagaaagtacgtggtgattacggcggctataaagatgattccggcgtacatcacctgaacgtgctggacttccagcgtcagatccgtacctgtccgaaaccggttgtcgcgatggtggctggatactccatcggcggtggtcacgtcctgcacatgatgtgcgacctgactatcgcggctgataatgccatcttcggccagactggcccgaaagtcggttccttcgacggcggctggggcgcttcctatatggcgcgcattgttgggcagaaaaaagcacgtgaaatctggttcctgtgccgtcagtacgacgcaaaacaggcgctggatatgggcctggtgaacaccgttgtacctctggcggatctggaaaaagagaccgtgcgctggtgccgtgaaatgttgcaaaacagcccgatggcactgcgctgcctgaaagctgcgctgaatgccgactgtgacggtcaggcaggtctgcaggagctggcaggtaacgccaccatgctgttctatatgacggaagaaggtcaggaaggtcgcaacgctttcaaccagaaacgtcagcctgatttcagcaaatttaaacggaatccgtaatgcgtagcgcgcaggtataccgctggcagatccccatggacgcgggggtggttctgcgcgacaggcggttaaaaacccgcgacgggctgtatgtttgcctgcgtgagggcgagcgcgaagggtggggggagatctccccactgccgggcttcagtcaggaaacctgggaagatgcgcaaagtgtgctgcttgcctgggtaaataactggctggcaggcgattgcgagataccgcagatgccttccgttgcctttggcgtaagttgtgcattggcggagctggcagagacgctcccgcaggcggccaattaccgtgcggcgccgctgtgtaatggcgatcctgacgatctgatcctcaaacttgccgatatgcctggcgagaaagtggcgaaggtcaaagtgggattgtacgaagccgtgcgcgacggcatggtggtgaatctgttgctggaggcaattccggatctgcatttgcgtcttgacgcgaaccgcgcctggacaccgctgaaaggccagcagtttgccaaatacgttaacccggattatcgccaccgcatcgcgtttctcgaagagccgtgcaaaacccgcgatgattcgcgtgcgtttgcccgtgaaaccggcattgccattgcctgggatgaaagcttgcgcgagccggattttgcctttgtagctgaagagggcgtgcgcgcggtagttatcaaacccacgctcacgggcagcctggataaagtacgcgagcaagtgcaggcggcgcatgcgctggggctgacggcggtgatcagctcttccattgagtcgagcttaggtctaacgcaactggcgcggattgctgcctggttaacgccagacaccattccgggactggacacgctggatctgatgcaggcgcagcaggttcgtcgctggccggggagcccactgccgttagtggacgttgatgcactggagcggctgttatgatcttctctgactggccgtggcgtcactggcggcaagtgcggggagaagccatcgccttacgtctcaatgacgagcaactcaactggcgcgaactttgtgctcgcgtcgatgaattagcctccagctttgcggtgcagggtgtggttgagggcagcggcgtgatgttgcgggcgtggaatacgccgcaaacgctgctggcctggctggcgttactgcaatgcggggcgcgggtgttgcccgtgaaccctcagctgccgcaaccgctgcttgaggaattgctgcccaatcttacgctgcaatttgcgctggtgccggaaggggaaaacacgtttccggcgttagcgtcgctgcacattcagctggttgaaggcgcacatgccgcggcgtggcagccgacgcgtctgtgctcaatgacgttaacctctggttccactggcttgccgaaagccgctgttcatacttatcaggctcatcttgccagcgccgaaggggtgttatcgctgattccttttggtgatcacgatgactggttgctctctttaccgctgtttcacgtctccggtcagggaattatgtggcgctggttatacgctggtgcgcggatgacggtgcgtgataaacagccattggagcagatgctggcaggctgtactcacgcttcactggtgccaacacaactctggcgtttgctggttaaccgtagttccgtttccctgaaagcggttttacttggcggcgcggctatcccggtcgagttgacggaacaggcgcgcgagcaggggattcggtgcttttgcggctatggtctgaccgagtttgcctccacagtgtgtgcgaaagaagccgacggtctggcagacgttggttcgccgctgccgggtcgggaagtgaaaatcgttaatgatgaagtgtggctgcgggctgccagtatggcagaaggttactggcgtaacgggcaacgggttccactggttaatgacgaaggctggtacgccacgcgcgatcgcggtgagatgcataatggcaagttgaccattgtcggacgtttagacaatctattcttcagtggcggtgagg

SEQ ID NO: 9993 - DNA, 15039 bp, Escherichia coli
agtcgtgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttaccatcggcaatcaattcggcccctgcgctaacgtggcttgtaacaatcagatcacattgtggagcataaatacgctgaccggaacgcactggggtatcaattaaacgcgtttttgtgaccggcgttgtattttgcgctggagcctgcggtgcgggagctggacgcggcgctttttcctttccttccgtcaggataggcagccccatcttttcaatttcggctttaagttgcgcatctttgcagccacttacgccaataacccgcaaaccagttgccgaaaccgccttatgcatcgctgaccagtttaccgggtcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatcttcagacctgtttaaatatccagtgttgaggcgagtgtattttttcaccacgccaggctttcttaactttccattttttgcagcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcgggcttcaatctcctgcgtgtggcgttgtttgcgacccgtatatttgtgtgagttcagatggcatttccccagagttaacaaggaaatatctcggcgaaaaagccgctgaaaacttacaatcattacaaggctacgatcccagcgaatttacattctctaacggtgtattttgcgatgttaaagaaaaattatgtcgtgatgatcgttattttggtgtggatggtaagcggagtggaaaaatcaatcaaaccaccacaaagatgttatttatgtgtcgtgagtgatgtcttgtttacattatgttctattcggcattgtctgctattcgtcattaacctcttgagcgacagagaggagtggggcgttaacgtttatgacggggagagtccccgtcggttgatatttacttaatttgaatatcgacgttatattttttagttttgtttttacgggcgtcatttcgggtttgcagcactcgcagctcatatttgccagaagcagggagtgagtattgtccgtgactatcgagttctggggaatatctggataaatcaacagaatcatcgattcctggcccgaagaggtaagtatcagcgccttcattagagatactcacgtgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaagcaacaatacagccttactgatgcccttaattttcattggtagtctcctgttcagaatgagtacgatgaactgttataatataacaatccttcacgggagaattccagtggctttcctgtgttcggttaaatcccggcgcggcatttttgccggggggattacttataaagggggcatggactgaacaaaccgtagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattcttccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacacgaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtacccgaagagccagtgctgtttattaaaccagaaacggcactgtgcgatctgcggcagccattggcgatcccatccgatttcggttcagttcatcatgaagtcgaactggcggtgttgattggcgcgacgctgcgtcaggctacggaagagcatgtccgcaaagccattgccggttacggcgtggcgctcgatctgacattgcgtgatgttcagggaaaaatgaagaaagccgggcagccgtgggaaaaggccaaagcgtttgataactcttgtccgctttccgggtttattcccgcggcggagtttaccggcgatccgcaaaatacaacgctgggcctgagcgtaaacggcgagcaacgccagcaaggtacgactgcggacatgatccataaaatcgttccgctgatcgcttatatgagcaagttttttaccctcaaggccggtgacgttgtgctgacaggcacgcctgatggtgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaaggtttacctgcgtggcatccgctacttactggttcgaaagcggcaatgcatggtgaacgtatctctgtgcgtcatatcgcagtaaaagaatcagaagtgattgactggcaggatcatatcttaaataaacctgactgggcgcagtgataaatttaatagatgttgatgggggctttcttaatatacgtctggatgctcgccatttcgtagccctgtttttgaaagcgctctgtcataatgagagttacccgataccttattatcaacaggtaactctcaatctttaaaaaacgtctgtatttttaaatgtgataaactttataccttgagtacatagagagaataatcgcttatcagacttcaggtatctcaaagagtgtcttcttaccgtgtcttttctgatactcattacaggtgttaatcatttttttggccgcttacttttagtaaagaaagcattaaatcatcataatcaacgtagaatctggttgtttcagtttccgtttttatcaccccgatggcggctatttcggtagttaatttcaatttggcggcatcgatatctttattcgcttgtttaaccgtgttagacagggtggtaaagaaactctgcgcagattttaacttgttcttcaattctggaatcagtttcccttcaactacgcccgcagcaatagaacacagtttcttgatgccgtcatccagtaccttaatgagaatgcctttctgggcgaatgcttcgattctattttaaaccaggtgatatttttcctttctgctggatggacgctgtcgccagaaggccgcgtgagcacaggataagagaacgaaaaatcagcagtctatgcagcgacaaatattgatagcctgaatcagtattgatctgctgataagaacagactactgtatataaaaacagtataacttcaggcagattattatgttgtttatcaagcctgcggatctccgcgaaattgtgacttttccgctatttagcgatcttgttcagtgtggctttccttcaccggccgcagattacgttgaacagcgcatcgatctgaatcaactgttgatccagcatcccagcgcgacttatttcgtcaaagcaagtggtgattctatgattgatggtgggattagtgacggtgatttactgattgtcgatagcgctattaccgccagccatggtgatattgtcatcgctgctgttgacggtgagtttacggtgaaaaaattgcaactacgcccgacggtacagcttactcctatgaacagtgcgtactcgcccattaccatcagtagcgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggcgttaaaatgggcgatccctggttcaaacaaaaagatctgtttcgtcgctgtggcgtggtttgctttagcagcaattatgagctttacgcagacatgagtaatcgggtgatgtcgacgctggaagaactatcgccccgcgtcgagatttacagtattgatgaggcattctgcgatctgacaggtgtgcataattgtcgcgatctgactgattttggcagagaaatttgcgcaacggtgctacaacgtacccatcttactgttggtgtggggatcgcccagaccaaaacgctggctaagcttgccaatcatgcggcaaaaaaatggcagcggcagacgggcggggtggtggatttatcaaatctggaacgccagcgtaaattaatgtctgctctccccgtggatgaagtctgggggattggacggcggatcagcaaaaaactggacgcgatggggatcaaaaccgttctcgatttggcggattcagatatccggtttatccgtaaacattttaatgtcgtgctcgaaagaacggtgcgtgaactgcgcggtgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgttcaatgaaccttattacggcaatagcgcatcggtaaaactgctgacgcccactcaggacagcagggatatcattaacgccgctacgcgatctctggatgccatctggcaagcgggccattgctaccaaaaagcgggcgtgatgctgggggatttcttcagtcagggagtcgcgcagctcaatttattcgatgacaacgcaccgcgccccgggagtgagcaattgatggcggtaatggatacgctgaatgctaaagagggcagaggaacactctattttgccgggcaggggatccagcaacaatggcagatgaagcgtgccatgctttcaccatgttatacaacgcgaagttctgatttactgcgggtcaaataaacatagcggcaggaaaaagcgctcccgcaggagcgccgaatggattagcgaccgaacaggtcacgttttttcgctttaaacggctgggaaatcaccaccagcaccgcgacaatcaggtaagcgataaaaataccgagcagccactgcggcatttccagacctaaaaattcccactgacgctcggcgcaatcgccagaggcgacaaacacttgcggcacccatttatccagcggcagccattccgggaaacgagccataaaatcacaggtcgcaaacggcgaaggatagagctgaagcatggtgtgctcgtaagttaactgcacaccgcggaacgcactatacaaccagataaccatcgctacataacgcagcggagttttcggggcgatcgcgccaatcagcgcagcacccagaacgccgaataacgcgcagcgttcataaatacagagcacgcaaggtttcagtaacatcacatgctggaaccacagcgccgtcagttccagtgccagagcagtaaacgccatcaacagccatgcaccccggccttgtgaacattggttcaaaaatcgcaacataatcatttccctgcaatatgcatagagtgcgcagtttaaaccaattcattcgctgcgccaccaggaggcagcaaaaataggacgcaattggacaattatcgggcgaaaaggcaaaccgggcatttatatgcccggtaagttgttatcaaagcgttgctatccagcccatttgcataaaccattcggttacaggagcaagcgtaaactcgacgcagagcagcccgacgagtgtcaggacgagggtgtaaggcagggccatccacaccatgcggccataagagagacgaatcaatggcgcgagtgcagaggtcagcaggaacaggaacgcagcctgaccgttcggcgtagcgacggagggcagattggtaccggtattaatggcgaccgccagcagctcatattgcttcaacgtgatagcgccacttttcattgccgctttcgcttcgttgatataaatcgtccccacgaagacgttatccgaaatggatgacagcagaccgttgaaaatatagaacaacgacagctgagcatgttcagatgcctgcaacacaaactgaataatcggcgaaaacagttgttggtcgataatcaccgcgactactgagaaaaacaccgtcaacagtgcggtgaatggcagagattcggtgaaggctttaccgatagcatgttcatcggtaacaccggtcaatgatgtcgccagaataatgaccgacaaaccaatcaaaccgacttctgccagatgtagtgccagcgcggtgaccagccagacgccgataatcgcctgcacaatcagacgaattttgtcctgacgtgtacgctggagacggctttgatcgtcaaactgttgcagcacttcgcggactttctccggcagcgtttcaccgtagccaaaccaacgcagcttctctaccagcaggcaggttaacaggccacaaatcagaaccgggacggtcaccggcgacatgcgcaggaagaaatcgccaaaatgccagccagccgctttagcgatgatcaggttttgtggttcgcccaccatggtcatcacgccgcctaatgcggtgccgacaccggcatgcatcatcagactacgcagaaagccacggaactgttccagaaccactttgtaatgcttgtcgatatgactatcgtcttgcaggtcggtatcttcagtacgggaagaggctacgcggtgataaataccataaaaaccgactgcaacgctgatcaccaccgccacgacggttaaggcatcgaggaacgcggagaggaacgccgccgccacgcaaaaagagagcgacagcagcattttggagcgaatacttaacagcaaacgggtaaatatgaacaacaacagctgtttcataaaatagatacccgccaccataaacatcagtaacagcaagacttcaagatttgccgccacttcttcacgaacatgttccgcgctggtcatgccgatgaataccgcttcgatagccaacagaccaccggggagcagcgggtagcatttcagggccatcgccagagtgaaaataaattccgctaccagcaaccagccagcgacgaaagggctgatgaggaaaattaacggatttacgattaagaaaatgatgagggcgagtttgtaccagtcgggggactgtcccaaaaaattgcgccatagtgcgcggccccaggagatctccatgatggtttcccttaccttagaaataatcaatgatgtttttatgtttaaacgcaaagcttaacggtcagacaggagtgaggcaagtcttgatagtcaaggggaaagagatgcagaaaatgaagccttgatcccttttttcttctttttgtcttctatcagcgtagttagccctctggtatgatgagtccaactttgttttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacaacgtctggcacgagatggctggttgaccattcaacacggcaagccgacgaaggtgaataatttctgggaaacctctggtttaaatatccttgaaacactggcgcgactggaccacgaaagtgtgccgcaacttattgataatttgctgtcggtgcgtaccaatatttcaactatttttattcgcaccgcgtttcgtcaacatcccgataaagcgcaggaagtgctggcaaccgctaatgaagtggccgatcacgccgacgcctttgccgagctggattacaacattttccgcggcctggcgtttgcttccggcaacccgatttacggtctgatccttaacgggatgaaagggctgtatacgcgcattggtcgtcactatttcgccaatccggaagcgcgcagtctggcgctgggcttctatcacaaactgtcggcgttgtgcagtgaaggcgcacacgatcaggtatatgaaacagtgcgtcgctatgggcatgagagtggcgagatttggcaccggatgcagaaaaatctgccgggtgatttagccattcagggacgataatccttccagacggatgacaaacgtataattgcctgatgcgctacgcttatcaggcctacgtgtttttttgcaatgtattgaatttgcgatactttgtaggccggataaggcatttacgccgcatccggcaaaaatgagtcctcctcaaacgaggaggactatttacagatttcccattctcggcgggcaacgttccagcaactcgacgctgccgtcttcgttttgctgttccagcatcacatcaaatccccacaggcgatgcacatgcttcagcacttctttgcgcccccgatccagcggtgcgcgattatgtggaatgtaacgcagcgtcagcgaacggtcgccgcgcaaatccacgttccagatctgaatattcggctccagattacttaagttatattgcgacgataaccggttacggatttcccgataaccttcttcattatgaatagcggaaatctccagataattatgccgatcatcatccagcacggtgaagaagcggaaatcacgcatcactttcggtgacaggaactggctgataaaactctcatctttgaaatcacgcatcgcgaaatgcagcgtttccagccagtcggaaccggcgatatccgggaaccagtatttgtcttcttccgttggtgactgacaaatccgtttaatatcctggaacatggcaaacccgagggcatacgggttgatgccgctgtaccacgggctgttatagggcggctggaagaccacattggtgtggctgtgcaaaaactccagcataaaacgttccgttactttcccttcatcatacagatggttaaggatggtgtagtgccagaaggtcgcccagccttcgttcatcacctgagtctgtttttgcggataaaaatactggctcaccttacgcacaatacgcaggatttcacgctgccatgattccagcagtggcgcatttttctccataaaatagagcaggttttcttgtggttcggacggatagcggcgcgcttcagcaaccgttttctcttcctcgcgcttcggcagggtacgccagagcatattgacctgactttgcagatactcttcgcgactcttctgccgggctttctcttcttgcagcgagattttttgcgggcgtttgtaccggtccacgccgtagttcatcagcgcgtggcacgagtccagaagccgttctacttcatcaacgccataacgctcttcgcactcggtaatatatttacgggcaaaaatcagataatcgacaatcgaactggcgtcggtccagctacggaataagtaattgtttttgaagaaagagttatgcccatagcaggcatgagccatcaccagcgcttgcatggtaatggtgttctcttccatcaggtaagcgatacacgggttagagttaatgacgatttcataggccagtccttgctgaccgtgcttatacagccgttcagtctcgataaactttttaccgaatgaccagtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaaacgtgtggtgtccttattcatagaatcgatcgtcgccatacgcgcacctcattgttgtcggcgctctctgtgtggagcacctcatttcaagcatagaacacctgttaaaaaccgcgtcgccggagaatttttttctttgcgatttcttattatcagagtgccactaatccgcttctgaacggaattttatgctggataaaaagggcgttcagcaggagatactaaagacgccatattgccgcagagtcagggagatgtgagccagctcaccataaaaaagctgtatgttgaataatattttcaactgagttatcaagatgtaattagattattgttcttttactgtatctaccgttatcggagtggctatgcgagttgtcatactgggaagtggtgtggtaggcgttgccagcgcctggtacttaaatcaggcaggacatgaggtcaccgtcattgatcgggagccgggggccgccctggaaaccagtgccgcgaatgcagggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactatatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaacgcgacccgcgatatcgccgtgctggaagatgccggcgtaccgtatcagctgctggaatccagccgcctggcggaagtggagcccgcgctggcagaagtggcgcacaaactgacgggcggcctgcaactgcccaatgatgaaaccggagactgccagctgtttacccagaatctggcgcggatggcggagcaggcgggggttaaattccgctttaatacgcccgttgaccaactgctttgcgacggcgagcaaatctacggcgtgaagtgtggtgatgaagtgattaaggccgatgcgtatgtgatggcgtttggttcttactcgacggcgatgctcaaaggcattgttgatattccggtgtatccgctgaaaggctactcgctgactattccgattgcgcaggaagatggtgcgccggtgtctactatccttgatgaaacctacaaaatcgccattacccgtttcgataaccgcattcgtgttggcggaatggcggaaattgttggctttaacaccgagctgttgcaaccgcgtcgtgaaacgctggagatggtggttcgcgatctctatccacgcggcggtcatgttgagcaggcgactttctggactggcctgcgcccgatgacgccagacggcacgccggttgtcgggcgtacacgctttaaaaatctgtggctgaataccggtcacggcacgctcggctggacgatggcttgcggttccggtcagttgttaagcgatctgctctcggggcgcacgccagcgatcccgtatgaagatctaagcgtagcgcgctacagccgtggatttacgccattacgcccgggccatttacatggcgcacacagctaaggaaacgagatgacccgtccgatacaggccagcctcgatctgcaggcattaaaacagaatctgtccattgtccgccaggccgcgccgcgcgcgcgcgtctggtcggtggtaaaagcgaacgcttacgggcacggtattgagcgtatctggagcgcgatcggggctaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtggaatgaatcggttgggcttccagcccgatcgcgtgcttaccgtctggcagcagttgcgggcgatggcgaatgttggcgaaatgaccctgatgtcacattttgccgaagcggaacatcctgatggaatttccggcgcgatggcgcgtattgagcaggcggcggaagggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcaggatacgccgacggttatccgcgccacgcgcctaccggtacccctgttttagtggacggcgttcgcaccatgacggtggggacagtctcgatggatatgctggcggtcgatttaacgccttgcccgcaagcgggtattggtacgccagttgagctgtggggcaaggagatcaaaattgatgatgtcgccgccgctgccggaacggtaggctatgagttgatgtgcgcgctggcgttacgcgtcccggttgtgacggtgtaacttgttatcgctggatgcgaccagcgtcgtatccagcgttacaaaacacattaaacttaagattcggcttcttcctccgctacccgaacaccaatcttcaacacttcattatcttctttctcggccaccgtccagatcatcccggcaaactctacctggtcaccgacaaccggtgctgcgcctaacaactgctggacgatttcacccagcgtttgctgcttatcgcgatattctcgcccgtcttccaggccatatatcagcgccacatcagcatatttggcgctggcttcgagaatgaagtcaccaaagaagcgttgatccagcgcgaccggcggcgactggctgaacagtttaccgagcgccgggagatcgcgttcccgaccaattacacacaacacatcgccttcgcgcagtcgggtgctgccggtgggatgaagcaactggttatcacgaaacagtgccgcaatacgcgtctcttttggcatatgcaaatcacgcagtgccgcgcccacgcaccatttatcggcactcaattgataaacaaactgctcccacggattttccggatgaatatccaggccaacgcgtgacaccggacgtcccactggcggaacgaccactttggcttttttcgccgcccacgagagtgatgttccctgcaatagcagtgaaaccaggaccacaaagaaggcgacattaaagaacagtcgcgcattctccagccccgccatcatcgggaacacagccagaataatcggcaccgcgccgcgtaatcctacccagctgataaacacgcgctcacgcagattgaagccacggaacggtagcaatccggcaaataccgaaagaggacgggcgaagaaaatcatccatgcggacaaaatgagcgccggaatggcaataggcagcagatcgcttgggttaaccaatagccccagcaccaggaacatggcgatttgcgccagccaggcgaggccgtcgaaattttgcaggatgccgtagcggttgcgaatcggccgattacccagcagaaaaccgcacagataaacagccagaataccgctgccttccagcgccgtggttaaa

SEQ ID NO: 9994 - DNA, 34704 bp, Escherichia coli
attttttgccctgtaccaggccgccggaaccgtatttttttgatggatctttgcgggtacgaccatcgctggcatacagagtcccgtgaccttcggtgaatacatcatcaatatattttttcactgtccacggcgcgcccatccaccagcctggcatctgccagatcaccacatcagcccagagaaagttttgtacttccgctttgacatcgtagtcgctgtcggcgcgaacaatgcggacatcatgcccgaggtcgcgcagtgtgccatccgcgacttcggtcagggtgtcgttcagttgaccattggagtgggcgaattttttcgcgccgttgataatcaggatgttgctcattttttaacctcaaggtgagacgtttgccgactatagtacgtcacagagcggtacggtgaaattagcaaaatgtgcaaagtcttttgcgaatttagcaaaagtctgatctttctctgattcaccgatgcgggataaatattttctgaaaatgacaatacttaaatcaacttcccataagctcccacaggagagatgtattatgcaaatgatacaggagtttttcggaaaaaatgattatggagaatatatatgtcaaatatgatatacttatcaattaaagggaaaatacaaggtttgatctctgagggttgtggttcgtatgcatctattggtaataaatatcaaataaatcatgtggatgaaatttttgttttacagttcgaccattctttaagtcgagagtataatgtagtgcatcaccccataaaattttacaagccaatagataaatcctcccctttattaaatgccgctctttctgaaaatgaagagttatcagctgtatttaatttttatagaattaattctggcggttgtattgaaaggttttacacaattgaattgcaaggagcacatttatcgaatattctgacatgttatccacactcaattacacatgcgggtaatcagccggaagatgtcattgttcttaattataaaaatataacatggaagcaccatatcgcgagtacggaatcatatagttgttgggaagaaaggattttttaaatatgaaaagcgatctcactataaaaaatagatattgtacaattccacaagcgaagttccgtaaatgggatgaaatggacgttttactctggaagttaggaaaaaatgattcgcgtcgccgttcaggagtatattatttaaatgcttataaagatgcatatgtacaatataatagagacaaaataattaaacatgcatacgccgctggaattcgtccagagttactgggcggcgtggcctggattgagtcaggaggtatgcctgaaaattataagtttcagatatatgaaacaaaaagaatgatcggattgttagatatgcctgaaaataaaacatcatttggctcaatgggtatacaaatacgaaccgcagcgattactctaggtctagacccttcagaattaactaccagaaatcagttagagttagcgacatgcctaatggaggatgattttacctttcaaattgctgctacttatttaagagatcttgttctttttgattatccctcttcggcaacactgtatatgacgaatgagcagtatattatggctggtattagatataatcgtggtgttgaacgagatttgggtttttttatttgtttaattaataatttgcctgcgcgtgatacagatgattataaattcatctcttatggtatgaggttgttagagattagagaacatatcaaaaaattgattaatgagtaatcagatatgttaaaaaaacaactactatcaatatttgaagcactattatatataatgcttacttattggttaatagattctttttttgctttcaataagtatgactggatgcttgagtcgggagacaatatttgcagtataccttctgtttcaggcgaagatcgtatattgtaagcaatgattgcagcattttttcttctgacaccacttattattcttatcttaagaaaactctttatgcgggaaatgttcgagttttggctatatgtattctcgctcgttatttgtctgggttgtggttggtggcttttttggggacggtttatattttgctattagtaaagtctatgagagtcgttttaacggctctcatagacagagaagttaccagcttaccttcgcctcaaatccaccttgttccgcattcccaaattcaacattcatgtcatgcagcttggcgattcgctggacaatcgatagcccaagtccactgccggtagcggtttgtccgggtgggcgatagaagcgttcgccaattcgcgccagtgcctctggcgtcacaccggggccgttatccctcacgatgaaattatcggcattcagcgtgacgtctaccacgctaccttgtggactgtaacgcacggcgttatccagcaaatttcgcaccaacaaacttagcaatagcggttgtccggtgcgtttgatgccgttggcattgagtgtcagtcgcacgtcaatgttcgcctgctgcgccgtgtggtaaatatccatcaccgacgattgcaggagatcttcaagcgggatctccgcgacgtcctgaaggttatccagtgagtccagccgcgatagcgtgagcagttgatcaaccagacgagtagcgcgatcgatcccggaatgtaattggagcagcgcttttttccgcgcctgcggatcatcgtcagagagctgagcaacttcggtttgcactttcagcgccgttaacgggctacgaagttcgtgagctgcgtcggaggtaaagcgtcgttcacgaaccatcatcgcatgtgtgcgggcgaacagttgatttagcgactcaaccagtgggcgcacttcgctgggtacgcccgtcgcgtttagtggtttttccgagtctgggtcacgcatacgtagtgccagcgccaatttgttcagcggcgcgagttcacgacccagtagtaccatcatgatgattaacataatcggcagtgcgaccagccacgggatcaattgtccggcaacaatcgccagcgccatgtcttcacggtattcccattcctgacccacaacgatgcgatatttgccatcaggtgaggtcatccagacaaaacgccagggatcgtcttcaccgaccagttgcccgtcagcaaaaccttcccgctgatagctatagggaatatcttctccgttatcgccatcgttaaggaccattctgccgtcgtgggtaaagatggcaaaagtcagcgcatcgtcatcaacatgaccgtgttttaatttatttggcgtctgtgccatgcgatccgccgcgttgatttcgttgagatcgagcgtacttaaccgtttggcaaacagcatcagttgggtgtcgaacaactcatcgacgttatccgttgtttgtttccaggcgacaaagctggaaagcagccaggtcaccgaggccagaattaaaaagattagcgtcagcctgactcgcagactaagacgttgggtaaatttcatttctcacctaatgtgtagccaataccatgcacggtacgaataaaatcactgccgagtttgcgtcgcagatgatgcacatgcacttcaacggcattactggtgacctcttcgtcccaggtatacagtttctcttcaatcagtttgcgcggcagtacccgaccagcgttacgcatcagtaattccagcagggcaaattcttttggtttcagcgttaagggttcgccagccagcgtggcgatacgtttgccggggtcgagcatgacgttgccgtggcgcagctcgttgctggcctggccgttggttcggcgcatcagagcttccagcctggcggcgacttctatcaacgcaaaaggtttacacagataatcgtcagctcccagacgcagcccttctacacgttccgccagcgcatcgcgcgcggtcaggatcagtaccggctcacgctgacctttttctcgccattcgcgcaaaatatcgcgaccatccatgcccggtaaggttaaatccaggatcaccgcatcataaggtgcgctatatagcgcctcttttccctgacgaccttgtgtaaaccagtcgacgctaaaacccattttactaaggcccgttttgatgccgtcgccaatcagcatgtcatcttctatcagtaaaattcgcattttttcatccctgcgataaccgtatttgctgccagtaaaccgtgttgtaacgcgctctgtacagcattaaattttatttttttcccttaagaagttgttaaggactatcttgttaaatgctcggaaacagacattaaagggagtaataaacatgaaaaaattcgcagcagtaatcgcagtaatggccctgtgcagtgcaccggttatggcagcagagcagggaggtttttctggcccatcggcaacgcaaagtcaggccggaggattccaggggccgaacggcagcgtaacgaccgtagaaagcgcaaaatccctgcgtgacgacacctgggtaaccctacgcggcaatatcgttgaacgcatctctgacgatctctacgtgttcaaagatgccagcggtactatcaatgttgatatcgaccacaaacgctggaacggcgtgacggtgacgccgaaagatacggttgagattcagggggaagtcgataaagactggaattctgttgaaattgacgtcaaacagatccgcaaagtaaatccgtaattgttaccgctcccgggacgcgttcccgggaataatttcgcagggaggcaaaatgacaaacctgacactggatgtaaatattatcgatttcccatcaatccctgtggcgatgttgccgcaccgctgtagccctgagttgctcaactatagcgtggcgaaatttatcatgtggcgtaaagagacggggctttctcctgttaaccaaagccagacttttggcgtcgcctgggacgaccctgccaccaccgcaccggaagcgtttcgctttgatatctgcggcagcgttagcgaaccgatccccgataatcgttatggcgtgagtaatggcgaacttaccggtgggcgttatgctgttgcccgccatgttggcgagctggacgatatttcacacacgatatggggcatcattcgccactggctacctgcaagcggcgaaaaaatgcgcaaagccccgatcctgtttcactacaccaatcttgccgaagggatgacagagcggcgactggaaacggatatttatgtgccgttggcgtgatggggaatctttaccggagtgtgagccaaatcactcgcgataagtttgagcaaacaatgccacaggcgtattgttgtcgggcttataatttctccggtaaggaataccatgtatacgcgaaatttattatggctggtcagcctggtaagtgcggctcctctctacgctgctgacgttcccgccaacacaccgctcgccccgcaacaagtctttcgttacaacaatcatagcgacccaggcacgctcgacccgcaaaaggtagaggagaatactgccgcgcagattgtgctggatctgtttgaaggtctggtatggatggacggtgaaggccaggtgcagcccgctcaggctgaacgctgggagatacttgacgacggcaagcgctatattttccatctgcgtagcggtttgcagtggtcagacggtcagcctctgacggcagaggattttgtcctcggctggcagcgcgcggttgacccgaaaacggcaagcccttttgctggctatctggcacaggcgcacattaacaatgccgcggctattgttgcgggtaaagcagatgttacatcgctgggtgtcaaagcgacggatgatcgtactcttgaagttacgcttgagcagccagttccttggttcacgacgatgctcgcctggccgacgctgttcccggttcctcatcatgtcatcgctaaacatggcgatagctggagtaagccagagaacatggtttacaacggtgcctttgtgcttgataaatgggtagttaacgaaaagattactgcacgcaaaaatccaaagtaccgcgatgcgcaacatacagtattgcaacaggttgagtatctggcgctggataattcggtcaccggctataaccgctatcgcgcgggagaggtcgatctcacctgggttccggcgcagcaaattcccgccattgaaaaatcacagcctggcgagctacgaattatcccgcgtctgaacagcgaatattacaactttaaccttgagaaaccgccatttaacgatgtgcgggtgcgtcgggcgctatatcttacggttgatcgacagcttattgcgcaaaaggtactggggttgagaacgcccgcaaccacgctgacgccgccagaggtaaaaggctttagcgcgacgacgttcgatgaactgcaaaagccaatgagtgagcgcgtcgcgatggcaaaagtcttgctgaaacaggcgggatacgacgcctctcatccgctacgctttgagctgttctacaacaagtacgatctgcatgaaaagaccgcgatagcgttgtcttccgaatggaaaaaatggctgggtgcacaggtgacgctgcgcacaatggagtggaaaacctatcttgatgcccgacgagccggtgattttatgctgtctcggcagtcgtgggatgcgacgtacaatgatgcctccagcttcctgaacacgctcaaaagcgatagtgaagaaaacgtcggtcactggaaaaatgcgcagtatgacgccttactaaaccaggccacgcagatcactgatgcgacaaagcgtaatgcgttgtatcagcaggcagaagtgatcatcaaccagcaggcaccgctgattcccatctactatcagccgttaatcaaactgcttaaaccctacgttggcggttttccgctgcataatccccaggattatgtctacagcaaagagttgtatatcaaggcacattgatgcctttatcgccgccggagcacgtccggcggcgctattcacgctgatctcctgtgactcgacgcggcagataatgtagtatctccggcaatattgcccctttgaaggctggcgaataagttgaggaatcagaattaatgagcgatatggcagagcgccttgcgctacatgaatttacggaaaacgcctacttaaactactccatgtacgtgatcatggaccgtgcgttgccgtttattggtgatggtctgaaacccgttcagcggcgcattgtgtatgcgatgtctgaactgggcctgaatgccagcgccaaatttaaaaaatcggcccgtaccgtcggtgacgtactgggtaaataccatccgcacggcgatagtgcctgttatgaagcgatggtcctgatggcgcagccgttctcttaccgttatccgctggttgatggtcaggggaactggggggcgccggacgatccgaaatcgttcgcggcaatgcgttacaccgaatcccggttgtcgaaatattccgagctgctattgagcgagctggggcaggggacggctgactgggtgccaaacttcgacggcactttgcaggagccgaaaatgctacctgcccgtctgccaaacattttgcttaacggcaccaccggtattgccgtcggcatggcgaccgatattccaccgcataacctgcgtgaagtggctcaggcggcaatcgcattaatcgaccagccgaaaaccacgctcgatcagctgctggatatcgtgcaggggccggattatccgactgaagcggaaattatcacttcgcgcgccgagattcgtaaaatctacgagaacggacgtggttcagtgcgtatgcgcgcggtttggaagaaagaagatggcgcggtggttatcagcgcattgccgcatcaggtttcaggtgcgcgcgtactggagcaaattgctgcgcaaatgcgcaacaaaaagctgccgatggttgacgatctgcgcgatgaatctgaccacgagaacccgacccgtctggtgattgtgccgcgctccaaccgcgtggatatggatcaggtgatgaaccacctcttcgctaccaccgatctggaaaagagctatcgcattaacctcaatatgatcggtctggatggtcgtccggcggtgaaaaacctgctggaaatcctctccgaatggctggtgttccgccgcgataccgtgcgccgccgactgaactatcgtctggagaaagtcctcaagcgcctgcatatcctcgaaggtttgctggtggcgtttctcaatatcgacgaagtgattgagatcattcgtaatgaagatgaaccgaaaccggcgctgatgtcgcggtttggccttacggaaacccaggcggaagcgatcctcgaactgaaactgcgtcatcttgccaaactggaagagatgaagattcgcggtgagcagagtgagctggaaaaagagcgcgaccagttgcagggcattttggcttccgagcgtaaaatgaataacctgctgaagaaagaactgcaggcagacgcgcaagcctacggtgacgaacgtcgttcgccgttgcaggaacgcgaagaagcgaaagcgatgagcgagcacgacatgctgccgtctgaacctgtcaccattgtgctgtcgcagatgggctgggtacgcagcgctaaaggccatgatatcgacgcgccgggcctgaattataaagcgggcgatagcttcaaagcggcggtgaaaggtaagagcaaccaaccggtagtgtttgttgattccaccggtcgtagctatgccatcgacccgattacgctgccgtcggcgcgtggtcagggcgagccgctcaccggcaaattaacgttgccgcctggagcgaccgttgaccatatgctgatggaaagcgacgatcagaaactgctgatggcttccgatgcgggttacggtttcgtctgcacctttaacgatctggtggcgcgtaaccgtgcaggtaaggctttgatcaccttaccggaaaatgcccatgttatgccgccggtggtgattgaagatgcttccgatatgctgctggcaatcactcaggcaggccgtatgttgatgttcccggtaagcgatctgccgcagctgtcgaagggcaaaggcaacaagattatcaacattccatcggcagaagccgcgcgtggcgaggatggcctggcgcaactgtacgttctgccgccgcaaagcacgctgaccattcatgttgggaaacgcaaaattaaactgcgtccggaagagctacagaaagtcgctggcgaacgtggacgccgcggtacgttgatgcgcggtttgcagcgtatcgatcgtgttgagatcgactctcctcgccgtgccagcagcggtgatagcgaagagtaatatgccggggagggcgctgtttcctcccgcttgcaaggaacgccggatgaaacgttaagtcgtcatccggcagcgtattcaacccccggaaacgataaaaattcccttgaaaccgttgtttattcatgcgttgcgattaacaatacgcttttccagagagcggcttttaacaatgccctaacctgattttcaggtgacgtacaatgccagtctctcagaccttcagagggtgttatgctatatatctttcgtcttattattaccgtgatttacagcatcttagtctgtgtattcggctccatttactgccttttcagcccgcgtaacccgaaacatgtggccacctttgggcatatgtttggccgtcttgcgccgcttttcggcctgaaagtggagtgccgcaaacctgcagacgctgaaagctacggcaatgctatctatattgctaaccaccagaacaattatgacatggtgacggcatcgaacattgtgcagccgccgacagtgacggtaggtaaaaagagcttgctgtggatccccttcttcgggcagttgtactggttaaccggcaacttattgatcgacagaaacaatcgcactaaagctcacggcactattgcggaagtagtgaatcacttcaaaaaacgccgtatttccatctggatgttcccggaaggaacccgcagccgtggtcgcggcctgctgccgttcaagaccggggcatttcacgcggcaattgcggcgggcgtcccgattatacccgtgtgcgtctctacaacttcgaataagattaatcttaatcggctacacaacggtctggtgattgtcgaaatgctgccgccaattgacgtcagtcagtatggcaaagatcaggttcgcgagttggctgcccattgtcgttcgataatggaacaaaaaatcgccgagctcgataaagaagtcgcagaacgcgaagccgccggaaaagtttaagtcggcaatctgtatttttgcggggaacactttcctgcacggtattactttagccagttttacatggagcaaatatgtcactcagtcggcgtcagttcattcaggcatcggggattgcactttgtgcaggcgctgttcccctgaaggccagcgcagccgggcaacagcaaccgctacccgttccgccgctgcttgaatctcgccgtgggcaaccgctgtttatgactgtacaacgtgcgcactggtcatttacgccagggacacgcgcgtcggtttggggaatcaatggtcgttacctggggccgactatccgcgtctggaagggcgacgatgttaagcttatttacagcaaccgcctgacagaaaatgtctcaatgacggtggccgggctacaggtacctggcccgctgatgggcggtccggcacggatgatgtcgccaaatgctgactgggcacccgtactgcccattcgccagaacgcagctactctgtggtatcacgccaatactcccaaccgcacggctcagcaggtttataacggccttgccggaatgtggctggtggaagatgaagtcagtaaatcgctgcctatccccaaccattatggtgtggatgattttcctgtcattattcaggataaacggctggataactttggtacgccagaatataacgaaccgggaagcggcggctttgttggcgatacgctactggttaacggtgtacaaagcccgtacgttgaagtctcgcgtggctgggtgcgcttgcgtctgttgaacgcgtcgaactctcgtcgctatcaactacagatgagcgatggtcgcccgttacatgtgatttctggcgatcaaggattcctgcccgctcctgtatcggtgaagcaactttcgctggcaccgggcgagcgtcgtgagattctggtggatatgagcaacggtgatgaagtgtcgattacctgtggcgaagcggcgagcattgttgatcgtattcgtggcttctttgagccatccagcattctggtttctacgctggtgctaacgctgcgcccaaccggccttctgccgctggtcacagacagtcttccgatgcgcttgctgccaactgaaatcatggccggttcgccgattcgaagtcgtgatatcagcctgggtgatgacccggggattaatgggcagttgtgggacgtcaaccgtattgatgttactgcgcagcaaggaacgtgggaacgctggacggtgcgcgcggacgagccgcaagcgttccatattgaaggcgtgatgttccagatccgtaacgtgaatggcgcgatgccgttcccggaagacagaggctggaaagataccgtttgggttgacggacaagtggagctgcttgtttatttcggtcagccttcctgggcgcacttcccgttctacttcaacagtcagacgctggaaatggcggaccgtggctcgattgggcaactgttggtcaatccggtaccgtaatggaccaattcaatgccccacagagtggtggggcattgaaaattactcagtatgcagtcttcattgtgtatcaggtcgaaaataatcctggcagcatcagactaagctgcgggaaataacaaataattgccattactacaaacaatgccagaaacatcggcagtaatggttttattgccctgtcgatactgaccttaccaatgctgcaccccacaaacagaatggtgccgacaggtggtgtgcaaaggccaatggttaagttgaaaaccataattatgccgaagtgaatcggatcaatccccagatgctgggcgatcggcaggaaaataggtgtaaatatcaggatcgccggcgtgatatccataaaggtaccgacgatcaacagaatgatattgataataaacagaatgacccatttgttatccgaaacgcgggtaatcagttcgttgatcaactcaggaacatcagcattcgtcatggcccatgacattcccattgaacagcctaccagtaacagaacaattgaactggttactaccgaatctaacagaatatcattgagcttcttaagagtgatttcccggtaaatcatcgccagggctaaactataaattaccgctattgctgatgcttctgtgggcgtaaatacccctgcgataataccgccaataatgataaaaataagcatcaggctaggaattgattcgcggaatacctgtaaaaactgacggtaattgatgcgttcggccactgggtaatggtgacgtcgtgcataaagtgcagctacaaacattaaggcaacagcggtgaggatgcccggcagatatccagctaagaacaacgcagcgacagaagtcccgccactggcgagggaataaacaatcaacacattgctcggtgggatcatcaggccaatgggggcagaggcaatattaaccgctgctgaaaacgccggatcatatccctctttttcttgcagtggtgacataatcccacctaccgctgcggctgacgcaacggctgaacctgaaatcgcaccaaacagtgtattcgcgaggatattacaatgagccagtgagccaggaagacgcccaactaatgcttgcgccaggttaaccagtcgtctggctataccaccggtattcataatgtttccggctaacacgaagaagggaatggctaatagcgtaaagccatccagccctacagtcattttttgtgaaataacagaaatggcggcatcgggtggcaaggcagtaataatagataacagcgaagaaagaccaatcgcaaaagtaattggcacacctattgccagcatgacggcaaaactgccaaataaaattaagacggggtagatatattcaaattccatatttccctcgttaatgagaattccgtttacgatagttgtcaataatattcattactgaataccagaccagaataagcccactgacaggcataacccaatatactttatccattggccattttaatactggagagatttgtccaacatgttgtgctttttcaacaacaatattcccgccatagatcatgaaaataaccgcaaagaccgtaataataatttggataaaactgtcaagcgtcagaacagatgcagccggaagtttttgagccaacaaatcaatggccagatgtttttttaaacccgcagtatatacaccgccaagcaaaatcatccacataaataaaatctgggtgaactcatcaagcacagtgctgggagcgttaaaaataaaacgtgcaataacttgccaggttacgcagaacaccataatggcgagaataatgcagcaacatccggcaaggatcttattaagaatatgagtgagtgttcgcataagtcttccatgaaaaggcaggaattacctgcccattagggttacatactttctactagctcaaggtttttggctgattgtgcatctttcgccttgaattcatcgtataacggtttgacgcgttctttgaaagcggatttatcaacatcaacaactgttgcgttcatccctttcattttgtcgtaggcttctttttcagccgcaggccaaatgacgtccttcatctgcatcattgactcatcggctgcttttaataatgccgtgcgctctttatcaccaagtttattcaacacgtcggtgctgataattaacacatcaggtaccatggtgtgttcatcacgtgaatagacttttgcgacttcggcgtgacgcatatcggcatagacaacggtattgttctctccgccatcaaccacaccttgctgaagtgcggtgtagagttcgccttgcgccatcggggtagcgacaccaccgagtgctttcatcattgcaatggcgctggggctttgttgaaccctgattttcattcccgctaaatcttcaggttttgtaatcggtttattggaataaaaacttctcgcaccgccgtcatagtacgtaataccaacaaaaccttttctttctgatgaattaagtatttttttacctaaatcactttgcagaacacgataatagtgatcacggtcgcggaataagaacggcagactgaaaaggctgtaatccggagcaaatgattctagtgatgcggcattaaccttaaccatctgtaatgcaccggagttcattaattccagtgattcacgctcattacctaatgtcgcatttgggtaaatgcgaataactaattcaccattagaatactctttggttttatccgctaaatagcttaatgctttatggacagcatggcttttatcctgattatgactcagttttaatgttgtttttgccagtgtggtattagatattaataaacaactggttaacagcataagcgatgccgtcagaggacgaagtgctttcatatcctgctcctggttaatataacagaaacgataaatacagcgcttttctatcgttataataaaaaatagtgattaattctctgccagataatggaatattcctgccggaaccggaataccttcctgttggcatttttctttgtagtgcatttgcggatcgttcggcgctaacactttttcgacaccaggagccggtttaacggcatgcagctccgtgaccattttcgccatagtttttgcaaaaacaggattgccgagctttttcggatcgatggcaataaccaaacttgccagcttacgcatcttgtcataatcaccatacatgcgaacaatatggttgccaaaattcgcattcatcagcacgccagtcagtgcatcaatagccagtgcaatgcctgaacctttgtgttggccgaaaggtagcaggttttcaatcttatacggatcagtggtgccataaccgtttttatctatcgccagcccttcaccaatatgttttccggtttcctttgcatgaagtattttgccgaaagccgtggcactggtcgccatatcaacaatcatcggatggctgttttccaccgggaaaccaaaggcgatggggttagttcccaaaaagcgctcggcgccgccatggggagccacacaggtatcggtttgcgtcattacgatagcaaccaaccctttgtgggtgatcatctctgcaaaataagataacgcaccacagtgagacgtgtttttaacgctaacaaaaccgaggccctcttgctgggccagtttaatagcgtgctcagtggcgctaattaatgcggaatgccccattccgtcgtcagagtcgagaatggccactgacggtgaaatttgctcaatgctaaactgcggggctttatttaaccctccggcagcaaggcgggtgcaataatgttcgacacgcataacaccatgtgaatgcacaccggtaatatcggcatgtactaaaacatctgtcacctgttgtatggtgtcggtatccagcccggcggtatgtaatttgtggtgcaccagtgattttaaattttcttcactgacataaacagttgtcatatttgttcccttaaaaagtgatcacacccttgaccatatttttattttctacaacgttacgctggtaatcttcgccaacactaaagaaattgaacgcctggtttttcattaaattttcgtgaattttattgctgcgcatcagttcaatcaccaacgcaaaatcttcccgtgtggcattgcggctgctgagtaacgttgtctcttttttatggaaggtcggatcgtcaataacaagttcaccaatatacaaaccgatgaaaacaattttgccgccatgacgaataagattgacatcatgactcattgaagctttatttcccgtcgcatccaggactacgcaagccagttcgccgccaaacacttcactaagcgcggcaataaaaccttcctgtgttgggtcgaagacattaattgccagatgatccacaacgtgctggcgacgttgacagtcaatatcagcaacaacaacatgtgcccctttagccctggcgatggctgcggtagccagaccgattggcccagcgccaatcaccagtacgttttgttcagccttgatctctgcccgacgaacggcatgtgcaccaatggcgaaacattcaaccaatgctccggcactgtcgctgacctcgtcagggagaggcacaaggttgtcttcacgtaccgcaaggtactcactaaaacccccatcctgatgcacgccatacagcgaaacacgttcgcaacagttcgttttctcttcccgacaggctgcgcactcgccacacggaatgcatgggatgacggaatagcgctggcctgattgtgctgtttggcactggctgcctcgcgaaaccgcttcggcgcatatttcatgacctaatacacgtgggtagctaaaaaaaggctgtctgccggcaaaagcgtgaatatccgtaccacaaatacccacagctttgatttttaacagcacttcattatctgctggtgtgggaatatccttttccacatattccataacgccaggctgctgacaaattaatgttttcatttctgctcatccgataataattggctgatggtggccttgatgcctttgttttttatattcgcaaaggcgatttttatttcatttataaatggctgatggttgcttaaatcaccaaatatggcgctaaggtgcagtaatgcgagcgcctgttgccatgcgtcttgttgttcctttattagcgcctgaaattggtcattcattggatcagcgacagactggcttttctcaacagcatcaatgacataatgcaaccaaccagcaacgagcagtgacagaacagcattgttttgtttttgctgatgcaatttcagccagggcgtcagtgcacgctggggaagcttttgtgaaccgtccatggctatttgcccggtacggtgtgcaacgttacggttgctaaagcgttcaattaacaggtcggcgtattcctggatgttgatatttaagtctggattaagtgttcgggcttgttcattaatcatcagttggtgggtaatggaacgaaaattagcgtcttccatgcattgccagataaactcatagccagccagtgagccgttataagccagaaatgaatggctaccatttaacatgcgtaacttcatctcttcataaggctgaacattgctgacaaacatcgcgccggctttatcccattccggtcgtccgcgcacaaaattatcttcgataacccactgacgaaatgattcgcagacgatcccgcagggatcggcataaccggttttagtttccagtaaggcgaattgcgattcagtcattgccggaacaatgcgatcgaccatcgtgcctggaaatgagacattttcttcgatccactgagccaggggctggtccagttgtcgggcaaaaccgagaacggcattgcgcgtcagatgcccattgtctggcaagttgtcacaggagagcacactaaaagcggcgagtcctgccgctttacgttgttgcaaagcacagacgatcacgccaatagccgactgaggcgcatccggattttgtagatcgtggttgattaatccattggtgagatcaagtgatcgcgtttgcggatcgagacaatagcctttctcggtgatagttaatgaaacgatttttacctgaggttcagccagtttatggattgctgcggcaatgccatctctgggggtatgaataccgccagccaccgaacgcacaaggcgtgaggtagattgcgatgcagatgtttccacaaccgaaaacagcccattttgcgcatttaagttttcgatcagttgagcatcaccaaacaggttgatctcaaagatcccccagcgggtgtccgaaagttgattagcgagatccgtgtagacagcctggtgtccgcgatgaaaagcgccaaaaccaatatggacaatatctgcctgtaacccgtcccgaggccaggtggttacctgatcatagtgggcggcagcgatactttcgttccctgacattatgctcttactcctgacgacttgtgtgtagaccaatttacataattcactagaccaaaaacagagagatgcatcacgcttgcagagaaaggtaaaagtacgaaacagaacaacaaggcgttatttatatctgtatcaatgagttatatgaataaaatgaaaggaaagttttttagaggtcagtttttaggataattgccgctaatctaagatatctgatgatagtcgatttattagaccaattaaaaagagagcgtgtaccagtggagggcgaaaggcagagccggcgttatttttcccgccagctctggactaatgaaggttaacgagcgaagaaaaagtcatcaaaatcgctgatggaagcgtcttgtttgaagattttgatcagttcatttttgctgttttccagatgtctccaggacgcttccctggcgagctctgaatctttctgttgcagagccaggaaaatagcccggtgatcttccagccattgcagacgcaaatgcttttcatgcaggtacttgtagttaagtttcttccagcgggggttttctgtacgaactgcccgccataattcagcagcttgtttgatgagtacccgattttgcgtcgcttcggcaataatgctatgaaatcggtgatccaggtcttcaaatctatcactttccgcagcgatagcgttttcctgcaaactaatgattttctttaactcttgtaactcgttaaagctaatctggctggctgcaaaaccggtaatattgctctcaattacctgacgtgcctgtaacagttcaaacgggccaatttctgaatagggcattaatgatttctggttgagcttatcggtggagtcgacaaagaaaatccctgacccttgcttcacattcaatacgcctttcagttccagcataatgatggcttcacgaatggtagttcggctggtattaaaccgctcgctcagttcacgttctgaaggtaagcgttctccggccttaaatacgcctgaatacagcagctcttcaatctgtagaccaatatcgtaatagcggcgctttgtaataacctgttccataccttgccttactgtgggtgtcctcggatagccgatcgtcgtgcaatatgatttgaacgttgctgatcggcataaatagtagcggcagttgccacgataccgccagccttaaatgtgcttgcccaagtcgggcagtgaaaaacctcaccagggtatttcgccaccgttcatcaacatcacttcatttccgcgtgtgatacagcgtataatccccggcctttgattatttttttaccatttctggaagcaaaatgagctctatctccctgatccaaccggatcgcgacctgttctcctggccgcagtactgggccgcctgttttggaccggcaccgtttttgccgatgtcacgtgaagagatggatcaacttggctgggatagctgcgacatcattttggtaacaggtgatgcgtatgttgatcacccaagcttcgggatggcgatttgtggtcgtatgctggaagcgcagggctttcgcgtggggatcatcgctcagccagactggagcagtaaagacgatttcatgcgtctgggtaaaccgaatctgtttttcggtgttactgctggcaacatggactcgatgatcaaccgctataccgccgatcgccgtttacgtcatgacgatgcctacacgccagataatgtcgcgggtaagcgtccggatcgcgccacactggtttatacccaacgttgtaaagaggcgtggaaagatgtgccggtgatcctcggcggtattgaggccagcctgcgccgtaccgcgcactatgattactggtcggataccgtgcgccgttccgtgctggtggattcgaaagccgacatgctgatgtttggtaacggtgagcgtccgctggtggaagtggcgcaccgtctggcgatgggcgagccgattagtgaaatccgcgatgtgcgtaataccgcgattatcgtaaaagaggcgttgcctggctggagcggtgtggattccacccgtcttgataccccagggaaaatcgacccaatcccgcatccgtatggcgaagatttgccgtgcgcggataacaaaccggtagctccgaaaaagcaggaagccaaagctgtaaccgtgcagccaccacgcccgaaaccgtgggaaaaaacctacgtgttgctgccttctttcgagaaagtgaagggcgataaagtgctgtacgcccatgcttcgcgcattctgcaccacgaaactaacccaggctgcgcccgcgcattgatgcaaaaacatggcgaccgctatgtatggatcaacccgcctgctattccgctttctaccgaagagatggatagcgtctttgcgctgccgtacaagcgcgtgccgcatccggcttacggtaatgcccgaattccggcttacgaaatgattcgtttctcggtcaacattatgcgtggctgctttggcggctgctctttctgttctattaccgagcacgaagggcgcattattcagagccgttccgaagattcgattattaatgagatcgaagcgatccgcgacactgttccaggttttacgggcgtgatttccgatctcggtgggcctactgccaacatgtatatgttgcgttgcaaatcgccacgcgctgagcaaacctgccgtcgtttgtcgtgcgtttatccggatatttgtccgcatatggacactaaccacgaaccgacgattaacctctatcgccgtgcgcgcgatctgaaaggcattaaaaagatcctgattgcctctggtgtgcgttatgacatcgccgtagaagatccgcgctatatcaaagagctggcgacccatcacgttggcggttatctgaagattgccccggaacataccgaagaagggccgttatcgaagatgatgaagccgggcatgggcagctatgaccgctttaaagagctgttcgatacttactcgaaacaggcaggtaaagaacagtatctgatcccgtatttcatctccgcgcacccgggtacgcgtgatgaagatatggtgaatctggcgctatggctgaaaaagcatcgcttccgcctcgaccaggtgcagaacttctatccgtcgccgctggctaactcgaccaccatgtattacaccggcaaaaacccgctggcgaagattggttataagagtgaagacgtcttcgtaccgaagggcgacaagcagcgtcgcctgcataaagcgttgttgcgttaccacgatccggcaaactggccgttaatccgccaggcgctggaagcgatgggcaaaaagcatctgattggcagccgtcgcgattgcttagtgcctgcgccaaccattgaagagatgcgtgaggctcgccgccagaaccgcaatacccgtccggcgttgactaaacatacgccgatggcgacccagcgtcagacgcctgctacggcaaaaaaagcgtcgtctacgcaatctcgcctgcagaatgctggtgcgaagaaacgccctaaagcggcggttggacgttaaaaaatatccccggtaacagaatgctgccggggatttttttatcattctgcgtacatacgcaagcagcgcaggcagtcgaaatagtcctgtgcatcaagacgcgtattggctctgttagcttcggatttggcagcatagatttgtgggcgtaatgctttcatatcctgctcaagccgggcgattttggcatttaatgtttgcacattgctcgccagctgattgatcttttgctcattgacgcagccactgagcaagcaggttgccagaacaacagctcccacggtgaaaatcgttttcatatagtgttcccttttatttattgttccggctaattgttatttaattcagctcattgttttaatctggcggcggtttttgcctcaatctgcttaagtaggctgccgctgttcgggcggataaaatcagcgatttcccacttaccttcgcgccgctgtaaaatcagttcttgctcttcgttgttgccattggtcagcgtaaagcgaacatgaatgcgggcggaatcggtggttttctccaggactcgaatttcatcaacgcgtgaaaataacgactcttcgccaaaacagatcggattgtcgtaaataaattgccgttctatttgcatatcttcatcgggattgttggccgtcttgaaggtggttttatagaaggcattgaccgcctggcggtaagagtcggaaaccacccacgtccacggccagctataatcagcaatatgttcaaagagttcggcaacaaaggcttccggctgttctttttgcaacgaagctatagcggccagcgttttttcattctcgctattaaccgcttgtaagacgctgccatgattgctgacaatatcgccaatgacccaacgaccattttccgccaccattttcagtgtctgcgaggtcttttctttatcgtctttaaagatacgaaagcgcacaacggcatcggcatgatcggcgtcagtttgggttatcgctacgctttctaacaccagatcgccaaaatcctgacaatcacaaaccggatcataatccagccagccaatattgcccggcagcgtaagattgtcgttcagggtaagcgcctgttgaatacgcgcagaagttatcgctcgctctccggtttcaccaaaataaggggcagtggcatctgatttatagttctgataaatatgccggactgtttgttctacggtctgtgaggggggctgtgcgtgtacggtaaaacttgccagggctgctaaaaacagaagtattattttcatctgtttttcacctctccgttgcgtttatcccggatatagatgagttgttcttttaagagcttccggctctgcatgatgatgtccttatatttggcattcctgaacaaggaagagtagcaacgggcgggacgcgaggggaataaatgatttctgaaaagtccggtagcggaacattaccgccaccgggagaatttgcacgttagccgccgaactggtcaggatcgggaccgagacgcttgccctgatcgagttttgcaatttcgccaagttcgtctttgtcgagacggaaatcccagacatcaaagttttcgacaatgcgtgaaggtgtgaccgattttgggatcaccaccaggccgctatccagatgccagcggataacaatctgcgcaggggttttgccgtatttatctgccagatcgcgaatgactttctgatcgaaaacgcctttccctccttgcgctaatgggctccaggattcggtctggattttgtgtgtcgcgttccaggcatgtagctggcgttgttgcatcagcgggtgaagttcgatctggtttatcacaggcgtcacgccagtttcatcaatcaggcgttgcaggtgatggatctggaagttgcacacgccgatgcttttgattaatccctctttttgcaattcgatcatgcctttccatgcttcgacataatggtcgatagcgggaacgggccagtgcattaaatagaggtcgatataatcaagctggagttttttcaggctgtcgagcagggcttcgcgggggcgcttgtggtcgtcgttccacagcttagtggtgatgaacagttcttctctgttgactgaggcatttttcagggctttgccgacaccttcttcgttcttgtaggctgcggcggtatcaatcgagcgataacccacttctaacgctttttgaatggcggtgattacttcctcattacttgcttgccagacgcccagtcccagctggggcatgacattgccatcctgtagcttaataacggttggattagccatacgttcctcctttatatgaactcaccggagcaggctccggtgaggtgttgtgaacttaagtctggacgaaatgcccgaaaacgaaagtttgaggcgtaaaaagcttagcgggcggcttcgtatatacggcggctgacatccagcgtaatgtcatgattttcgcccagttgggtcatgccgtgctcttccagttttttcagcaaagccgggatggagctgccgtccagaccgtagtcggagaggtgggtcggcacgcctaattgctcaaagaaattgcgggttgcggcaatcgcggcgtcaatacgctcatcgtctgaaccttcagtgatgttccagacgcgttcagcatattgcagcagcttagcgcgcttggtatcgcgtttttcattccacagtgcaggcaggacgatagccagtgtttgcgcgtgatccagaccgtgcatcgcagtcagttcgtggcccagcatatgcgttgcccagtcctgcggtacgccagcgccgatcaaaccgttcagcgcctgagtcgccgcccacatgacgttggcgcgcacatcgtagttttctggctctttcagggctttcggaccatcttcgatcagcgtcagcaaaatgccttctgcgaaacggtcctgaattttggcatcaaccggtttggtaacatactgttccacggtgtgtacaaaggcgtccactacgccgttagccacctgacgcgacggcagggtgtaggtataaaccggatcgagcacggcaaatacgggctgaacatgggcagaatggaacgcctgcttgtcgcctgtggttttacgggagatcaccgcgcctgcgttggattctgaaccggttgctggcagcgtcagcacacagcccatcgggatggcgcttttaatctctttgccgcccgtttgcagaatgtgccacggatcgatattttccggatagttagccgctgcggcgataaatttggtgccgtccagtacagaaccgccgccaaccgccagcagaaaagtcactttttgttcgcgaaccagtttcacggcgttcatcagcgtttcataagccgggtttggttcaataccgccaaattccagcacgtccatgcctttcagggcatccagaacttgatcgagaacgccggtttttttcacgctgccgccgccgtaggtaatcaatacgcgagcatcgtgaggaatttgttcgcgtaaaccagcgattgcgcctttaccaaacagaatgcgggttggggtgtgcagattaaagttgttcattacttgctccctttgctgggtcaatatgagggcagagatcggtctgcctgatgtttttcattgtggtcgccagcgccgtacctctcaatgctcatttctgccaatgtcttgcctatttctccagagtgctggagaaatgctacaaaattgcgcacaatcaaattgccgcattattcctaagaaattacgcgatatgaaacgtgaagagatttgccgcttgctggcggataaagttaataaactgaaaaataaagaaaatagtttgtcagagctgttgcccgatgtgcgtttgttgtatggcgagacgcctttcgcacgcacaccggtgatgtacgagcctggcatcataattctcttttccggacataaaatcggttatatcaatgaacgcgtgtttcgttatgacgctaatgaatatctcctgctgacggtgccgttgccgtttgagtgcgaaacctatgccacgtcagaggtgccgttggcagggttgcgtctcaatgtcgatattttgcagttacaggaactgttgatggacattggcgaagatgaacattttcagccgtcaatggcagccagcggtattaactccgccacgttatcagaagagattttatgcgcggcagagcggttactggatgtgatggagcgaccgctggatgcgcgcattctcggcaaacagattatccgcgaaattctgtactacgtgctgaccggaccttgcggcggcgcgttactggcactggtcagccgccagactcacttcagcctgattagtcgcgtgctgaaacggattgagaataaatacaccgaaaacctgagcgtcgagcaactggcggcagaagccaacatgagcgtatcggcgttccaccataattttaagtctgtcaccagcacctcgccgttgcagtatttgaagaattaccgtctgcataaggcgcggatgatgatcatccacgacggcatgaaggccagcgcggcggcgatgcgcgtcggctatgaaagcgcatcgcaatttagccgtgagtttaaacgttacttcggtgtgacgccgggggaagatgcggcaagaatgcgggcgatgcaggggaattaaatacgttcccggtacagcaaccgggaacggggaaaatcgtcaggcgttacagtatttttttttaatcaccacaaacagcgtgcccaacaagccagcggttaacaaggcaattggcaggatcatcaggaacgtcattacctgatcttcatgtcgtttaacgaacggaatcatacttaaggcatagccgaaactggttaccacgctgacccacagcaatccgcttaaccagttgaaaaactggaagcggcggtttggcagaccggaaattcccgccatggttggcagcagcgtacggacaaatgcaagaaaacgtccagccagcagcgccagcagaccgtggcggtcaaacatgcaggtggcgcgctggtgatatttagcaggaagctgtgccagccagcctttcaccgttttggtattccctaaccagcgcccctgaatataacttagccagcagcccagacttgctgcggcggtcagaatcgcaatcgtaggcagaaaatccataaccccctgggcaatcaatgcgcctgccagtatcaacaagctgtcgcctggcaaaaatgaggcgggcagcaagccgttttctaaaaacagcgtggcaaacataacaaagtaaacaacgctaacaatatgagggtccgccagcgcggcaaagtcgtgttgccagagcgcagcgatgatatcttgaataacagccatggactttcctgtggaacagcgtttaagcctttatctgcctattgtactcctgaatcgtccgggacgccttgatcccggacgcaacaatttaagtcttttcacaataaaatgtctgcaaaattgtccaaaagtggcaatgttatacaattcgcgcaaaaccggcgtccagatcggcaatcagatcgtcgacatcttccagaccaatatgcaggcgaatcaaggtcccgctaaaatcgatcttgccttgtgggcgaatggcggcgatatgttctggttgatttgccaggatcaacgattcatacccgccccacgagtaggccatgctgaataaactgaagttatccagatagttcgccagctcttcatcattgagttttttcttaagcacaaaggaaaatagcccgctgctgcctgtaaagtctcgtttccagaattcgtatcctttactgccaggcagagcagggtggttaactcgtgctacttggggatgttctgccagccattcagccactttcagactgctttcatgatgttgacgcaggcgaacccccaaagtgcgcaggccacggctggttatataggcggtatcggcatcgaccatctggcccatcagataggcattctctcgcagctgctcccagcaacgggcattgcacacggcagtgccaatcatcgcatctgaatgcccaaccagatatttggtggcggcctgaatagaaacatcgatgccaaaatccagcgccttaaacagcacaccggctgcccaggtgttgtcgatcataatgatggcatccgggaccacactgcgtacggcggcaacaatcgccggaacatcgtggacttccatggtgatggaacctggcgattccagaaacacgattttagtgtttggctgcagatgattaacgatatcggcaccaatcagcggatcaaaccacgatgtcgttacgcccagtttgctgaggattttgctacagaaatcctgactcggttcataggcggtgttggtcatcaacacatgatcgccctgttcgacaaaagcaagaatggaattagcaaccgctgccgccccgcagggaaatagcacacagcctgcgccaccttccagttcacacatcgcttgttgtaaggagaaatgggttaacgttccacgccgtccatagaacaactcgccattggcgcgattacgtgtcgcgtgttttttggcttccacactgtcaaagaccagcgaagacgcgcgctgaatcacgctatttaccgcaccgagcgtgtattttttgctgcgtcctgcattcaccagttgagtatcaagctttttgtccgccatgtcgggattcctgtttttatacgtctggatgtctaaactagcatgaatattcgcgggcgcatcctgaagaattggcataaagcagaaaattttcgcaaatggcgtgctggttactttttttactgcgtaaacgcaaggaaaagaaagcaaaggtacggcagtatgcaaatagtaatgagaacgactatcaattcgacgtcgttttgatattattatgcacagattttgtgacttgcgtcctggagatacacagtgggtaataatttaatgcagacggacctctccgtctggggtatgtatcagcacgccgatattgtcgttaagtgcgtgatgattgggcttattttggcctccgtagtcacctgggcaattttcttcagtaagagcgtggagttcttcaatcagaagcgtcgtcttaagcgcgagcagcaactgctggctgaagcgcgttccttaaaccaggccaacgatatcgccgctgattttggtagcaaaagcttgagcctgcatttgctcaatgaagcgcagaatgagctggaactgtcagaaggcagcgacgataacgaaggtattaaagaacgtaccagcttccgtctggagcgtcgggtcgccgcagtaggtcgtcaaatgggccgtggtaacggctatctggcaaccatcggcgcgatttcgccgttcgttggtctgtttggtacggtctggggcatcatgaacagctttattggtatcgcgcaaacgcagaccactaacctggcagtcgttgcgccaggtattgcagaagctctgttagcaacggcaatcggcctcgtggcagcgattcctgcggtcgttatctataacgtatttgcacgccagattggcggctttaaagcgatgctgggtgatgttgcagcgcaggtattgttgctgcaaagccgtgacctggatctggaagccagcgccgctgcgcatccggttcgtgtcgcacaaaaattacgtgcaggataatgtccgatggcgatgcatcttaacgaaaacctcgacgataacggcgaaatgcatgatatcaacgtgacgccgtttatcgacgtgatgttggttttgctgattatctttatggtggcggcaccgttagcgacggtagatgtgaaggtgaatttgcctgcttctaccagcacgccgcagccgcgcccggaaaaaccggtttatctgtcggtgaaagcagacaactcgatgtttattggtaacgatccggtcaccgatgaaacaatgattacggcgttgaatgcgttaaccgaaggcaagaaagacaccaccatcttcttccgtgcggataaaactgtcgattacgagacgttgatgaaggtaatggatacgctgcatcaggcgggttacctgaaaataggtctggtcggcgaagaaactgcgaaagcgaaataaaaatgatgcccggttgcttttcacaaccgggcatttttttaacctaaatgctcgccgccgcagacaccgtgcacttctgcggtgacgtagctcgactcctgacttgccaggtaaacatatacaggggccagctccgccggttgccccgcacgcttcatcggcgttttctgaccaaactgcgggatcttatcctgcgtttgtccgccagaaatttgcagtgctgtccagatcgggcctggcgcgacaatattcacccgaatacctttctccgcgacctgttttgccaggccacggctatagttcagaattgccgccttcgtagccgcatagtccagtaaatgcgggcttggctggtatgcctggattgaggaagtggtgatgatacttgcacctttcggtagcagggggatcgcttcctgggttagccagaacaacgcgaaaacgttaatggcaaaggtcttttgaaactgttcgctggtgaggtctgcaatatcaggaatggcaacctgtttcccggctaccagcgccataatatccagcccgcctaacgccttgtgtgcttcgtgaaccagcgaacgggcgaatttctcatcgcttaaatcgcctggcagcagaacggctttgcgtccgcattcttcaatgatctttttcacatcctgagcgtcttcttcttccacgggaagataactgatcgccacgtcagccccttcacgcgcgtaagcaatggcggcagcgcgaccgattccggaatcgccccctgtcaccagtgctttacgatctttcaggcgaccgctaccaacataggttttctcgccgcaatccggtaccggtgtcatcttcgcctggatgcctggcgtcggttgtttctgtttgggatattcaccagtgtaatactgcgtggtcgggtcttttaaatgagacatcatttttctcccttcaggttcaacgtcctttaagggtagacgctctcgatgcgttgataagggaaccaggaagatccctaaccctcagaattatgcgacaaaggtttaacgtatatgttgatttgctgttgcgtgctgtttacttaattgcgatatactgttgcccgttttaactacacgacaggaatgtatggaacgttttcttgaaaatgcaatgtatgcttctcgctggctgcttgcccccgtgtactttggcctttcgctggcgttagttgccctggcgctgaagttcttccaggagattattcacgtactgccgaatatcttctcgatggcggaatcagatttgatcctcgtgttgctgtcgctggtggatatgacgctggttggcggtttgctggtgatggtgatgttttccggttacgagaatttcgtctcacaactcgatatctccgagaacaaagagaagctgaactggctggggaaaatggacgcaacgtcgctgaaaaacaaagtagcagcgtcgattgtggcaatttcttccattcacttactgcgcgtctttatggatgcgaaaaatgtccctgataacaaactgatgtggtacgtcattatccatctgacgtttgtgctctctgcatttgtgatgggctatcttgaccgactgactcgtcataatcactgatctgattcgggcgcggttctcgcgcccgttattaacaggtcatttatcggaagacgcctgccacagattcagctctccatcggcgatatgctgatcaatctgcgccagctcctcggtgctaaatgtcagattattcagcgcctgcacgttctcctcaagttgctccgcgcggctggcaccaatcaataccgacgtcactcgctcatctttcagcaaccagcttaacgccatttgcgccattgattgtccacgctgctgtgccatttcatgcaataagcgcaggctgttgaggttggcttcggtgagcattttcggcgtcagaccacgaactttattcccttcacgatgcatccgtgaatcttgcggaataccgttgagatattttccggtcagcaatccctgagccagtggagtaaaggcaatgcagcccacgccgttattttgcagggtatccagcaggccgcttttatccacccagcggttcagtaaattgtacgaaggttgatgaattaacagcggaattttccactcgcgcagcaactcgaccattttttgcgtccgctctggcgagtaagaggagatcccgacatacagcgccttaccgctttgtaccgaatgagccagcgcagaggcggtttcttccatcggcgtattttcatcgacgcgatgagagtaaaagatatcgacatactcaagccccatacgcttcaggctttggtcgaggctggcgagcaggtatttacgtgagccgccagagccgtatggaccgggccacatatcgtatccggctttggtagagataatcagttcatcgcgataagcggcaaaatcctcgcgcagcaggcgaccaaagttttcttctgcgcttcctggaggcggcccgtaattgttggctaaatcaaagtgcgtaatgcctaaatcaaacgctttacgcaggatcgcacgctgtgattccagcgcgttaacgtgaccgaaattgtgccataaaccgagcgataacgcgggcaggcgtaaaccactttttccgcaatagcggtactgcatccgcccgtaacgttcgggattcgctaaccagaccatgacctctcctttccaccattcaatttcgaaacaatgtttctagtttagcgattcgccagcgcgtatcccgtagtctggctcacagagtgacgaaaaactgggcaaaaacacgcgcttatgctttgcttaaaaaaacaccagttgaggagtgcaacgatgccgcgtttaaccgccaaagatttcccacaagagttgctggattactacgactattacgctcacgggaaaatctcgaaacgtgagttcctcaaccttgcggcgaagtatgcagtgggcgggatgacggcattagcgctgtttgatttgctcaagccaaattatgcgctggcgactcaggtagagtttaccgacccggaaattgttgcagagtacatcacgtatccctcgccaaatggtcacggcgaggtacggggttatctggtgaagcccgcaaaaatgagcggcaaaacgccagccgtggtagtggtgcatgagaatcgagggctgaatccgtatatcgaagatgtgacgcggcgagtggcgaaggcggggtacatcgccctggcgccagacggtttaagctcagtaggtggctatcctggtaacgatgataaaggccgcgaactgcaacagcaggttgatccaaccaaactgatgaatgatttctttgccgcaattgagtttatgcaacgctatccgcaagcgacaggcaaagtgggtattagcggattttgctatggcgggggcgtatcgaacgcggcagcagtcgcgtatccggaactggcctgcgcggtgccgttttatgggcgtcaggcacccactgccgatgtggcgaagattgaagcgcctttactgctccactacgctgaactggatagccgaatcaacgagggctggcccgcttacgaggcggcgttgaaagccaataataaggtctatgaggcgtatatatatccggaggttaatcacggattccataatgattccacgccccgttatgacaaatctgccgccgatcttgcctggcaaaggacgctgaaatggttcgataaatatctctcctgatgggtttatctcttacaggattacgtcttaaacaagcatgaaaaaatagcgtgcgcaaatgtcgttctttgcctaaaatatcgatatatatgacaatatataacgaatgaggtgaacgatgaataaccattttggtaaaggcttaatggcgggattaaaagcaacgcatgctgacagtgcggttaatgtgacaaaattctgtgccgattataaacgcggttttgtattaggctactcacaccggatgtacgaaaagaccggagatcgccagcttagcgcctgggaagcgggtattctgacgcgccgttatggactggataaagagatggtaatggatttctttcgtgagaataattcctgttctacgttgcgcttttttatggccggttatcgcctagaaaattgatcaaacatacgtattatcttgctttaattaattacactaatgcttcttcccttcgttttagtgccccgccgcagtatcatgatatcgataaccataataaatgtgtggtaaatggcgcatcgatcgcattattgattttgcgattgaggcaaaatatatgccaggtcttcgcaacggaataactataaatgactggagataacaccctcatccattctcacggcattaaccgtcgtgatttcatgaagctttgtgcagcattagccgccaccatggggttaagtagcaaagccgctgcagagatggccgaatcggttactaacccgcagcgtccgccagttatctggattggcgcgcaggagtgcaccggttgtacggaatctctgcttcgtgcaacgcatccaacggtagaaaacctcgtgctggagactatctctctggagtatcacgaagtgctttccgccgccttcggtcatcaggtcgaagagaacaaacataacgctctcgagaagtacaaagggcagtatgtgttagtggtggatggttccatcccattaaaagataacggtatttattgcatggttgccggtgagccgattgtggat

SEQ ID NO: 9995 - DNA, 32489 bp, Escherichia coli
ccttaaactcaaacttaaccaaagaattattccttcttttagctttgctcaataaggcaagatcgtttatagatatttcttgattaccatggagtctagataaaaaatcattagatgtcgcatgatacctatttttaatagatgtaatgacaaattctctaatcttgtttaaagataacttagatgccaaaacctcaagacaatccctatgtagttcatttgaaaatgtaattccatactgattaagcagatctttaagctcagacttaagcaaaaaacccaaataaacaaatttatttaagcgagagcaaacccttcctttttgaattattttaaagcgtacgctactattattagattgaaattctacaacgccaacatctgatgaaacccgtttagatacttcactggtaaattttggcgcgcacacaattgtaactttttcgaagctagatttaaaaatttttaactgaccatccaatcgcttaagagagtcaaaatcgctttttatttcaaaagcttgtaggcttccattggcaatagccaaatcagctcttctgctccagttagcaacaaccatttcattaatgatcgttgcatcactaagcatgccttttttatataaccattcaattagggctattttaacttcctgctctcgcaataactcagccatgttaatcacactcacttcacgttgatttttattatagcaactaacaattaaaaactccagattatgttacttaacactcattttaaaaatcaaccaataactatttttatttaagtatttctttgtattttgaataatcataaggcgtaatatatttattacggttcatatccaaataatcagcccaccactgcatcattaaacgccgctcatccaaatgctcggaggtatggatatatgccgcacgtacattattacgctctgagtggctcagttgcctctctatcgcgtcatcactccataaccccgactcccccaacgcaccacgcgccatagtcctaaatccatgcccacacacctcggttttagtatcatagcccatcgcacgcaatgcgctgtttaccgtgttttcactcataaccttagttgcgtcatgatcccccggaaaaagcagctctttatcaccactaatctgctttaactggtttaataaaatcatcgcctgtcgactaagcggaacgatatgttcctctttcatcttcatgcctcggtacgaataacgcacacctttaatttcttctcgctttgcaggtatacgccaaagagatttatcgaagtcgaattcatcccaacgtgcgaaacgtaattcactggaacgcacaaaagttagcaaggaaagctcgaccgcaatccgtgtcattacacggccacgatatgcagcaagacgtgcaagaaactcagggaatcggctagaaggtaaagcagggtaatgtcgcgctttggttgtcgatagcgcaccagccatatcgctggctggatttgagtcgatgtaatcgttctgtacggcataacgcataatggctgtgacgcgctgttgcaggcgctgagcgacatcgtgtttgccactggcatcaacttttttaatcggggctaacaggtggctggttttaagctgccgaatgtcggacgaaccgatatgagggaatatataaagctcaagatagcgaagaacgcgcgatcgatggtcttcactccagcgcttgttactggcatgccattctcgggcgatagcttcaaaagtatatgcccccgaattctcggcccgagcttctttttgtacgacttttgggtctatgccctgtactaaaagctttttagcttcatcgcgttttgctcttgcctgagcaagcgtcacagtaggccaaacaccaaacgcaagacgatcctcttttttgtcagagggacgtctgtatttcatgcgccagtatttggaacctttggccgaaacctcaagatacaaaccaccaccatcggccattttgtaggttttgtcttttggctttgcggtctcgacctgtctggcgttgagcttcatttgggggcacatttctaatcgaagttaagatgcccccaattatgcccccaatgatatccggatttcaacggacaacctcggaagacgcaggacgaaaaaatcgctgcaagcattgattttaaagggatatttggactttctcggatggtcttggaagtaagaatggtgccgaaggccggactcgaaccggcacgtatttctacggttgattttgaatcaactgcgtctaccgatttcgccacttcggcactgaagaggtatgcggaaaacgttgtggattatacctgtcgcacgccaccatgcaagcgccagcttgctcgcacctcgctaagtgctgaaattttcagcattgcataccgcgatgtgtaacctttgtcacactccaggcaccccgccctgccatgctctacacttcccagacaacaccagagaaggaccaaaaaatgtcgatgataaaaagctatgccgcaaaagaagcgggcggcgaactggaagtttatgagtacgatcccggtgagctgaggccacaagatgttgaagtgcaggtggattattgcgggatctgccattccgatctatcgatgatcgacaatgaatggggattttcacaatatccgctgattgccgggcatgaggtgattggtcgcgtggtggcgctcgggagcgccgcgcaggataaaggtttgcaggtcggtcagcgtgtcgggattggctggacggcgcgtagctgcgggcattgcgatgcctgtattagcggtaatcagatcaactgcgagcaaggtgcggtgccaacaattatgaatcgcggcggttttgccgagaagttgcgtgcagactggcaatgggtgatcccactgccggaaaatatcgatatcgagtccgccgggccgctgctgtgtggtggtatcacggtctttaaaccactgttgatgcaccatatcactgctaccagccgcgttggggtaattggtattggcgggctgggacatatcgctataaaacttctgcacgcaatgggatgcgaggtgacagcctttagttcaaatccggcgaaagagcaggaagtactggcgatgggtgccgataaagtggtgaatagccgcgatccgcaggcactgaaaactctggcggggcagtttgatctcattatcaatactgtgaacgtcagcctcgactggcagccttattttgaggcgctgacgtatggcggtaatttccacaccgtcggtgcggttctcacgccgttgccggttccggcctttacgctgattgcgggcgatcgcagtgtctctggctctgctaccggtacaccttatgagttgcgtaagctgatgcgctttgccgcccgcagcaaggttgcgccgactaccgaactgttcccgatgtcgaaaattaacgacgccatccagcatgtgcgcgacggtaaggcgcgttaccgcgtggtgttgaaagccgatttttgaaaatcattcgcagcgctgatctgaggcgcagccctctttcgcacatattctgttttgtcgtatcgccagcacagcctgccgacattgttcggtgacattggcaatatcatggttgatatcaatgcgcacaatatcctgttcatcgtcttgtggacgctccagtgcctcaaactgactttttagtaacgctaccggcataaaatgcccagcccgacgctgcattcgcgcgagaatagtttcatagtcgccatctaaccagaggaaatgaacatgggggctacccttgcgtaaaatatcacgatactgtttttttaatgatgaacagacaataaatcctgtttcattctttttataaagactgtatgaagcatcatttaagcgttccagccagggaagtcgatcttcatcagataatggaataccctgcgacattttatctatatttttggctggatgaagatcgtcaccatcaataaatttagcagataataacgcggcaaccttgctaccaattaatgttttaccactccctgaaacgcccatcaaaataaagctttcacccgccatttaaaatctcctgaatcatcttacctgctgcgatactacgcctggtggcataataatttcacgtttttttatttctgctgataagaattacaaggcacatcacgttatgcgtaacatcgtaatgtaacaattttctaacgtgatcttcatcacaaataatgacaattaaaaccgcttaaatgcttccgaggtgtctacctgaccagtgaggaatttatgcaagtgaaaacacagtcctgcgttgttgcgggcaagaaaactgttgccgttaccgagcagacgatagattggaataataatggaacattagtacaaataacccgaggtggaatttgcggttccgatttacattattatcaggaaggaaaagtaggtaatttcatgataaaggcaccgatggtgttaggtcatgaagttatcggtaaagttattcatagcgactcatcaaaattacatgaagggcaaacggtagccattaatccgtctaaaccgtgcggtcactgcaaatactgcattgaacataacgagaatcagtgtacagagatgcgtttttttggcagtgccatgtatttccctcatgttgatggtggctttacccgttataaaatggtcgaaacgtcgcaatgtgtcccttatccggccaaagctgacgaaaaggttatggcttttgccgaacctttagccgtcgcgattcatgccgcacatcaggccggcgagttacagggcaagcgagtatttatttctggtgttgggcccattggctgcctgattgtcagtgctgttaaaacactgggggccgcggaaattgtctgtgccgatgtgagtccccgttccctttcgctgggcaaagagatgggggcggatgtgctcgtaaacccacaaaacgacgacatggatcactggaaagcggaaaaaggctatttcgatgtcagctttgaagtgtccggtcatccttcatcagtgaatacctgtctggaggtcactcgtgcacgcggcgtaatggtgcaggtagggatgggaggcgcgatggcagaattcccaatgatgacgttgattggtaaggagatttcactcaaaggctctttccgttttaccagcgaatttaatacctcagtgtcatggctggcgaatggcgttattaatccactgcctttactgagtgctgaatatcccttcacagacctggaagaggcgctacgtttcgccggtgataaaacccaggcagcaaaagtccagcttgttttctaagagataaataaaggaataatacaatgaacgatctattttcactggcaggaaaaaatatcttgattaccggttcagcacagggcattggctttttactggcaaccggcctgggtaaatatggcgcacaaataattattaatgatattactgccgaacgcgcagaacttgctgtagaaaaactccaccaggagggtattcaggccgttgccgcaccttttaatgttactcataaacatgaaattgatgccgccgttgaacatatcgaaaaggacatcggccccattgatgtgctggtgaataacgccggtatccagcgccgtcatccttttactgagttccctgaacaagagtggaatgatgtgatcgcagtaaaccagaccgccgtgttcctggtatcgcaagcggtaactcgtcacatggttgaacgcaaggcaggtaaagttattaatatttgctcgatgcaaagcgaactgggacgtgacaccatcaccccttatgccgcatcgaaaggggcggtaaaaatgctcacccgcggcatgtgcgtcgagctggcgcgccacaatattcaggtcaacggtattgcgccgggctatttcaaaacagaaatgactaaagcactggttgaggacgaagccttcaccgcctggttgtgcaaacggacccccgccgcacgctggggagatccgcaggaactgattggtgctgcggtgttcctttcttcaaaagcctctgatttcgtaaacggccacctgttgtttgttgatggcggcatgttagtggctgtttaacacctactaccctacgtgcagcgcgaaagcgctgcttttctggcactaataagagataaagactatgccattaatcattattgcggcaggcgtcgcgctgcttcttatcctgatgatcggctttaaagttaacggctttattgccctcgttctggtcgctgccgtcgtcggatttgccgaagggatggatgcacaggccgtcctgcactctatacaaaatggtatcggcagcacgctcggcgggctggcaatgatcctcggtttcggggccatgttaggcaagctgatttctgatacgggtgcggcacaacgtatcgccactacgctgattgccacttttggtaaaaaacgcgtgcaatgggcgctagtgatcaccggtctggttgtgggcctcgccatgttttttgaagtgggctttgtcctgctgttgccgttggtatttaccatcgtggcatcatctggattacccctgttgtatgttggcgtaccgatggtagcagcgctctctgtaacccactgttttctgccgccacatccagggcctactgccatcgcgactatctttgaggctaatctcggaacgactttactgtatggatttatcattaccattccgacagttattgtcgcaggaccgctgttttctaaactgctaactcgctttgagaaagcaccaccggaaggcttatttaatcctcatctgtttagcgaagaggagatgccctccttctggaacagtattttcgctgccgtgatcccggtcatcctgatggctatcgccgccgtttgtgaaattacgttaccgaaaactaacaccgtgcgcctcttctttgaatttgtcggtaaccctgccgttgcgctgtttattgccattgttattgcgattttcacactgggccgacgtaatggacgcaccatcgagcaaatcatggatatcattggggattctataggcgctatcgcgatgattgtgtttattatcgctggcggcggcgcgtttaagcaggtattagtagatagcggtgtcgggcagtatatttcacacttaatgaccggaactacactttcgccgttattgatgtgctggactgtcgcggcgctgttgcgtatcgctctgggctctgccaccgtcgcggccattaccaccgcgggtgtggtgttgccgattatcaacgttacccatgccgatcccgctttaatggtactggcaaccggtgcgggcagcgtgatcgcgtcacacgtaaacgaccctggcttctggctatttaaagggtattttaatctgacggttggtgaaacgttgcgtacctggacggtgatggaaacccttatttctattatgggtttgctgggcgtgttagccattaacgtcgtattgcactgaaagaataaaatattgtgatgtagtttcgggggaagattgaagattcccccgacgttgggagaagttatgcgcaatcacagaatttctttacaggatatcgctacgctggctggcgtaacaaaaatgaccgtgagtcgttatatccgctcgccgaaaaaggtggcaaaggaaacaggcgagcgcatcgccaaaattatggaagagatcaattatatccctaatcgcgctcccggcatgttgttgaatgcacaaagttataccctcggtatcttgattccgtcatttcaaaatcaactcttcgctgacattctcgcgggaatagaatccgtcacctctgtgcataattatcagaccattattgctaattacaattacgatcgcgattccgaagaagagtcggtgattaacctgctctcttataacattgacgggattattctttcggaaaaatatcacaccatcaggacggtgaaatttctgcgttcagccaccattccggtcgtggaattgatggatgtacagggagaacggctggatatggaggtcggttttgataatcggcaggctgcttttgacatggtgtgtaccatgctggataagcgagtcaggcgcaaaattctgtatctcggttccaaagatgacacccgcgatgaacagcgttatcaggggtattgcgatgcgatgatgctgcataatctttccccattacgcatgaatccacgcgccatctcatccattcatttaggaatgcagttaatgcgtgatgcccttagcgcaaacccggatttagacggtgtattttgcaccaatgacgatattgcgatgggtgcgcttctgctgtgccgcgagcgaaacctcgccgtgccagaacaaatttccattgcgggttttcatgggctggagattggcaggcaaatgatcccaagcctcgccagcgtaattactccccgttttgatattggtcggatggccgcccaaatgttgctgagcaaaattaagaataacgatcacaaccacaacactgttgacctcgggtatcagatttatcacggtaacacgctttaggttattttctctgcattacacatattctctttgccggacgttgcctatactccaggcaggaaactggaggaaatctcatgagcgaacccctgttaattgcccgcacgccggacacagaactgtttttactgccgggaatggctaaccgccatgggctgattaccggcgcaacggggacgggtaaaaccgttacgctgcaaaaactggcggagtcattgtcggaaatcggcgtgcctgtgtttatggctgatgtgaaaggtgatttaacgggagttgcggaggaaggtacatcttcggaaaaactgctcgcaaggcttaaaaatatcggcgtaaatgactggcaacctcatactaatccggtggtggtgtgggatatctttggcgagaaaggccatccggtgcgggcgacggtttcggatctggggccgctgttgctggcacgactgttgaatctcaacgatgtgcaatctggcgtgctgaatatcattttccgcattgctgacgatcagggattgttgctgctcgactttaaagatctgcgggcaattacccagtacatcggcgataacgccaaatccttccagaatcagtacggtaatatcagtagtgcatcggttggtgccatccagcgcgggctgttgtcgctggaacagcaaggcgcagcacacttctttggtgagccgatgctggatatcaaagactggatgcgcaccgatgccaacggtaaaggcgttatcaatatcctcagcgccgagaagctctaccagatgccgaaactgtacgccgccagcctgctgtggatgctttcagagttgtatgaacaattgccggaagcgggcgatctggagaaaccaaaactggtgtttttcttcgacgaagcgcatctgctgtttaacgatgcaccgcaggtactgctggataagattgagcaggtgataaggcttattcgctcaaaaggcgtgggcgtctggttcgtttcgcaaaacccgtcagatatcccggataacgtgctcgggcagctcggtaatcgcgttcaacacgctttgcgtgcttttacgcctaaagatcagaaagcagtgaaggcagcggcgcaaaccatgcgggccaatccaacatttgataccgaaaaggcaatccaggaactggggacgggcgaagcgttaatctcgtttctcgatgcgaaaggaagcccttcagtggtggaacgggcgatggtgattgccccctgttcacgaatggggccggtgacggaagatgagcgcaatggcttgattaaccactccccggtgtatggcaagtacgaggatgacgtggaccgggaatccgcctatgagatgttgcaaaaaggctttcaggccagtatcgagcagcaaaataatcctcccgcgaaagggaaagaggtggcggtggatgacggtattctcggtggattgaaggatattttgtttggcactaccggaccacgcggcgggaagaaagatggtgtggtgcaaacaatggcaaaaagcgccgcccgccaggtgacgaatcagattgtgcgcgggatgttggggagtttgctgggggggagaagaaggtaagccaggtgcgatttgtctttgcctgatgcgacgctggcgcgccgcatcaggcctacactactgcaatatattgaattttcatgatctttcaggcatgaacgaaacacactttgctaacaataataaagggagctttcgctccctttattcgttcattcggttacgattttctcattaacagccacaggctgattaagaagaagctggcgcttggcaacagtgcgccgatgatcggcgggatgccgtaaaccaacgtcagcgggccgaagatctggtccagtacgtagaagacaaaaccgaagctaataccagtgaccacacgcacgcccatcggtacgctacgcagtgggccaaagatgaacgacagcgccatcagcatcatcaccgccacggatagcggctggaagattttgctccacatgttgagctgataacgtccggcatcctgaccgctcgacttcagatacttcacatagttgtgcaaaccgctgatagagagtgcatccgggtccagcgccaccacgcccagtttgtctggcgtgaggttggttttccaggtgccgctcaccgtctgcgaaccggtgatctgtttcggattggtcaaatcagattcatcaacctgcgacagacgccagactttatgttccgggtcaaacttcgcggcagcggcatagcgtacggattgcagacgacgattctcgttaaaggcataaatactgatgccacctaactcttcgtcacctttaacccgctcaatgtagacgaagttgttgccatctttcgcccataaaccttgctgggtagagagcaacgagccgccgtacatcgcctgcgcacggtagttacgcgccatctgctcgccctgcggcgcgacccattcaccaatcgccatcgtcagcaagaccagcggaatggcggttttcatcaccgacagcgccacctgcatacgggtaaaaccagaagcctgcatcaccaccagttcgctgcgctgcgccagcatcccaagaccaagcaacgccccaagcagagccgccatcgggaagaagatttgcacatctttcggcacgctcagcaaggtatacattcctgcgcctaacgcgtcgtaactcccctgcccggcttttttcagctgatcgacaaacttgataatgccggacagcgacaccagcatgaacagcgtcatcatgatggtggtgaaaatagttttaccgatatagcggtcaagtacgccaaaaggttgcatcacaccgctcctttacgcgaaaaactggcgcgcaggcggcggaccggcacggtgtcccaaaggttgagaacaatcgccaaagccagataaatcaggttaacggtccacatccacagcgtcgggtccagcttacctttaccgccgttcgatttcagggaggtctggatcaggaagaacaacagatacagcagcatggctggcagcatcgatagtacgcgcccctgacgcgggttaaccacgctcagcggtacgaccataagtgccatcataaacacggtgaacaccaacgtgatacgccagttcagttctgcgcgagcacgatcggtgtcagtgttccacaatgtgcgcatgtccatctggtcggtatcgttcgggtcgagcgccaccgcctggtgaccaatgatcgcctgataatcctggaaatccgtaatgcggaaatcacgtaacagtgcagtgccttcgaagcgcgttccctggttgagagtgacgacctgggagccgtcgcgcagctgggttaaatgtccggaatcggccaccaccacagaaggtcgtgcattaccttttggtcgaatttgcgcgaggaacacatctttgaaatcgctgccgtcaacgctttcgatgaacagcaccgagctgccattagtcgcttgctggaattgcccttgcgccagcgccgccatgccagggttcgctttcgcttctgctaacacttcatcctgatgacgcgatgaccatggtcccgcccacatcacgttaaccgccgcgacgattgccgtgaacaccgcaaggatcattgccgctttcaccagcaccgctttgctcagaccgcaggcatgcattaccgtaatttcactttcggtatacagtttgcccagcgtcatcagcagcccgaggaacaggcttaatggcaggataagctgcgccatttccggcacgcccaacccgagaagggagagcaccaagttcgccggaatatcgccgtcaaccgctgcgccgaggatcctcactaacttttgacagaagaagatcaaaagcaagatgaagagtatcgccagctggcttttgagcgtctcccgcaccagatatcttatgattatcactttaaatacgcccgtaaaaactcgtcttttgcaggattttagcttgtttcatggcttaaacgtcatttattctcttgagtcgtcgaaatcgtcgctaagataattatactcaacggattcacctctcagattttgttctgacgtgccaatgccgtaataacgttaagattaacacgaagtcatcgcaacagcggacatgagttacgaaagcttgcaattctatctgtagccaccgccgttgtctttaagattcaggagcgtagtgcatggagtttagtgtaaaaagcggtagcccggagaaacagcggagtgcctgcatcgtcgtgggcgtcttcgaaccacgtcgcctttctccgattgcagaacagctcgataaaatcagcgatgggtacatcagcgccctgctacgtcggggcgaactggaaggaaaaccggggcagacattgttgctgcaccatgtgccgaatgtactttccgagcgaattctccttattggttgcggcaaagaacgtgagctggatgagcgtcagtacaagcaggttattcagaaaaccattaatacgctgaatgatactggctcaatggaagcggtctgctttctgactgaactgcacgttaaaggccgtaacaactactggaaagtgcgtcaggctgtcgagacggcaaaagagacgctctacagtttcgatcagttgaaaacgaacaagagcgaaccgcgtcgtccgctgcgtaaaatggtgttcaacgtgccgacccgccgtgagctgaccagcggtgaacgcgcgatccagcatggtctggcgattgccgcagggattaaagccgcgaaagatctcggcaatatgccaccgaatatctgtaacgctgcttacctcgcctctcaggcgcgccagttggctgacagctacagcaagaatgtcatcacccgcgttatcggcgaacagcagatgaaagagctggggatgcattcctatctggcggtcggtcagggttcgcaaaacgaatcgctgatgtcagtgattgagtacaaaggcaacgcgtcggaagatgcacgcccaatcgtgctggtgggtaaaggtttaaccttcgactccggcggtatctcgatcaagccttcagaaggcatggatgagatgaagtacgatatgtgcggtgcggcagcggtctacggcgtgatgcgtatggtcgcggagctacaactgccgattaacgttatcggcgtgctggcaggctgcgaaaacatgcctggcggtcgtgcctatcgtccgggcgatgtgttaaccaccatgtccggtcaaaccgtagaagtgctgaataccgacgccgaaggccgcctggtactgtgcgatgtgttaacttacgttgagcgttttgagccggaagcggtgattgacgtggcgacgctgaccggtgcctgcgtgatcgcgctgggtcatcatattactggtctgatggcgaaccataacccactggcccatgaactgattgccgcgtctgaacaatccggtgaccgtgcatggcgcttacctctgggcgacgagtaccaggaacaactggagtccaattttgccgatatggcgaacattggcggtcgtcctggtggggcgattaccgcaggttgcttcctgtcgcgctttacccgtaagtataactgggcgcacctggatatcgccggtactgcctggcgttctggtaaggcgaaaggcgcaaccggtcgcccggtggcgttgctggcacagttcctgctaaaccgcgccgggtttaacggcgaagagtaattgcatcaggctgtgttgttattgtcggatgcggcgtgaacgccttatccgacctacacagcactgaactcgtaggcctgataagacgcgacagcgtcgcatcaggcaaggctgttattgtcggatgcgacgtgaacgccttatccgacctacacacagcacttaacttgtaggcctgataagacgcggcagcgtcgcatcaggcgctgcggtgtatacctgatgcgtatttaaatccaccacaagaagccccatatatgaaaaacgcaacgttctaccttctggacaatgacaccaccgtcgatggcttaagcgccgttgagcagttggtgtgtgaaattgccgcagaacgttggcgcagtggtaagcgcgtactcatcgcctgtgaagatgaaaagcaggcttaccgactggatgaagccctgtgggcgcgtccggcagaaagctttgttccgcataatttagcgggagaaggaccgcgcggcggtgcgccggtggagatcgcctggccgcaaaagcgcagcagcagcccgcgcgatatattgattagtctgcgaacaagctttgcagattttgccaccgctttcacagaagtggtagacttcgttccttatgaagattctctgaaacaactggcgcgcgaacgctataaagcctaccgcgtggctggtttcaacctgaatacggcaacctggaaataatggaaaagacatataacccacaagatatcgaacagccgctttacgagcactgggaaaagcagggctactttaagcctaatggcgatgaaagccaggaaagtttctgcatcatgatcccgccgccgaacgtcaccggcagtttgcatatgggtcacgccttccagcaaaccatcatggataccatgatccgctatcagcgcatgcagggcaaaaacaccctgtggcaggtcggtactgaccacgccgggatcgctacccagatggtcgttgagcgcaagattgccgcagaagaaggtaaaacccgtcacgactacggccgcgaagctttcatcgacaaaatctgggaatggaaagcggaatcaggcggcaccattacccgtcagatgcgccgtctcggcaactccgtcgactgggagcgtgaacgcttcaccatggacgaaggcctgtccaatgcggtgaaagaagttttcgttcgtctgtataaagaagacctgatttaccgtggcaaacgcctggtaaactgggacccgaaactgcgcaccgctatctccgacctggaagtggaaaaccgcgaatcgaaaggttcgatgtggcacatccgctatccgctggctgacggcgcgaaaaccgcagacggtaaagattatctggtggttgcgactacccgtccggaaaccctgctgggcgatactggcgtggccgttaacccggaagatccgcgttataaagatctgattggcaaatatgtcattctgccactggttaaccgtcgtattccgatcgttggcgacgaacacgccgacatggaaaaaggcactggctgcgtgaagatcaccccagcgcacgactttaacgactatgaagtcggtaaacgtcacgccctgccgatgatcaacatcctgacctttgacggcgatatccgtgaaagcgcccaggtgttcgataccaaaggtaacgaatctgacgtttattccagcgaaatcccggcagagttccagaaactggagcgttttgctgcacgtaaagcagtcgttgctgcggttgacgcgctcggcctgctggaagaaattaaaccgcacgacctgaccgttccttatggcgaccgtggtggcgtggttatcgaaccgatgctgaccgaccagtggtacgtgcgtgccgatgtactggcgaaaccggcagttgaagcggttgagaatggcgacattcagttcgtaccgaagcagtacgaaaacatgtatttctcctggatgcgcgatattcaggactggtgtatctctcgtcagctatggtggggtcaccgtatcccggcatggtatgacgaagcgggtaatgtttatgttggccgcaacgaagacgaagtgcgtaaagaaaataacctcggtgctgatgttgcgctgcgtcaggatgaagacgttctcgacacctggttctcctccgcgctgtggactttctctacactcggctggccggaaaacaccgacgcactgcgccagttccacccaaccagcgtgatggtatctggttttgacatcatcttcttctggattgcccgcatgatcatgatgaccatgcacttcatcaaagatgaaaatggcaaaccgcaggtgccgttccacaccgtttacatgaccggcctgattcgtgatgacgaaggccagaagatgtccaaatccaaaggtaacgtgattgacccactggatatggttgacggtatttcgctgccggaactgctggaaaaacgtaccggcaatatgatgcagccgcagctggcggacaaaatccgtaagcgcaccgagaagcagttcccgaacggcattgagccgcacggtactgacgcgctgcgcttcaccctggcggcgctggcttctaccggtcgtgacatcaactgggatatgaagcgtctggaaggctaccgtaacttctgtaacaagctgtggaacgccagccgttttgtgctgatgaacacggaaggtcaggattgcggcttcaacggcggtgaaatgacgctgtcgctggcggatcgctggattctggcggagttcaaccagaccatcaaagcgtaccgcgaagcgctggacagcttccgcttcgatatcgccgcaggcattctgtatgaattcacctggaaccagttctgtgactggtatctggagctgaccaagccggtaatgaacggtggaacagaagccgaactgcgcggtactcgccatacgctggtgactgtactggaaggtctgctgcgcctcgcgcatccgatcattccgttcatcaccgaaaccatctggcagcgcgtgaaagtactttgcggtatcactgccgacaccatcatgctgcagccgttcccgcagtacgatgcgtctcaggttgatgaagcggcactggccgacaccgagtggctgaaacaggcgatcgttgctgtacgtaacatccgtgcagaaatgaacatcgcgccgggtaaaccgctggagctgctgctgcgtggttgcagcgcggatgcagaacgtcgcgtaaatgaaaaccgcggcttcctgcaaacgctggcgcgtctggaaagcatcaccgtgctgcctgctgatgataaaggtccggtttccgttacaaagatcgtcgacggcgcagaactgctgatcccgatggcaggcctcatcaacaaagaagatgagctggcacgtctggcgaaagaagtagcgaagatcgaaggcgaaatcagccgtattgagaacaagctggcgaacgaaggctttgtcgcccgcgcaccggaagcggtcatcgcgaaagagcgtgagaagctggaaggctacgcagaagcgaaagcgaagctgattgaacagcaggctgttatcgccgcgctgtaatactcatagtgaaaacgaaggccggagcatgctccggcctttttatttagataaacggaacatacggcataataccgcgagatatccacattaacgaaccgctatcctgcggtttgtcatcattggttaactccagcgaatcaaggtcgccctggacatgggtattgttagcaatccagctaaccatccacattttcagccagggataagccagaccacaggtaattgaggaccccattaataccgccaacatgcgcagaagcataccgatcgcggtaacagatgaatgaaaacgaattgtcccatttgccagcgtcagattattcaaaaacagattgcgtaacgtgacatagagataactggcaaaaacaaggatcgcgacaaaatacaggaaataagaagccataatctgcgggtaatattgtaatacaaactcactgccagcatcagacctacccaacatggtcatcatcattaactgctggaatactggtgcgatcataataccaatcacaatgatgaaaggaaccatggttaatattgcgagcatgcaacctttaatgcattcttttacgtttacctgaatagaaaacttatgaatgccaaaagttgcattattacccagcaatggcatccatttactataggttataccatggacaacacctagcccgatggcagaaagcaaacttaatgcgactaagttaaagaataaccctcctatcgatgtcgtcacttgtgcaataagatacagtgcgaaccaaaaaactaacgccaacagaacaggcagtcctagcataacccaccatgcacgcatcattgagcagttaaagccaaagcgaatgtcattcagtgaggtcatgttcgcctgatactgcagactcttcactgccatacaaggaataccgcagatcaagagagcaaacaggaataaaccgagcgcaaagtgttgacctgcaaaacaagaaatactgagaagataaaccaccacaataagtaacatgctaacaaaaatggcaccacctgttcccttataactaaatggttgccccttgagtgtcacatgttgataaatataacgacggcattttatcaatgcccacggtccatatattcccagagtaataattgtcagtgaaaaattcacaagacaaataagaaaatactcaccacctttgcctgtgaaaacaaacgagtgccgagaattatctttcccgatgtttacatcattcatgaactatatccctaaaataaattccattcataccgataataattccagtcaattgatactggttcgcctagaatacgctttatctcagagagatatgcgtaatattttctgatttatcttcttcttgcaccacctaagcgagggtggtattaaagtgagctataaatcatacatttgaaattgagctatgctatgaatgttgtcgcttctcccgcactccgtttgcgcaaacttaccgtcgccgataatcctgctatcgcccacgtcattcgtcaggtatccgccgaatacggtcttaccgctgataaaggctacaccgtcgccgatccgaaccttgacgagctgtatcaagtatatagtcagcctggccacgcatattgggtggttgagtacgagggtgaagtggtcggcggcggtgggattgcgccattaaccgggagtgagtcagacatttgcgaactgcaaaagatgtattttcttccggctatccgcggcaaagggctggcaaaaaaactggccttaatggcaatggagcaggcgcgagaaatgggtttcaaacgctgctatctggaaacgaccgcttttttaaaggaagccattgcgctttatgagcatttgggctttgagcatatcgactatgcgcttggctgcacgggtcatgtcgattgtgaagtacggatgctacgcaaactttgaaaaatgcccgcgagcttagactcgcgggcattcgaacattaaccacgtgctttttgagtatgcaggatgtgacgtaaatgccttatccgggctacaaattcaccaggttgcaggaactacctgggcctgatatgcgtagcgcatcaggtaacgcagcctttgtcgtcaacgcttaattagtgacgaataccgtcatcgtcttcatcgacaaaatcttcatcgtcgccgtcttcgccgttaggatcttcaaagtaagtgccccaaccatcgtactcaacgtcaaatttctccgccagcgtcatcagttgttcaacctgggcatcgatcaggtcggcattcaacgcacactcgctgaggatgtcgcagcaaatcacgatgtcaccatcttcaacttccagctcttctggatcggtcacttcgtaaccgagtttaaacgcttcaactgctgctttttccagggtttccagatcgtctgcggaaagatggtgttcgatggtgtacagcgcgtccggatcgctgccatcttccagtaattcttcaataatcaaacgtgtttcttcacgctgttcttccagttgttccgggtttgccatggctcattcctcttaatgtcctgccgatactcttattgtcacacaccactgacattgcctccacctttgtgacaaagatttatgctttagacttgcaaatgaataatcatccatatagattgaattttaattcattaaggcgttgaccacaggagggatctatgtccgggttttatcataagcatttcctgaaattactcgatttcacgccagctgaactcaacagcttgttgcagttagccgcgaagctgaaagccgataagaaaagcggtaaagaagaagccagactcactggcaaaaacatcgcgctcatcttcgaaaaagactcgacccgtacccgatgctctttcgaagttgccgcatatgaccagggtgctcgcgttacttatctcggcccaagcggcagccagattggtcacaaagagtcgattaaagacactgcccgcgtgcttggtcgcatgtatgacggtattcagtatcgcggctatggtcaggagattgtcgaaacactggcggaatacgctggcgtgccagtatggaacggcctgaccaatgagttccaccccacgcagctgctggcggatctcctcaccatgcaggagcatttgcccggcaaagcattcaacgaaatgacgctggtctatgcaggtgacgcgcgtaacaacatgggcaattcgatgctcgaagctgcggcgcttaccggtctggatttgcgtctggtcgcgccacaggcatgctggccggaagctgcgctggtcgccgaatgcagtgctctggcacaaaaacacgggggtaaaatcaccttgacggaagatatcgcctctggggttaaaggtgcagactttatctataccgatgtctgggtatcgatgggtgagcccaaagagaaatgggcggagcgtattgccctgctgcgtgactatcaggtgaatagcaaaatgatggccctgaccggtaattcgcaggttaagttcctccactgtctgcctgcatttcatgatgagcaaaccacgctgggtaaaaaaatggccgcagaattcggtctgtatggtggaatggaagtcaccgatgaagtctttgaatctccggcaagtattgtctttgaccaggcagaaaaccggatgcacaccataaaagctgttatggtcgctacattagcaaaataacgttttgccgggcggcggcacaggtcgccccccggcagtgatcacttacgattttaatagcttaactactgctttccgtacctgagcgggggctcccaccgcacaaagcggtttgtgaacttcgccaggatagaaaacgacaaaatccccttcattaagaatcactgttttttcatcgatcccctgcccgataaaagcaatatctttatctgccagccagtcagtctctggtacgcctgctggttgcgtgctaaatgtcatcccttcctgcccttttaatacaatctggatatcgagataacgagcatgatactcagcacgacgcagttcacctggttcagtcgtatcctcagaaatcagataaaacaggcggtcgccgtcaatagcgtgcttaccttttgctgtctcatcgctgacatgtgatttgatgtactcaattgcttcgcgaagttcttccggcagccaggattgtaagtgatggatgttgccaacaatcataatatcttcctttattaaaacaatgtttcacttctttccttatacgaaaaaaagccacctctcaccatagaaaaatcatcaggttttgcccttgcgcatgtttattgctggagatgttgtactgatgttaagcaggagtaattttgtatgcagttttgctgcataaatcttataacttagctatgtattttggtcctaatatcttgttattgcatatgttaaaagaaaactctcagtcagatcacagttcattttcttagcttttaatgcccgtgctgtcatagttatcccgtgaaaatagtgctgtgaaaaataatcaccttattctttcgcatagatatgcaatgaatattaaaatatacataaatatcaatgctttatacttaaaggcatttcctgaaaaataaaacaatcaattaacaacgaagaataactctgcgtatatttgcgtattaatgcattatcgtattttgtttctttatcatttatcagaaccgcatcaaatattattaactgcgattattaatatcatcactggtgtgaaagtcgtcacattttctggaagaaataaactgaatcattgcatctgaaaattactgaacagacctgactacaagcatttaatttgtttgcagccatctcctctttatttttgaaaaagtgttaaaggaataatgatggaaaagcattatgttggttctgaaattggacaactacgcagcgttatgttgcatcgcccaaatctcagtctgaaacgtctaacaccatccaattgccaggagttgttatttgacgatgtattgtccgttgagcgggcaggtgaagagcatgatattttcgccaatacgctgcgccagcaagggatagaagttctgttactcactgatttactaacacaaacattggatatcccggaagccaaaagctggttactggaaacacaaatatcagattaccgactcggccctacgtttgctactgacgttcgcacctggcttgcagagatgtcacaccgggaccttgctcgtcatttaagtggtgggctgacttatagtgaaattcccgcctcaattaaaaatatggtggttgatacccacgatattaatgatttcattatgaagccgttaccgaatcatttatttacgcgtgatacctcatgctggatttataacggtgtatcgattaatccaatggcaaaacctgctcgccaacgtgaaaccaataatctacgcgctatttatcgctggcatccacaatttgctggcggcgaatttattaaatatttcggcgacgagaatattaattatgaccacgccacgttagaaggtggtgatgtgctggtgattggtcggggggccgtgttgatcggcatgtctgaacgcaccacgccacaaggaatcgagtttcttgctcaggcattgtttaaacatcgtcaggctgaacgggtaatcgctgttgagctgcctaaacaccgctcctgtatgcatcttgacaccgttatgactcatatcgatatcgacaccttctcggtttatcccgaagttgtgcgcccggatgttaattgctggacgctaacacctgacggtcacggcggcctgaaacgtactcaagaaagcacactcctccatgctatcgaaaaagccctcggtattgaccaggtacgtttaatcaccacggggggtgatgcctttgaggcagaacgcgaacagtggaatgacgctaacaatgtgctcacgcttcggccgggagtggtagtgggctacgagcgcaacatctggactaacgaaaaatatgacaaagcaggcatcaccgttttacccatccccggtgatgaattaggccgcggacgtggcggcgcacgttgcatgagttgccctttgcatcgtgacggtatctaaggaagagatcatggaaaacaaaccaacactggttatcgctctcggcggtaatgccctgcttaaacgaggcgaaccactcgaagcagaaatccaacgtaaaaatatcgatcttgcggctaaaactatcgcccaactgactcaacactggcgggttgtactggttcacgggaatggtccacaagttggacttctggcacttcaaaatagcgcctatgcccatgtcgctccctatccactcgacattctgggggccgaaagccaggggatgatcggctacatgctacaacaggcgctgaaaaatcaactaccacaacgtgaaatcagcgttctgctgacgcaggttgaagtggatgccaacgatcccgccttcagtaacccaactaagtacatcggcccaatttatgaccacgctcagactcaggtactacaggcagaaaaaggctgggttttcaaagcagatggtcactctttccgccgggtcgtaccttctccacaacctaaacgcatcgtcgagcgggatgccatccagacactgatcgcccacgatcatctggtgatctgtaatggtggcggtggtgttccggtggttgaaaaagccgatggataccatgggattgaagcggttatcgacaaagatctttcagccgcgctactggcaagtcagatccatgctgacgccttgttgatcctcactgatgcggacgcagtatatctcgactggggcaagccaacccaacgcccgctggcccaggtcacgccggaattactcaacgaaatgcagtttgatgccgggtctatggggccgaaagtcaccgcctgcgcaaagtttgttagtcagtgccggggcattgcagggatcggctctcttgcagatggtccggaaattctcgccggagacaaaggcactcttattcgccttgatacccccataaccacgcttgatccatttttataaggacatccccatggctacttcactgaaaaaccgtaattttcttaagctgcttgattacaccccagcagagattcaatacctgattgatttggctatcaatcttaaagccgccaagaaatctggaaacgaaaaacaaacgctggtcggtaaaaacattgcgttgatttttgaaaaatcctctacccgtacccgctgtgcctttgaagtcgcggcctttgatcaaggtgcgcaggtgacttacatcggccccagcggctcacaaatcggccataaagaatcaatgaaagataccgctcgcgtactcggacgcatgtatgacggtattgagtatcgcggttatggtcagaatatcgttgaagaattaggtgagttcgctggtgttccggtatggaacggactgaccaatgaatttcacccgacacagatcctcgcggatttaatgaccatgctggaacatgcgccaggcaaaacgctgccagagctgagctttgcgtatcttggtgatgcccgaaataacatggggaactcgctgatggttggtgctgcaaaaatggggatggatatccgtctggtggcaccaaaatctttctggccagatgaagcgctggtaacacaatgccgtgagatcgccagcgtgactggggcgagaatcaccctgacagaggatgtggaagaaggcgtatacgacgttgattttctctatacggatgtttgggtttcgatgggagagccaaaagaagcctgggcagaacgagtgagtcttatgacaccttatcagatcaatcaacaggtgattactgccacgcgtaaccctgaagtcaaatttatgcactgcctgcccgccttccataatgagcacaccacagtaggacgcgagatcgagatggcctacggcctcaaaggactggaagtaactgatgaggtttttgaatctgcccactccattgttttcgatgaagcagaaaaccggatgcacaccattaaagcggtgatggtagcaactctcggcgactaaccctgacgggcatgcgtcgacgagtggcgtatgcccgtgattatggagatcacattatgggtaaattcaaatttcccaccgcttataccatcttgttcgtgctgattgcgttagttgcggcaatgacctggattgtacctgcgggaaaatatcagatggcgacaaatgccgcactgggaaaggaagttcctgttgcaggcacttacgcacctgttgaggcgcaaccacagggtattacggctgtcctgttagcgcccatcgacggcttgtacaaccatcaaacctacactgcgggagcgattgatgtcgcgctgtttgtcctgatcatcggtggatttttgggagtagtaaataaaaccggagcaatagatgccggtatcgaacgagtgacaactcgccttaatggtcgggaagagtggatgattccgatcctgatggcgctcttcgctgctggcggtactatttatgggatggcggaagaatcactccccttctacacgttgctggtgcccgtcatgatggctgcccgctttgatcctctggtcgctgccgccacagtgttattgggatcgggcattggcacgctgggctcaaccattaacccatttgctaccgtcattgctgccaacgccgcagggatcccctttactcagggcattttgctgcgtgttattttgctgttagtaggctacgtgatttgtgtttactgggttatgcgttatgcccgcaaagttcgcaacagtccggaaagctctatcgtggcggataagatggctgaaaaccaggcgcattttctgggaaatcgttcagaaacgatgctggaatttacccccacgcgcaaagcgatcctgatactttttgctgcatcctttgcctttatgatttacggcgtagcggtactgggttggtggatggcggaaatctctgctgtctttctggcagctgcggtcatcgtgggtgtcattgcccgcatgggcgaagaaaccttcaccagtacctttattgacggcgcgcgggatctccttggtgtggcactgattatcggcatcgcccgcggtattgtggtcgtgatggataacggcatgattacgcacacaattctgcacagtgctgagaatctggtttcagggctttccaccactgttttcatcaacgtgacctattggctggaagtattgctctcttttctggttccctcatcttccggccttgcagtgttaacgatgccaataatggctccactcgctgattttgctcatgtacaacgcgatctggtggtgaccgcttatcagtctgcttccggggtggttaatttgattacgccaacctctgcggtagtgatgggcggtctggcgattgcccgtgtaccctgggtccgttatctgagatgggtagcaccgctactgctgattctcacgatgttgaatatgattgtgctgagtatcgccgcgatgatttaacgcgacaggccgcttatcaaagcggccttcaaatctggtgtagtgataaatgaaccactctcacattataaaatgtgaaaaatatcatcaggtaataataaataaaaggtgcattatgaaggaatacgatgattactccgccaaagaaaagaagcaactggcggtctgtcagcgcctgattaccgaaaaaagttatctttcacaggaggaaatccgccgcgatttgcaaaaccatggctttgacagtatcagtcagtcaaccgtttcacgactactgaaattgctgggagtcataaaaattagaaatacaaaaggacaaaaaatttattcggtgaatcctcaattacttcccacacctgacgcaggtcgatccgtcgctgaaatggtcctgagtgtcgagcataatggtgaatttatccttatccataccgtcgccggatatggtcgggcagtagcacgaatccttgatttccatgctttgccagaaattcttggcgtgattgctggcagcaatatcgtttgggtcgcaccacgtgtggtaaagcgtacagccctggtgcacaagcaaattaattacttattaaaattgaatatatattcatgataaccgtttgccttgctttataactgcatcatcttcttgatcctctctcagagctgagtataatgccggacaatttgccgggaggatgtatggttcagtgtgttcgacattttgtcttaccgcgtctgaaaaaagacgctggcctgccgtttttcttcccgttgatcacccattcccagcccctcaatcgaggggcttttttttgcccaggcgtcaggagataaaagatggctaatccgctatatcagaaacatatcatttccataaacgaccttagtcgcgatgaccttaatctggtgctggcgacagcggcgaaactgaaagcgaacccgcaaccagagctgttgaagcacaaagttattgccagctgtttcttcgaagcctctacccgcacccgcctctctttcgaaacttccatgcaccgcctgggtgccagcgtggtgggcttctccgacagcgccaatacatcactgggtaaaaagggcgaaacgctggccgataccatttcggttatcagcacttacgtcgatgcgatagtgatgcgtcatccgcaggaaggtgcagcgcgcctggccaccgagttttccggcaatgtaccggtactgaatgccggtgatggctccaaccaacatccgacgcaaaccttgctggacttattcaccattcaggaaacccaggggcgtctggacaatctccacgtcgcaatggttggtgacctgaaatatggccgcaccgttcactccctgacccaggcgctagcgaagttcgacggcaaccgtttttactttatcgcgccggatgcgctggcaatgccgcaatacattctggatatgctcgatgaaaaagggatcgcctggagtctgcacagctctattgaagaagtgatggcggaagtagacatcctgtacatgacccgcgtgcaaaaagagcgtctggacccgtccgagtacgccaacgtgaaagcgcagtttgttcttcgcgccagcgatctccacaacgccaaagccaatatgaaagtgctgcatccgctgccgcgtgttgatgagattgcgacggatgtggataaaacgcctcacgcctggtacttccagcaagcaggcaacgggattttcgctcgccaggcgttactggcactggttctgaatcgcgatctggtactgtaaggggaaatagagatgacacacgataataaattgcaggttgaagctattaaacgcggcacggtaattgaccatatccccgcccagatcggttttaaactgttgagtctgttcaagttgaccgaaacagatcagcgcatcaccattggtctgaacctgccttctggcgagatggggcgcaaggatctgatcaaaatcgaaaatacctttttaagtgaggatcaggttgatcagctggcgttatatgcaccgcaagccacggttaaccgtatcgacaactatgaagtggttggcaaatcgcgccccagtctgccagagcgcatcgacaatgtgctggtctgcccgaacagcaactgtatcagccatgccgaaccggtttcatccagctttgccgtgcgaaaacgcgccaatgatatcgcgctcaaatgcaaatactgtgaaaaagagttttcccataatgtggtgctggccaattaattgcggttggtaataaaagtctggctccctataatgagccagactttttaccgctgtaataaaggagaaatcatgagcaaaactatcgcgacggaaaatgcaccggcagctatcggtccttacgtgcagggcgttgatctgggcaatatgattatcacttccggtcagatcccggtaaacccgaaaacgggcgaagtcccggcagatgtcgctgcacaggcacgtcagtcgctggataacgtaaaagcgatcgtcgaagccgctggcctgaaagtgggcgatatcgttaaaaccaccgtgtttgtgaaagatctgaacgacttcgcaaccgttaatgctacctacgaagcctttttcaccgaacacaacgccaccttcccggcacgttcttgcgttgaagttgctcgtctgccgaaagacgtgaagattgagatcgaagcgatcgctgttcgtcgctaatcttgatggaaatccgggctatcatgcccggattaagtctaatgacaaacgcaaaattgcctgatgcgctacgcttatcaggcctacgtgattcctgcaatttattgaatttgtaggcctgataaggcatttacgccgcatccggcatgaacaaagctcactttgtctgcaatctgattccgggccaccatgcccagtttattctttactgccaaccgtaacgacggctatagaaccctttcaccaactgggttaacgtcatataccctgccagaatcgcaaccagccacgggaaatagcttaacggcagcgcctgcagctgcagataactggccagcggtgaaaacggcaatgcgatcccgacaatcatcacgatcacggtcataatcattaacggccacgatgcacagctctgaataaacggtacacgacgggtgcggatcatatgcacaatcagcgtttgcgacagtaagcccaccacaaaccagcccgactggaacagcgtttgcgtttccggcgtgttggcatggaatacccaccacatcaggcaaaacgtcagaatatcgaaaatcgagctgatcggtccgaagaagaccataaagcgccccagatccgccggattccaacgctgcggcttttgaatttgctcgtcgtcgacgttatcaaatgggatcgccacctgtgacacatcgtacagcagattttgaataagcaagtgtagcggcaacatcggcaggaagggcaagaaagcactcgccaccagcacgctgaacacattaccgaagttagagctcgccgtcattttgatgtatttcagcatgttggcgaaagtgcgacgtccctcaataaccccctcttccagcaccatcaggcttttttccagcaggatgatatcagccgcttcacgggcaatatctaccgcgccgtccacagaaatgccgatatccgcagcgcgcaaggcgggcgcatcattaataccatcgcccataaagccaaccacatgcccttcgcgcttcagcaacgttacgatgcgttctttatgcatcggcgtcagacgagcaaacagcgtggtgcgctgtgcgagatttgccagttcgtcgtcagatagcgtttcaatatcactaccaatgaccacctctcccgcgtccagccccacttcatggcacactttcgctgcaaccaactcactgtcgccagtaaggatttttacggtaattccactcgcttttaatgccttcagtgccggagctgttgtctcttttggcggatcaaggaaagcaatatatccttcgaggatcaggtcggattcatccgcccgctggtaatctccttcacgcgctggcaggtatttcgtcgccaccgcaaccacgcgcagcccctgacgattcagcgtatcagtaacccgcttaatcttacgcagcatggtgtcatcgagcggtacaatctcgccattgtgacgcacttgcgaacacacattgaggatttcctgcaatgcgcctttgcaaaccaactgatggtgttcggtattttctgccacaaccaccgacatccgacgacgctcgaaatcaaatggaatctcatcaattttttgccaacggctggccagcgagcgcgctgactcttcatccgtaccttcgagcaccgctgtatcaagcaggtttttaagcccggtctggtaatggctgttcaaccacgcgctatgcagcacgcgttcgctagttttaccggagatatcggtatgattctccagcacaattttatcctgtgtcagggtgccggttttatcagtgcacagaatatccattgcgccaaagttctgaatggcatccagatgtttgacgatcactttctgtttcgacaacttgactgcgccacgcgccagcgtcgaggtaacaatcatcggcaacatttctggcgttaagcctaccgcgaccgaaagtgcgaacagtgccgcttcccaccagtcgcctttggtgtaaccgttgataagcaacaccaccggagccatcaccagcataaagcgaatcagcagcatactgacgcggctgatcccttgctgaaaggcattcggctcgctttcctgctcactaacacgccccgccagttgaccaaaccaggtgttggctcctgtagcaatcaccattgcttgtgccgtgccgctcaccacggtggtgcccataaaacacagggtgtcgcactccagcggattgctgtgctccggctggcgagtagtagcggctttttccacgggcagagactcaccggttaacgacgcctgagcgacgaacagatcccgcgcctgcaagatacgtaaatctgccgggatcatatcccctgccgccagttttataatatcgccgggcaccagctggtcgatcgggatctccagccagccattttcgcctttgtcgttaattactcgcagtaccgtcgcggtattactgaccatcg

SEQ ID NO: 9996 - DNA, 28827 bp, Escherichia coli
tcttcccgctcagcaacgcgaaccggtgggatacgcacctcatcacccgcttcgagtttatattcaggcttaatacgttttttgttcacccgcacttcgcctttacgcaaaatacggtaaatcatactttttggtacgcctttcaattgggtacgcaaaaagttgtcgatacgttgccccgcttcgtcagcggtgatagcaacaatttttacggatggagtctctgttttcatggtgggcgattctaattagccaacaggattcgcgccactcatttttctatgcttatatttagttttacaccttattacttcactaggtgatcactttattgatggttattaaaccaatcaccagcaagaagtgaaaaaactgtgagtaagcgggtgataaatggtaaaagtcatcttgctataacaaggcttgcagtggaataatgaggccgtttccgtgtccatccttgttaaaacaagaaattttacggaataacccattttgcccgaccgatcatccacgcagcaatggcgtaagacgtattgatctttcaggcagttagcgggctgcgggttgcagtccttaccggtagatggaaatatttctggagagtaatacccagtctgtttctctgataattgcgctgtttttccgcatgaaaaacgggcaaccgacactctgcgcctctttgagctgacgataaccgtgaggttggcgacgcgactagacacgaggccatcggttcacacccggaaaggcgttactttgcccgcagcttagtcgtcaatgtaataataatgagtaagttacgatgaaaagaatgttaatcaacgcaactcagcaggaagagttgcgcgttgcccttgtagatgggcagcgtctgtatgacctggatatcgaaagtccagggcacgagcagaaaaaggcaaacatctacaaaggtaaaatcacccgcattgaaccgagtctggaagctgcttttgttgattacggcgctgaacgtcacggtttcctcccgctaaaagaaattgcccgcgaatatttccctgctaactacagtgctcatggtcgtcccaacattaaagatgtgttgcgtgaaggtcaggaagtcattgttcagatcgataaagaagagcgcggcaacaaaggcgcggcattaaccacctttatcagtctggcgggtagctatctggttctgatgccgaacaacccgcgcgcgggtggtatttctcgtcgtatcgaaggcgacgaccgtaccgaattaaaagaagcactggcaagccttgaactgccggaaggcatggggcttatcgtgcgcaccgctggcgtcggcaaatctgctgaggcgctgcaatgggatttaagcttccgtctgaaacactgggaagccatcaaaaaagccgctgaaagccgcccggctccgttcctgattcatcaggagagcaacgtaatcgttcgcgcattccgcgattacttacgccaggacatcggtgaaatccttatcgataacccgaaagtgctcgaactggcacgtcagcatatcgctgcattaggccgcccggatttcagcagcaaaatcaaactgtacaccggcgagatcccgctgttcagccactaccagatcgagtcgcagatcgagtccgccttccagcgtgaagttcgtctgccatccggtggttcgattgttatcgacagcaccgaagcgttaacggccatcgacatcaactccgcacgcgcgacccgcggcggcgatatcgaagaaaccgcgtttaacactaacctcgaagctgccgatgagattgctcgtcagctgcgcctgcgtgacctcggcggcctgattgttatcgacttcatcgacatgacgcctgtacgccaccagcgtgcggtagaaaaccgtctgcgtgaagcggtgcgtcaggaccgtgcgcgtattcaaatcagccatatttctcgctttggcctgctggaaatgtcccgtcagcgcctgagcccatcactgggtgaatccagccatcacgtctgcccgcgctgctccggtaccggtaccgtgcgtgacaacgaatcgctgtcgctctctattctgcgtctgatcgaagaagaagcgctgaaagagaacacccaggaagttcacgccattgttcctgtgccaatcgcttcttacctgctgaatgaaaaacgttctgcggtaaatgcgattgaaactcgtcaggacggcgtacgctgtgtgattgtgccaaacgatcagatggaaaccccgcactaccatgtgctgcgcgtgcgcaaaggggaagaaacctcaaccttaagctacatgctgccgaagctgcatgaagaagcgatggcgctgccgtctgaagaagagttcgctgaacgtaagcgtccggaacaacctgcgctggcaacctttgccatgccggatgtgccgccagctccaaccccagctgaacctgccgcgcctgttgtagccccagcacctaaagctgcaacggcaacaccagcatctcctgcacaaccagggttgttgagccgcttcttcggcgcactgaaagcgctgttcagcggtggtgaagaaaccaaaccggccgagcaatcagcaccgaaagcagaagcgaaaccggaacgtcaacaggatcgtcgcaagcctcgtcagaacaaccgccgtgaccgtaatgagcgccgcgatacccgtagtgaacgtacagaaggcagcgataatcgcgaagaaaaccgtcgtaatcgtcgccaggcacagcagcagactgccgagacgcgtgagagccgtcagcaggcagaggtaacggaaaaagcgcgtaccacagacgagcagcaagcgccgcgtcgtgaacgtagccgccgccgtaacgatgataaacgtcaggcgcaacaagaagcgaaggcgctgaatgttgaagagcaatctgttcaggaaaccgaacaggaagaacgtgtacgtccggttcagccgcgtcgtaaacagcgtcagctcaatcagaaagtgcgttacgagcaaagcgtagccgaagaagcggtagtcgcaccggtggttgaagaaactgtcgctgccgaaccaattgttcaggaagcgccagctccacgcacagaactggtgaaagtcccgctgccagtcgtagcgcaagctgcaccagaacagcaagaagagaacaatgccgataaccgtgacaacggtggcatgccgcgtcgttctcgccgctcgcctcgtcacctgcgcgtaagtggtcagcgtcgtcgtcgctatcgtgacgagcgttatccaacccagtcgccaatgccgttgaccgtagcgtgcgcgtctccggaactggcctctggcaaagtctggatccgctatccaattgtacgtccgcaagatgtacaggttgaagagcagcacgaacaggaagaagtacaagtgcagccgatggtgactgaggtccctgtcgccgccgctgtcaaacctgttgttagcgcgccagttgttgaagaagtggctgaagtcgtagaagcccccgttcaggttgccgaaccgcaacctgaagtggttgaaacgacgcatcctgaagtgattgctgccgcggtaactgaacagccgcaggtgattaccgagtctgatgttgccgtagcccaggaagttgcagaacacgcagaaccggtggttgaaccgcaggaagagacggcagatattgaagaagttgccgaaactgctgaggttgtggttgctgaacctgaagttgttgctcaacctgccgcgccagtcgtcgctgaagtcgcagcagaagttgaaacggtagctgcggttgaacctgaggtcaccgttgagcataaccacgctaccgcgccgatgacgcgcgctccggcaccggaatatgttccggaagcaccgcgtcacagtgactggcagcgccctactttcgccttcgaaggtaaaggtgccgcaggtggtcatacggcaacgcatcatgcctccgccgctcctgcgcgtccgcaacctgttgagtaataattagctcaagcaatcaagccctggtaactgccagggcttttttatttcatctttgagtcaacatattaaaattcatcaaatggcatccttgctaaccaactatacaaaataggcaaaaaaatgcccgccccggcgatcccagagcgggcagacaaaacatacccagtttcatgatatgttttaaagcgagcttatttgttgagctggaagagcgacaatccctgcatatcggtaaatgctttatacgatgcctgcaatgccgtttgctgcatgatgtaagatgaaatagttgcattccagtccacatcaaccagatcgctcatctgctgcgtttgccctaaagcgcgatcgctacctaatgaatccagcgactccagttcgttcagttgcgtgcctaattccgcgcgaacagtcagcacattgttcagcgagtttttcagtccgcggttggttttatccagtgccgcagcggcggtttctttatccgcttcgctatccgcgaccggcgttttcagggctgcgatggcgctatccagcatggcaaaaagattggtttcagaagcgctaccgtctggttccgctaccgcgttgctggtaatactgtcgaaaattttgtcgcccgtatgtcctatcaccatcgaacgcgaagcatcgacctgttgtttaatactttctgttccgccgacataatcaccgtcagcctcactaaacggcgcagtctctgttttataaccggcaaaaatgtagcgcccgttaccgtcagtggtgttcgccagattcagtaactgatcacgaagcccctgaatatccgtagccagtgaggcccggtcatcgtcactcaaggtgccattgctggcgtagacaattttttcctgagcattctggatagcagtggtgacctggctaagcacactctcttccagtgacactttttgagtggcgaaagtacgcgccagcgtgtactggctgttttgtgcctgtgcctgggagagaacaacagcttgtgatgcagcaatgggatcatctgaagggttaacgactcgcttacccgtcgacatctgttcgccgtacttcatccattctgcctgagaattggtgatgccacgcatgttttgctggtacatcatctgggtactgaaacgcattttatctccccttagcgaatgttaatcagcgcatcaaaaatcgcgtttgccgtctgcagaacctgcgcattcgccaggtaatactgctgaaaacgttgcagatttccgtactcctcatcgagattgacaccggaaatcgactgctgctgattggaaagctgcgtcaccacattaccttgcgtggcgctactggttttcaacgtcgcggttttattcccgatatcactcactaatgaggcataagcgtcgttaaaggatttcgcaccgcccaccgttttactgttgctttgcagatccagcagggcctgaccgttgcggttgtcgctatcacccgcatcttcttcgctcgccatggcgattttcgcttcgtcagtgattaatacatccatgttgacgatggcgtcacttaccggtttcagcgtgaagctgtcgttaacggcaggcgttcctgtaaacgtcaactccagaccatcaaatgccactttaccgttggcatccggcgtcaccgtaaaagtggtattgctggcaaggcgggtgacctgccactgattattatcgaacgagattttgtaatctgtcgccagtaccgcggaggcatcagttaccgtggcaccgatcgcaacgtcacctttgtttttcgtgttttgcagaaccgcgggcttaccaatagcaaagaaatcttcaccagcatcgccgttggcatcaaatccggctttgtgttgtgtgttgaaagcctcggcaaatgccagcgccagttgtccaagcgtattacgcgtctggtccagatcctgagaacggaatgtcagaatgccgcccagcgacccggtattcagtaatttctccgggatctcaatattgcctgccgtcctatcaacataagcgacagtcgtacgagaagggtcggcgctggaaggaactgccgcaagttgccgcgccgtacttccctgaaccagtgagtagccattggccatcgtgatgttataagtgccaccatcctgaacgctgacttctacgccaacaatctggtttaattcgctcaccagttgatcgcgttgatccagcagattgttaggtgacgcccctgcccccacgcctgtcaggcgggagatttgatcgttcaggctggcgatttgtttagcgtaattgttgatctgatcaacgctggcacctatcgcgatattgacctgtttgtcctggtcgcgcagatattgatcggtggttttaaactgattcaccaacccttctgatttcccaatcagcgcctggcgcgctgccgggtcttccgcgttacttaccagcgtttgcaggctggtgaagaaatcctgcatctgtgttgccagcgaagaggtactggtggagagcatattgtcgattttcgacatctgctcatagcgggcagtcaggccgctactttgcgtctgcgccgcacgtaactggttggtaataaatgcatcatactcacgctgcacaccagaaacgtagacgccattgccaacccagccgccagcgcccagcgtgctattggcctgcgccataatagtggtttggcgggtatatccggcaacgttatagctggagatattattacttgccgtatttaacgccgcctgggccgcgttcagtccgctcatggcgttattgatcaagctggacatggaggttccttataagccttcaattacagagtattatcggcagcgacccgccggacttgagttattcagaacagattatcaatgttcatactgtaggttttgctcactttgtcgcttatcgatttcatctgctgaatcatgttggtgagtttgcgggcatagtgaggatcggtggcatagcccgcgtcctgtagggcctgtgccccctgctccgcactcacggcggtcgtcacggcagcgtagcgcggattgcgtgttaacagcccaacgtaatccgacaatgcttccagatacgagctgtagacccgaaatttcgcttttactttcttcgcttcgccgttttcatattcagtcgtggtgatttcagtgactggccctttccagttgccagaggctttgacgccaaacaggttgtaactcggctcgccgttttcgcggcggatttgccgttgcccccagccagattcaagcgccgcctgagcgaggatcaaatgatgtggcacaccgctttgctggcttgccagttgggcgggcagtgagagttgcgcgaggaatgctttactgttacccggcaacgaatcatcgtagttacgtggtacggccttttgcaccagctgagaaagcgcctgattttgataacgcaccacagtttcgagcgggaatttcatcggtgctgctggcgtggactcctctggcaatggttgttctggcgtcatctgtttaaccatcatctctgccagccccagacctttgcccgccgtcatctgttgggcaatctgctggtcatacatactggtatacaggcgagtgcgctcgctgctgaacaggccatcttttggtaaagcgtcgcgcatgcttttcaacatcatctgcacgaacatcccttccacctggcgggccaccggacggatatttgccgctggatcttcgcccgctttcgcctttagttcgttgagtgattgcgcatcccaggccgcacttgccagtagtttgctgtcgctgatcatcagatgatttccagttttgcccgcagacatcccgcactttgcattgattgcaaaatagacatcagatccatcggcgtagcgcccagcgcattgagcgcgcgcaccacgttattgaggctggcgctggaacgtacgctttgcagcgaaccgccgctctggcgtaaatcgatctgcgtttgtggagtaaccacagtctgtccaccaccaaacggtgtatctggctggctgacattggcctgacgattgaccgtaaccgagagattcccctgcgctactgcgcagctgtcgagggtcacttcgcgattcatcaccaccgagccagtgcgcgagttaatcactactttagcgtcctgcggggtgacattaacctgcatattctggatatcggcaaggaaacggacctgggaactgttgccacttggtacgcgcacctgaatagtccgcgcatctaacgcggtggcgctgccatatccacgcacgcggttgatggtgtcagcgatttgctgcgccatgctgaaatcttcgtcgttaagttgcaaattaagggtattcccgacgccaaactggctgggcaattcacgttcaataaccgcaccattggtgatccgtccaccgttcagttggtttacctgaacactgctaccgccagcagaggctcctgcgccgccaaccagaatattgccctgcgccagcgcatacacctgactgtcaacgcccttaagcggtgtcatcaacaacgtaccgccacgcaagcttttggcattacccatggaagaaaccaccacatcgatggtttgcccctggcgtccaaacggcggaagtgacgccgtcaccattaccgcagcgacgttttttagctgcatattggtgcccgtcggaacggtaattcccagctgtgagagcatgttattaagcgtttgtgtggtaaacggcgtctgggttgtctggtcaccggttccatccagccccaccaccaggccatagccaatcagtgagttttgccttaccccctgaacactggtgagatcgcgaatacgctcagcctgagccgccgtcgtaaccagtagaagaattaatgcagagagaaatttaatcaccacagcctcacttacattggcgacaggttaaggaagaaacgctgcaaccagcccatattttgcgcttcgttaatgtagccattgcctacgtattcaatgcgcgcatccgccacctgagtagatggtacggtattgctgccgctgatagtgcgtggattaaccacgccagagaagcgaataaattcggtaccctgattaatggcgatctgtttttcacccaccacatgcaggttgccgttgaccagtacctggtcaaccgtcaccgtcaacgtaccgctaaaggtattgctggcattggccccgccttttccgttgaacgtgttaccaccggaggcttcgacatcggcacgagcgttaccaaacaacccctgcaaatagcgcggcacagtatcaaagccaaaattagttttaccgtcacggctggcattcgcagaggagcttttgctggcgctgacgttctcctgcaacacgatagtcagcgtatcgccaatattgcgtggtcgacgatcttcaaacagcggttgatagccatagttaatcggctgagcagactggaaaatagacccgttggcgacgggcgtcggaccgggaaccggttgtgcactggtcgccccttgtaccagcggcgtggagggtatccaggcgcagccggttagtgaaagcaccaacaagctggaaatggcataagtatgcgcagcgtttttttgcatggctatcatcttcaaaaatcagtaaaccggtgaacctgccaccggttaagccttagagttgcgtcagtttttgcagcatctgatcggtggtggacaccgctttactgttgatttcgtaagcgcgttgcacctgaatcatattgaccagttcttccgccacgttgacgttagacgtttcaacatacccttgatacagcagtcccgcgccgttcaggcccggcgtgctttcgttcggtgcaccggaggattgcgtttcggtgtagaggttttcgccaatgctctccagtccggtgtcattcataaaggtggtgagattgagctgcccaacctgaaccggagctgcctggccttgttgggttacgctgaccacgccatcacgaccgatggtgatacttaacgcattcgccggaatggtgatcgctggctgcacctgaaaaccaccggccgtcaccagctgcccgttctgatccacctggaaagagccgtcacgggtataggctgatgagccatctggcaacatcacctggaaaaagccctgccctttaatcgcgacgtctttactgttattggtttgcgacaggttgccctggctgtgtaaacgttccgtggcgaccgggcgtacccccgtaccgatttgtaatccggatggtaaggtggtttgttcggaagactgtgcccccggctggcgaatggtttgataaagcagatcttcaaacaccgcgcgctgacgcttaaaaccgttggtactaacgtttgccaggttgttggcaatgacgtccatattggtttgctgggcgtcaaggcccgttttggcgatccataatgaactgatcataaaatgtcctgtagtggattagtgacaaagtgcatatgtcttcttgccggatgcggcgtaaacgccttatccggcctacaagagctcgcaaaatcgataaattgcgattgcccccatagacccgataaacttgcgcatagggcaacttatacttgtcatgtatcctttcaattaactcatcgacagcagttggttggcacggcctgcgttatcatcgacgctgctgatcaccttcatctgcatttcaaaacgccgtgcgctggcaatcatgtcgctcattgccgcaacggcattgacgttactgccttccagaacccccgacatcacacgcaaggttggatctgcctgcagtaccggcccacgcgtagcctggctttctgcgcttaaacgaaaaatgccatcgtcaccgcgctggacttcgctgcccgtggctttcaccagcttcagacgccccactggcgcaaccgtatttgccggatcgcccggattcagcgccgagattgtgccatcggcagcaatagtgatttccgccccttccggcacagcaattggccccgcctcgcctaccaccggatgtccctgaattgtcagttgcccggtgggatcaacctgaatgctgccattacgcgtatacccttcactgccgtcagcggtctgcacggccagccaaccatcctgctgcaacgcaacgtccagcgggcgcgaggtgtaatccatcttgccgggtgtcatgtctgcacccggtgttgacgccgttaccagcgtgcgcgtgggcagtgaaagcccttccaccggcactgcgcgcaaggcgtttaactgcgcgcgaaaaccgggcgtagaggcattggccagattactggcggttaccgcctgttgattcagcgtctggctggctgctcccatcgcggtataaattgcgtgatccattgagctatcccgtcagcgattagcgtaagttaaccagcgtattgaggatctggtcctgggttttgatggtctgggcgttagactgatagttacgctgggcaacgatcatattgaccagttctttactgagatcgacgttggacgcttccagcgcaccgttggtcagtgtgccaaagttgcccgtcccggctgtccccaacagcgccacgccagaagattgcgtagcggaccagacgttgtcgccttcggatgccagaccttcgttgttggcaaagttcgccagtacaatctgccccagcagttgggtttgttcgttggaatagttgccgacaaccgtaccgtcatcattgatttgataactcaccagatcgcccggtttgtagccgttctgggtggttgccacaatgttgttagcgccggtattttgctgcatggagttgaggaagctcaggctaaacgtggcgggatctgcgccgttaattgcgccagtggaaatattcgctgttggatttgaggtcagaacgccattggcattaaacaccagtgttgtcgctgtcttcgcaatgctgtttggatcactactatcctgggtgtagacctgccagttattatccccggtcttcacaaagtacacgctcatatcatgagcattaccctgactatcgaaaacagtcaccgaaccttttttgttatagctatccgcattgctggcatcaaatgcgttaacagagggaagcgaatcactggaattcaggttgatctgcattgacgccgtggtggtagttttcgctgccatcagggtattcgggatcgaaatattggtcggattcgccccttgctgaatagtcggcggcgtaccggttgccgggtaccccgtcagctgtaaaccttgcatattcaccaggttacggttttcatccagcttaaattgtccattacggctgtagaacaccgaaccgttgctgtctaccagacggaaaaaaccgttctggctgatagcaacgtccagacctcgcccggtgttggtggtcgtgccatcggtaaagtcctgggtgataccggcaacttttacccccagtcccactttcgaaccggcaaacatatcggcaaaagaggccgtgcctgatttaaagccgtaggtggcggagttggcgatattgttgccaataacatcgaggttggtggcggcagcgtttaatccgctaaccgcttgagaaaaggccatgactgactcctgaaatgtgaaggcttaaattatctgccgtacttcgtcgagggtggtggtgccgtaagtgccgagatccagcgtattaccgttgttgccgcggatcacaccctgcaccagagcaaactgcagcggctgggcaaccagttgtgtaccaccgttactggcgctaatcgctacattgtaagaaccgttcggcgcagtgctgccgtcagtcaacgtaccgtcccaggtgaaactgtggactccggcagtcagttcaccgatatcaatggtacggacgaccgcgccgtttttatcggtgatggtggccgtcactttgtctgccgcctgttgcaactcaacaccaaacggcgtggtcgtggtcacagccccttcttcactgccggttcccgcaagaacagtggtaccggggatcatcacgccgtgaccaatcaggttactggcctgtaacgactggctgttatcaatctgtccggaaatagatccaagcgtggtattgagtttttcaatcccactgaccgtgctgatttgtgccaattgcgacgtcagctcgttgttttccattggattggtcgggtcctggtttttcagctgcgccaccaacaaagtcagaaaactgctttgtaaatctgcggcgttgctgcccgtgagcgaactactgctggtggtactgacgccggtattcgtcggatcggtggtggttaccgcaatggacatagctttctcctttattgaccgagcgtaagggttttcagcatcatacttttcaccgtgttgagcacttcaacattggcctgataactgcgtgacgccgacatggtgttaaccatctctccgacgacatcaacgtttggcattttcacgtagccctttgcatccgccagcggattacccggttcataaaccagtttgtccggggcctgactttctataacatcggcaacctttacgccgcctgtcgcagcacctggcgcagcgttaacctggaataccacctgttttgcccgatatggctgtccatcgggaccggtgacgctatcagcattcgccagattactggccgccacgttcaggcgctgggactgggcagttaacgccgacccggcgatatcaaaaatattcagcagtgccatccgttaatttccgctctgtaaaacgttcatcatgcctttgatctgcccgctcaacgcgctaaggctcatctggtattgcaggctgttatcggcaaactgggtgcgttcgcgatccatatcgacagtattaccgtcaagcgaaggctggtccggaatacggtattgcagttctgcggaaggaggcgtcagcgcctgcgccggaatgtgtttcgttgaggtcatcgtcagagcaaccacactggttgcatcccgtccacgttgcatgacttttttaagttcactggcaaaatcgatatcgcgagcctgataaccaggggtatcggcattggcgatgtttgctgccagcacttcctgacgctgggcgcgcagattgagcgcctcttgttgaaaacgtaaggcggcgtcgagcttatcgagcatatctcctccgcaggtatcaaaattctgccatcagcttaaatgcctttacgcgcgcgttatcggcggaataaacgcaaaatgggtcgctatttatgccgttgatggtcattgcggacaggtacaattcacgttgtagaaatggctgggggcgaaaatgctgacaataaaacgtagcgtggcgatcatcgcgatactgttcagtccgttaagtgcggcgagcaatctcacatcgcaattgcacaccttttttagcgcccagctcgcgggggtaagtgatgaggttcgtgtttctattcgtacagcgcccaatctactaccgccgtgcgagcagccattgctttcgatgagcaataattcccgcctgtggggcaatgtgaatgtgttggcacgctgcggtaacgacaaacgatatttacaggttaatgtacaggccacaggaaattatgtggttgccgcgatgcccattgtgcgtggaggaaagctggaagctggcaatgtcaaactgaaacgcggccgactggataccttgccaccgcgtacggtgctggatatcaatcaacttgttgatgccgttagcctgcgcgatctatcacccgatcaacctatccagttaacccactttcgccaggcatggcgggtaaaagcgggacaacgtgtcaacgtgatcgccagcggtgatgggtttagcgccaacgcagaaggtcaggcgctgaacaatgcagccgtcgcacagaatgcgcgggtgcgcatgatatcgggacaagtggtcagcggcgttgttgatgcagatgggaatattcttataaacctgtaagctgttaaagattacccgtcccttgccgataaataagcaacacatgataaaagcgccctcaatgaggaataaaccatgagtattgatcgcacttcgcctctgaagccagtaagcaccgttcaaccgcgcgaaaccactgacgcgccggtaacaaacacccgagcggcaaaaacaacagcctccaccagcaccagtgtgacgttaagcgacgcgcaagcaaaactgatgcaacccggcagcagcgatatcaatcttgaacgtgtcgaagcgttaaaactggcgattcgtaacggtgaactaaaaatggacaccggcaaaattgccgatgcgctgatcaacgaagcgcagcaagacttgcagagtaattgatcgtatgacgcgtcttgcagagatcctcgaccagatgtccgctgtgcttaacgatctcaaaacggtaatggatcaagagcagcaacatctctctatggggcagatcaacggcagccagttgcaatggattacagaacaaaaaagctcactgctggcgacgctggattacctcgaacagttacgcaggaaagaacccaatacagcaaatagcgttgatattagtcaacgctggcaggaaattactggcaaaactcagcaactacgccaactgaatcaacataacggctggttactggaaggacagattgagcgcaatcaacaggcgctggaaatgttgaaaccgcatcaggaaccgacgctatatggagcgaacggtcagacctcaacaacccatcgcggcagtaaaaagatttcgatctgaagattatctccggcctgcactgcaggccggaatacattgttacaccgtccggcgggcaaactctttaactttgaagcccagtaccgccagtgcagcaaagtacgcagcaatccccgccagcacgaccgccattaaacgcagtaagcgccagggcatggtacccaatgaccactccggcatgatatgtaacatacctaaaagcacaccagacatcaccagtaccgccaccaccagacgcaacagaaacgccatccagccaggttgcggggtaaagattttctgcttacgcaactgccagtaaagcagcgaagcattcagacacgccgccagaccaatagaaagtgacagcccggcatgtttcaacggaccaataaacgccaggttcatcaattgcgttaaaatcagcgtaacgatggcaattttcactggcgttttaatgtcctggcgggaataaaagccaggagccaacactttcactacaatcaggccaatcaaacccaccgagtaggcaattaacgcccgctgggtcatcagcgcatcaaaggcggtaaatttaccgtactgaaacagcgaaacggtcaacggacctgaaagaatgcccaacgcaaccgcactcggcagcgccaacaggaaacaaagacgcagcccccagtccatcaaacggttgtattcatcatgattgccactggcaaaacttttcgacagcgacggcagcaaaatggtgccaagcgccacgcccagtacaccggacggaaactccattaagcggtcggcgtaatacatccaagacaccgaaccggaagcaagaaacgaggcaaaaatggtgttgatgattaaggagatctgactcacagagacgccaaggattgccggtcccatctgtttcaccacgcgcattgctccggcatcgtggaagttaatgcgcggcaggaccagcatgccgatcttcttcaggtgcggtagctgatacaccagctgcaggacgccgccgaccgtaacagcccacgccagcgccagcaccggtgggttaaagtacggtgcggcaaacagcgcgaaaccaatcatgctgatgttaagcagtgttggagcaaacgccggaatcgagaagcggttccacgtattcagaatcgctcccaccagcgacgccagggagatcagcaagatatagggaaaggtaatctttagtagctggctggtcagggcaaatttgtcagctgtgtcagcgaagcctggcgcggtcaccatgatcacccacggtgcggcgagcatgccagcgaccgtcacaaccgccagcgcaagtgtcagcaggccagaaacataagagacaaagacccgcgtggcgtcttcaccctgcttacttttatattccgccagaatcggtacaaatgcctgggaaaatgccccttcggcaaagatacggcgtaacaagttaggaagtttaaaagcgacgaaaaaggcgtcggttgccatccctgcgccaaagattctggcgacaattgcgtcacgtgcgaagccaagcacacgcgaaaacatggtcatcgagctgacggcggccagcgattttaataaattcatcggtgttctaatccagacccacgggcaaaacgcctgcaaggcaggcgctgaaagaggcgaatagtctacctggattatggtgaattgctaccgccagatgttacagggtttattcactcatcgcatcgcgccagatcttgtcaacgatacgttgcgccagcactgcctgttcgccggcggtttgcggaactgtctgattttgcacgcattcaatgaagtgccgcgcacagccgacaaatccacgttgctcaagcgtactctgccaaccaggaatcggtttattcactacaccctgcccacgctcctcacgccattcgcgcatatccgtaatgtcgatgagcgcaccgtcagtcacggcctgcacggtttcacgctggcttccggcacggcgatgcatacaggtggtgatctgcaaaggaccggccgaaaaatggtgctcggcaaacagcatttcgccagcgtcgttagtcagtagcgtaccgccatccagagaggctttgccgcccgacaaccacagcgcggtatccaccacatgcagataatcatccagcaacgtgaaataaagatcgtgtggcccgacgctattgctacgatgtttatccattcttagcgaggctgcggtggcgagttgcgtttttaactcaccgtagagtggtgcgaaacgacggttaaaaccgaccatcaacgttagttttttccgcgccgccagttccaccagccgttcagcatcgcgcagattttctgccagcggtttatcgacacagacatgtacccccgcattgagtaacgtactgaccacgtcaaagtggctggcggtgctggaatgcacaaaaaccgcatcgcaactggcggcaaggctggataacgaatcagcataaggaatgcgccagctgtcacaaattggcaaggctttggcgcgcgtaggcgaccacgcaccttgtaacgtccagtcagacgctgccgccagcaccggtaaccacgctttttgcgcgatgccgcctaaccccactacgccgatacgtaattttttcactttaatctcccagatgggccagcaacgaatcaagacgctgtttcagttctgccacttcgatttccagggcttcgacgcgtgcctgtaaatcaccgtcaaccgcgttcgacatatccatcaccgccggctgatcttcaacctcaccactgaaaagatgcatgtagcggctttcacgtttacccggttcgcgggccagacgcaccacaaaaggaccatcttcgcgatttgccagttgttccagcgtcgactccacttccgccatatcgctgaattcatacattcgcgcggcgcggctgcgcagttcacccggcgtctgggcaccacgcaataacaacgtggtgattaacgccacttctgcggcgctcagtttcagatcgccaaattctgaattacaaaaacgttgttcatatttggtgacccgattaccaaagccactcaccgtgcgcagataatggcgtttgaccagattatccagttgctcctgcacctcggattcactcagattcatgaccggttcacggttcgttttctgattacaggccgtgactacaccattgactgagagcgggtattgctccggcgtggtcacctgtttttccagcaagcaaccaatcacgcgagcttccagggcagtaagttgatatttcatgagattctccttagcggccgggcgtccagtctggggtagttaatgccgtcagtacgtgatcgcgccattgtccatcaatcaacagatagtctttcgcatagccttctttttcaaaacccagtcgcgccagtaaatcaccgctgcgtttattgtgcggcatataattagccataatgcgatgaatatgttgggtgcgctgcatataacgaatggctgcgctcagagcttcaaacatgagtcctttgccctgccatttttgcccaatcgaataaccgagatagcaggcatgaaaagagccgcgaacaacattggaaaaattggcaacgccaataatctctttttcgtccgggtcgaataagccaaagtagaaagctgaaccttgtttatgaaattcgttaatcatccctagcctggcctgccagcctgatggataacagtggctttcgtcgcgcactggctcccagggcttgaggaaatggcgattctctgcgtaataatccgccagacgccaggcatcacgatcatgcaccagacgcacgaccagtcggtctgtggttaagcgcacttttggcacgttactgcgatagccaaacattctatacctactccttcccgtaacgtctttaatacgctgtaagtattactatacctgcgcaaccagaccctgtgaaaagtccagaatgccattttctgcattattcacatatttgataaaaactctctatcaaagcgacgttttgataaaaaaatattgtccccgaagtgatgggaaaagtcttagcggcaatgcagaatagaaagtgctcatcttttatttcccgggaggggaaatgtcccgcgtgtcgcaggcgaggaacctgggtaaatatttcctgctcatcgataatatgctggtcgtgctggggttctttgttgtcttcccgctgatctctatccgcttcgttgatcaaatgggctgggccgccgtcatggtcggtattgccctcggtctacgccagtttattcagcaaggtctgggtattttcggcggcgcaattgccgaccgctttggtgccaaaccgatgattgtcaccggtatgctgatgcgtgccgccggattcgccacaatgggtatcgcccacgaaccgtggctactgtggttttcatgcctgctttcgggactcggcggcacgttgtttgatcctccgcgttcggcgctggtggtgaaattaatccgtccacagcagcgtggtcgttttttctcgctgttgatgatgcaggacagtgccggtgcggtcattggcgcattgttggggagctggctgttgcaatacgactttcgcctggtctgcgccacaggggcagttttgtttgtgctgtgtgcagcgttcaatgcgtggttgttaccggcatggaaactctccaccgtgcgcacgcccgttcgcgaaggcatgacccgcgtgatgcgcgacaagcgttttgtcacctatgtcctgacgctggcgggttactacatgctggctgtacaagtgatgctgatgctgccaattatggtcaacgacgtggctggcgcgccctctgccgttaaatggatgtatgccattgaagcgtgtctgtcgttaacgttgctctaccctatcgcccgctggagtgaaaagcattttcgtctggaacaccggttaatggctgggctgttgataatgtcattaagcatgatgccagtaggcatggtcagcggcctgcaacaacttttcaccctgatttgtctgttttatatcgggtcgatcattgccgagcctgcgcgtgaaaccttaagtgcttcgctggcagacgcaagagctcgcggcagctatatggggtttagccgtctgggtctggcgattggcggcgctattggttatatcggtggcggctggctgtttgacctgggcaaatcggcgcaccagccagagcttccgtggatgatgctgggcattattggcatcttcactttccttgcgctgggttggcagtttagccagaaacgcgccgcgcgtcgtttgcttgaacgcgacgcctgatttgatactcccccctgactcctccatactgaaagtgaactgacagccaaatggaggagtcacgtgaagctatacatttacgatcactgcccttactgcctcaaagcccgcatgattttcggcctgaaaaatatccccgtcgaattacatgttctgctcaacgacgacgcagaaacacccacccggatggtcggtcaaaaacaggttcccattctgcaaaaagatgacagccgctatatgccagaaagcatggacatcgttcactatgtcgataaactcgacggcaaaccgttactgaccggcaaacgttcccctgccattgaagagtggctgcgcaaggtcaatggctacgccaacaaactgctgttgccgcgttttgccaaatcggcatttgatgagttttctactcctgccgcgcgcaaatatttcgtcgacaagaaagaggccagcgcgggtaattttgccgacctgctggcccactctgacggtctgattaagaatatcagcgatgatttacgtgcgctggacaaactgatcgtcaaaccgaacgccgtgaatggcgaactttcggaagatgatattcagctatttccgctcctgcgtaatctgacgctagtagccggaatcaactggccaagccgcgttgctgattaccgcgataatatggcgaaacagacacaaatcaatttgttatcatcaatggcgatttaatcctgacccgccgcggcagcctgtattcgcgggttgccgccgttttcagttttttctgctggcgcgtttatcgctggtgacacatgctgcgttgtgtcaggatattgacgcagatttcatgtcgaggactaccatgaacaagtttttatttgccgctgcattgatcgtcagtggcctgctcgttggctgtaatcaactcacccaatacaccatcaccgaacaagaaattaaccagtcgcttgcgaaacataataatttctcaaaagatatcggtttacccggcgtggctgacgcccatattgttctgacaaacctgaccagccaaattggtcgcgaagagccgaataaggttaccctaaccggagacgccaatctggacatgaactccctgttcggtagccagaaagcgaccatgaaactgaagctgaaagcgctgcccgtgtttgataaagaaaaaggcgcgatcttcctgaaagagatggaagtggtcgatgcgacggtacaaccggaaaaaatgcaaacggtgatgcaaacgttgcttccctatttaaaccaggcattacgcaattactttaaccagcaacctgcttacgtcctgcgcgaagatggcagccagggcgaagcaatggcgaagaaactggcgaaaggcattgaagtgaagccaggcgaaattgtcattccgtttactgattaatcacgagggcgcattcgcgccctttatttttcgtgcaaaggaaaacgtttccgcttatcctttgtgtccggcaaaaacatcccttcagccggagcatagagattaatgactgcaccatcccaggtattaaagatccgccgcccagacgactggcaccttcacctccgcgatggcgacatgttaaaaactgtcgtgccgtataccagcgaaatttatggacgggctatcgtaatgcccaatctggctccgcccgtgaccaccgttgaggctgccgtggcgtatcgtcagcgcattcttgacgccgtacctgccgggcacgatttcaccccgctgatgacctgttatttaacagattcgctggatccgaatgagctggagcgcggatttaacgaaggcgtgttcaccgctgcaaaactttatccggcaaacgcaaccactaactccagccacggcgttacgtcagttgacgcaatcatgccggtacttgagcgcatggaaaaaatcggtatgccactactggtgcatggtgaagtaacacatgcagatatcgacatttttgatcgtgaagcgcgctttatagaaagcgtgatggaaccgctgcgccagcgcctgactgcactgaaagtcgtttttgagcacatcaccaccaaagacgctgccgactatgtccgtgacggaaatgaacggctggctgccaccatcactccacagcatctgatgtttaaccgcaaccatatgctggttggtggcgtgcgtccgcacctgtattgtctacccatcctcaaacgcaatatccaccaacaggcattgcgtgaactggtcgccagcggttttaatcgtgtattcctcggaacggattctgcgccacatgcacgtcatcgcaaagagagcagctgcggctgcgcgggctgtttcaacgccccaaccgcgctgggcagttacgctaccgtctttgaagagatgaatgctttgcagtactttgaagcattctgttctgtaaacggcccgcagttctatggcttgccggtcaacgacacattcatcgaactggtacgtgaagagcaacaggttgctgaaagcatcgcactgactgatgacacgctggtgccattcctcgccggagaaacggtacgctggtccgttaaacaataaaaatcgtagcttcctgttgtcattaggttattttacctgtataaataaccagtatattcaacagggggctattatgcgaattgaagtcaccatagcgaaaacttctccattgccagctggggctattgacgccctggctggcgaactttcccgccgtattcagtatgcgtttcctgataatgaaggccacgtatcggtacgttatgccgcagcaaataatttatcggttattggcgcgacaaaagaagataaacagcgcattagcgaaattctccaggaaacgtgggaaagcgccgatgactggtttgtcagcgaataatatgcagtgatttttgtttttgccgggtcgccccggcttttttattttacttgcgaattgtgagtacaaaatttctacacttcctcaaaataattgcacaatatgctaaaaaaatatgaatgacatgctgttttattgttcatataaatcttaaaagcagaaatttatctgctcccccctttaaaaattcggtgaatacccttacttattggtatactgaagttgcttcagataaaaacgcattgaacctcgaataacgttgtctagtaacacgaattagggggccatgatggaaaaaaataatgaagtcattcagactcatccgctcgtagggtgggacatcagcaccgttgatagctatgatgcgctgatgttgcgtttgcactaccagaccccaaataagtccgagcaggaagggactgaagttggtcagacgctctggttaaccactgatgttgccagacaatttatttcgatattagaagcaggaatcgccaaaattgaatccggtgatttccaggtaaacgagtatcggcgtcattaacatgacatgaccatccacccaaaaggcacctcaccggtgcctttaccatttctgggttgtatatctgcattcagttaattactctgcttaaaccatgagagcagagagaaaaaaatgaaatacgatctcatcattattggcagcggttccgtaggcgctgccgccgggtattatgcaacccgcgccggtttaaacgtgctaatgaccgacgcccatatgccaccgcatcaacacggcagccaccacggcgatacgcgattaattcgccatgcttatggtgaaggcgaaaagtatgtcccgctggtcctccgcgcgcaaatgctgtgggatgaactttcccgccacaacgaagatgatcccatttttgtacgctctggtgtcattaacctcggtccggctgactccgcatttctcgccaacgtcgcccacagcgccgaacagtggcaactcaacgttgaaaagctcgacgcgcaagggattatggcccgctggccagaaatacgcgtcccggacaactacatcggtttatttgaaactgattccggttttttgcgcagcgaactggcgattaaaacctggatccaactggcgaaggaagcgggctgtgcgcagctgttcaactgcccggtcaccgcaattcgtcatgacgatgatggcgtaactattgaaacggctgacggtgagtatcaggcgaaaaaagcgattgtctgcgcgggaacatgggtaaaagacctactcccggagctgcctgtccagcccgtacgcaaagtatttgcctggtatcaggccgatggtcgctatagcgtgaagaataaattcccggcgtttaccggtgaactgcccaatggcgatcaatattatggttttccggcagaaaacgacgcgttgaagattggcaaacataacggaggccaggttatccattcagcggatgaacgtgttccgtttgcggaagtggtcagcgatggttcggaagccttcccgttcttgcgcaatgtgttgccgggtatcggttgctgcctgtacggcgctgcctgcacctatgataattcgcctgacgaagattttattatcgataccctacccggccacgataatacactgctcattaccggcctgagtgggcacggttttaaatttgcgtcagttttaggggaaatagctgccgattttgcgcaagacaaaaaaagcgattttgatttgacgccattcaggctttcccgcttccaataatcatcattacggcctccagaatgaggccgtttttacaggagtatttaatgcgtcgactgttgcactatctcatcaataatattcgcgagcatctgatgctttatctttttctctggggattgttggcaattatggatctgatctatgtgttttatttttagttttccgcactgacataaactgacaaatatttaatctccctttcatttagcgtgaaaaattgaatgagattcttcctgcctctacagcactcactagaccttccagatgctgaacccactaaacttatgaagattctttcattattaattcaaaattattgaaatagaaataaatatcattcaatttgttatttttgtgttgcaattcattctccgacacgccattttctttctctcgcaaattcgttttggatgcacttatgtcattcacaaatacccctgaacgctatggtgttatatctgcggccttacattggctaagcgcaattattgtctatggcatgtttgctttaggtctgtggatggtcacgctcagttattacgatggctggtaccaccaggcaccggaactgcataaaagcatcggcattttgttaatgatggggctggttattcgcgttctgtggcgtgtcatatctccaccgccgggtccgctgccgagttattcgcccatgactcgtcttgcagcaaaagctggacatctcgcattgtacctattgctgttcgccatcggcatcagcggctatctgatctcaactgccgatggtaaaccgatcagcgtttttggctggtttgacgtccccgcgaccctctccgacgctggcgcacaggctgactttgccggtgccctgcatttttggctcgcgtggagcgttgtagtactgtccgttatgcacggatttatggccctgaagcatcatttcatcgataaagacgacactctgaagcgcatgctgggaaagtcgtcatctgactatggagtataaaaaatgaaaaaaagtctgcttggtttaaccttcgcttccttgatgttctctgccggttcagcggttgccgccgattacaaaattgacaaagaaggtcagcacgcctttgttaacttccgaatccagcatcttggctatagctggttatatggcaccttcaaagatttcgacggtacttttacctttgatgaaaaaaatccagctgccgataaagtgaatgtgacaattaacaccaccagcgtcgatactaatcacgccgaacgcgataaacatcttcgcagtgcggatttcctcaataccgcaaaatatccacaggcaacattcacctccaccagcgtgaagaaagacggtgacgaactggatattaccggcgatctgacgctgaatggtgtaaccaagcccgtcacactggaagcgaaattaattggtcagggtgacgacccgtggggcggtaaacgtgcaggctttgaggccgaaggcaaaattaagctcaaagacttcaatatcaagacagatttaggtccagcgtctcaggaagtggatctgattatttcagtggaaggcgtacagcagaagtaagagtgaaatgttgccggatggcacgcatccggcaatgatatttattctgttggatcaggaatgcccagtgttgtattcagacgtccacgagacttattaaagatcttattgccattttcacgtcctgcccgacggcgtcgctgttcatctggcggtaacgcgctttcttcgcagcaaatctcactacaacaacctttgtatttttccgcacatactggacactgaataaacaacagatggcagccatcatttttacagttggtatggctgtcgcacggcgcaccgcactggtggcagtgcgcgataatctcatcagatatacgttcgcccatccgctcgtcaaaaacaaaatttttgccaataaaacgcaccggcaagccctgctcgcgcgccttacgggcgtattcaataactccaccctcgatatgccagactttgttgaatccgttatgtttcatccaggcactggccttttcacaacgaatgccgccggtgcagtacataacgatttttttatctttatgtgcctgcatcatctcaactgcttttggcagctgctcacggaaggtatctgccggtatttccagcgcgttttcaaagtgccccacttcatactcatagtggttacgcatgtcgataaacaatgcatcgggatcgtcaagcatggcgttcacttccgccgcttgcagatactcacccacattgctggcatcaaagtgaggatcgtcaataccgtcggcaacaatgcgatcgcgtaccttcatacgcagtacccagaaggatttcccgtcatcatccaacgcgatattcaggcgtaaaccctctaaagccgggtcgaaggcatagagctgcgcgcgaaatgtttcaacattgctcgcaggtacgctgatttgcgcgttaatgccctcatgcgccagatacactcgcccaaaaacattcagcgcggtaaacagttgatataaagcgtcacgggtcaccttaggatcggcaatgtggaaatacttataaaacgaaatggtggttcgcggttcgctctcagccaacattttggcttttaacgcgtcgttggaaatgcggttgtgtaacactggcatggtgtacggttcctgcgagatgggaaagtaaaaatccgcggcatgatatagcaattatcgataattaacatccacacattttacgctacattttagcattaaaaattatttgttatttacaagcgcggcaatttcgcccagtcttcagtcacaaattttggttgcggacgaaaaaatgcgacaatacatacaattgcccgtataggttgaaaaacaggattgatatgacgaatctacccaagttctccaccgcactgcttcatccgcgttattggttaacctggttgggtattggcgtactttggttggtcgtgcaattgccctacccggttatctaccgcctcggttgtggattaggaaaactggcgttacgttttatgaaacgacgcgcaaaaattgtgcatcgcaacctggaactgtgcttcccggaaatgagcgaacaagaacgccgtaaaatggtgg

SEQ ID NO: 9997 - DNA, 15215 bp, Escherichia coli
cgcgcgcttcaacgctatgaaggacaagcgcaatatcgtttctctgaattacgctgtgcgtgagaaagagaataatgaagatgatgcgacgcgtctggcgcgtttgaacgaacgctttaaacgcgaaggtaaaccggagttgaagaaactggatgatctaccgaaagattaccaggagccagatccttatctggatgagacggtgaatatcgcactcgatctggcgaagcttgaaaaagccagacccgcggaacaacccgctcccgtcaagtaatatcaatcaggcacaagaaattgtgcctgattttttaacagcggcaagatgccgtaaatcagatgctacaaaatgtaaagttgtgtctttctgatgacttacgcactatccagacttgaaaatagtcgcgtaacccatacgatgtgggtatcgcatattgcgttttgttaaactgaggtaaaaagaaaattatgatgcgaatcgcgctcttcctgctaacgaacctggccgtaatggtcgttttcgggctggtactgagcctgacagggatacagtcgagcagcgttcaggggctgatgatcatggccttgctgttcggttttggtggttccttcgtttcgcttctgatgtccaaatggatggcattacgatctgttggcggggaagtgatcgagcaaccgcgtaacgaaagggaacgttggctggtcaatactgtagcaacccaggctcgtcaggcggggatcgctatgccgcaagtggctatctaccatgcgccggacatcaatgcttttgcaaccggtgcgcgccgtgatgcctctctggttgctgtcagcaccggtttgctgcagaacatgagcccggatgaagccgaggcggtaattgctcacgaaatcagccacatcgccaatggtgatatggtcaccatgacgctgattcagggcgtggtgaacaccttcgttatctttatttcccgtattctggcgcagcttgccgcgggttttatgggcggaaaccgtgatgaaggtgaagagagcaacggcaacccgctgatctactttgcggttgcaacggttctggaactggtgtttggtattctggcgagcattatcaccatgtggttctcgcgtcatcgtgaattccacgccgatgcgggttcagcaaaactggttggtcgcgagaaaatgattgctgcattgcagcgcctgaaaaccagctatgaaccgcaagaagcaaccagcatgatggctttctgcattaacgggaagtcgaaatcgctcagtgagttgttcatgactcacccgccgctggataaacgtattgaagctctgcgtacgggtgaatacctgaagtaatatgaagtaaatactaaaaagcgcgtcctgatcgacgcgctttttttatgccctggatcgtggctgagtgatacgtaaaccactgacacaggcagcaatcactgccagaatagccgcagctatcagcgagacgtgcgtaccattatcaccaaactgatttagcatcagcgctaccagagccgcgccgctactctgacccagaagacgagccgtccctaacatgccactggctccaccgctacgttcgcgaggagcggaggtaataatggtgtggttattgggtgactggaacaagccaaatccagcaccacataagatcatcggccagataatattgatatccgcaggtgacgctggcagcagaaccagggaaaaaagccccgcagccatgatgaataaccctaaagcacccagcaatcctgcatgtacgcgttcaatcaaatagcctgccagtggagccatcaccatcgttgctaacggccacggtgtcagaagtaaacctgtttcgacttcactacgcccgagcacggtttgcaggtaaaagggcagggaaaccattgccagcatttgtgcgcagaaagagcaaacagatgtgcaaatagaaagtgaaaacagcgggatacgcagtaaatccaccggtagcagcggtacgggaagagaaagctggcggcgaataaagaaaataccaacgacaaccattaccaccagttccgcaccaatcaatgtcagcgattgcccctgagcgaaaccactcaacgcagtgataagcaggccgaaggttaacgcgttcatcacggcgctgggcaggtcgaaacggggtttactggcgcgagaaccattgggtggcagaaaacgcattgccagaagcagggcgataattcccaacggtacgttgattaaaaataaccatttccaggatgcgatggagaggattgctgcagcaattgtcggcccggcagcagaagagacggcaacaataaacgagtttatgcccatccctctacccagaaaacgttgtggatagatcaggcggataagtgcggtattaacgctcatcaacgctgcaccgccgaaaccttgtatgacacgcgcaagggtgagcatttgcagcgaatcagaaagggcgcagaacagtgaagacaacagaaaaacgaccagaccgcatttataaatacgtcgatagccaaacatatcgcccagaaacgaaaacgagagcagggagatgacaatggcgatttgataggcgttcactacccagatggaactggccggcgtggcatgaaggtccgtagcgattgttggcaaggcgacgttggcgattgcgccgtcaaggacagccatcgaaataccaatcacaatggttaatatcgcaccgtatcgcaggggcaatggcaggccgtcggcctgaacttttggcataggaattttatatctttggtgaataatcaacaggggtatgattctagcactgatattcacggtggatgtcgcagaattgtaactaaccggcaaaagatggattgcgaccacccaggtgcgaaattataataaaaaacagttctgatttttataaaacactcgcaatgaggtgataaatggctaacgcagatctggataaacagcctgattctgtatcttccgtgctaaaagtttttggcattttgcaggcgctgggtgaagagcgcgaaatagggataaccgagttgtcgcagcgcgtcatgatgtcaaaaagcaccgtttatcgctttttacagaccatgaaaactttaggttatgtggcgcaggaaggggagtcggagaaatattcgctgaccctgaaattgttcgaactgggcgctcgcgcgttgcaaaacgtcgatttaattcgtagcgcagatatccagatgcgtgagatctcccgcctgaccaaagaaactatccacctcggcgcactggacgaagacagtattgtttacatccacaaaattgactcaatgtacaatttgcgcatgtattcacggattgggcgtcgtaatccgctgtacagcaccgcgattggtaaggtactgctggcatggcgcgatcgcgatgaagtgatgcaaattcttgagggcgtggagtataaacgcagtaccgagcggaccatcaccagtacagaagcgttattacccgttctggaccaggtgcgcgagcaggggtatggcgaagataatgaagagcaggaagaagggctgcgatgcattgcggttccggtatttgatcgctttggcgtggtcattgctggtttgagcatctccttcccgacgttacgtttctctgaagagcgtttacaggaatatgtcgcaatgttgcataccgcggcgcgcaaaatttctgcccaaatgggttatcacgactatccgttctgatgagagtaagaacctgtctgaatatcaaacagacaggttctttatttagcatgagaaaaataaagttgaaggtggcgttatattaaacgcacttgcgataagaatattttactcatgagtgagaatctggttatttattatccttaaccattatcgaccacaatattgcttttacgtaacaacgggcaatctgttatccccagaaaaccacttttagtgtgcaggtattgtaccgtgctggtgcctctggcggtcagataggtacattgtaaacctaatcccgcggcattctctttgcttccaatcaaaacgccatatccgctgagtaataatcctatccataccagcgctatcagcataactgtgcgaatgatgaatcgcattacaacctcttctctttttatgttcgcttaatcgtagcggcaatatgcgctgaagcaagcgactcattccgaaaaagcacgaatatcgacatagttaggcgctgtttaactaacgcatgctagtttaatgacataaggtaggtgaaacggagattggagtgaaaaagtttcgatgggtcgctctggttgtcgtggtgttggcttgcttgctgctttgggcgcaggtattcaacatgatgtgcgatcaggatgtgcaatttttcagcggaatttgtgcccttaaccagtttatcccgtggtgatatcattttttcagcactagattttcttcctctccagcagtggtagaatagcgcctctactcagaggtggtgaaatgaacgaagttgtaaattcaggcgtgatgaacattgcgtctttggttgtatcggtggtggttcttcttatcgggctcatcttgtggttttttatcaatcgtgccagttcacggactaacgaacagattgaactgcttgaggcgttgctggatcagcaaaaacgtcaaaatgcactgttacgtcgtttgtgcgaagcaaacgaacctgagaaagcagataaaaagacagttgagagtcaaaaatcggttgaagacgaagatattattcgtctggtcgccgaacgataatccttcctcaatcttgagtaaccccgtcgttgaagggttactcaattcatgctgattatacgcactgtcatggtgcagctgcttcaaattaaaactctggtctgacttcaaataattatcatattattaatttgcgtaacgggatatcagaaaaagatatttccctcattaatttattaggatgtttacatcggatttgtgattaagcgtggtattatttattagcgaaacgtttctctcttgatttttttgctcattcatcaatttttcttattttaaatttacaatccctttggggattgacttctctttagggtaattgatagccgttaactgactgttttatgagaaaaagtgatataactttttattcattgcatagcaaaaaatgtgatattgcacgcactatgtaataacttctctcactggcctggaacaactgaacttattgaactatgttagaaaaaatacgccagtttaagtatctgcctgaactggcaaggttaagcacaatgatatatcggcgcgtattccgttgcataagtgtgcaaaaaagtggaagacgtatcgagatttgtgcgtctgatcgagacatgtttaaaaatggcttgccataattaacgttgtatgtgataacagatttcgggttaaacgaggtacagttctgtttatgtgtggcattttcagtaaagaagtcctgagtaaacacgttgacgttgaataccgcttctctgccgagccttatattggtgcctcatgcagtaatgtgtcagttttatctatgttatgcctgcgggcgaagaaaacaatctaaggaatttttcaaatggcaaagattaaaggtcaggttaagtggttcaacgagtctaaaggttttggcttcattactccggctgatggcagcaaagatgtgttcgtacacttctccgctatccagggtaatggtttcaaaactctggctgaaggtcagaacgttgagttcgaaattcaggacggtcagaaaggtccggcagctgttaacgtaacagctatctgatcgaatccactgatctgaagtgtgaatacgcttcaatctcgctataaagcctcgtcgaatgcgaggctttttactttgttttatcttcgctccagtcgttcggatatttgcccgccgcatgattcgcgttacacttgtggcctttagtatcctgccggagttgtcatgtcgttttcctgtccactttgccatcagcctctttcgcgtgaaaaaaacagctatatctgtccccagcgacatcagtttgatatggcgaaagaagggtatgtcaatctgctgcccgttcagcataaacggtctcgtgatccgggcgacagcgcggaaatgatgcaagcacgccgcgcattcttagatgccggacattatcagccgctgcgtgatgcaattgtcggccaattgcgggaacggcttgatgaaaaggccgcggcggtgctggatattggctgtggtgaagggtattacacacacgcatttgctgatgcgttgcccgaaatcaccacgtttggcctggatgtctcgaaggtagcgataaaagcggcggcgaaacgctatccgcaggtcactttttgtgtcgcttccagccaccgtttgccgttctccgataccagtatggacgccataatacgtatttacgcgccgtgtaaagcagaagaattagtgcgagtagtgaagcccggcggttgggtcattactgccacgccgggaccgagacacttaattgagctgaaggggctgatttacaatgaagtacatcttcatgcacctcatgcagaacaactgaaaggttttacattacagcagagtgatgagttgtgttatctgatgcgtcttcgcggtgatgaagccgtcgcattattgcagatgacgccgtttgcctggcgtgcgaagcctgaagtctggcaagcactggcagcaaaagaagtgttcgactgccagacggactttaatattcacctctggcagcgttcttattaaccgtggaagtgcgtccagaggatctggacgccaataccgatcagtaccagcccgccgagaatttccgcttttttcccaataattgagccgataaagcgaccaaccatcatccctaatgtcgacataatcaaggttgcacaaccaatggccaatgcggtcgcgataatgttaacctgcaggaaagcaagaccaacacccacagccatggcatccaggctggtggcaatcgcggtggttaccagtagccagaaaccgtgtcgacggcgcggttcttcatcttcatcatctgcgccacgaaaaccctcaataatcattcgcccgccgagaaatatcagcagcacaaacgcaatccagtggttccattcaaggacaaaccgactggctaacatgcccattccccagccgatcagcggcgtcagggtttcgacggcaccaaaaataaggccggttcgcaatgcttcagaaaatttcggtttatggagggtggcacctttaccgattgatgcagcaaaggcatccatcgacataccaaacgcaagaagaacagtagcagtgatattcatgacaacgtcctgaccggggtatccataaaacacatcatcgcccccagcaaacatgcatacatgaacaacaagccgcgatggttttcgcgttcatgcaggcatagcgattgatgtgcatatggtctcgcctgactgaaagtgttcagtccgtacgtgccacgttttgcaacgagtatgttgacacgtacatttccggaatctggaaatcagctactccccaaatgagggcgcaaccttaacatattttgagaatataagacaactgttggaatatattattttattgttttattgataacgattttcatttagatttatatatcaatgaaacgttaaaataaaaaacaaataagggaagaggtaatatagcctaagctatgtctgattattaaaaatacactaaacatagctttggctaaattcataacttattgagttgaaacgagaagcttataaactttttccaaatcgtcgatatttcgaacgcggattaacagccggcgctgttctaattgcatcaccaacacgccatcttccgacaagttcatcgctttgattcggctatattcaatccagacattggcgaagaaaaaacctttttgtttaaagatgatcttcggaacgcggatccagaatatataaaaacccatcagagccagtgcacttaataaccatgttgttattagcgcgccatgattcgtgacgttgttatagataagaatgacaatcaatccgacgaagataacactatcgatgcgaccacgccggagcaaaggaattgccagcagggtggggccgttacggcggggcatgatgaactgatcgtagatcgcgaaggccagaagtgcggcgatgaaaagaatcagtaccaggtccgtgattgtcattaatcctccagataaaaaaacggggccaaaaggccccggtagtgtacaacagtcttacagtcccagcaggccgcaagcgtaaccagcgataccgatgacgaagaagccaacgatgatccacagcgggttaacttttttgcgcaacagccacatacaagcaaaggtcagcagcagtggtaccaggcccggcattaactggtccagaatagtctggacagtggtaacgtgttctttgcccgtctggtcagtaatgcgagagaccaccagtgggatgttgacatgtgtccacttattaaccaacgcccccatgacaaacaggccgaggatagacgccccttccgtcagtttttgcaggaagccaccacccatatctttaacgatatcgatacctttggagtaaccatacgctacgccgtagtaacgggttgccagacgcaccaggttaaacaggatgaagaacagcagcggacctaacaggctgccgctcatcgcgataccagcccccagcgctgcaaataccggacgtaccgttccccagaagatcgggtcgcctacaccagccagcggccccatcaaaccgactttgatgccgttgatagcaccgtcatcgatctctgcgccattagcacgctgttcttccagtgccagggttacgccgagaatcggcgcagccacgaatggctgggtgttaaagaactccaggtgacggcgaatagcctgtttacgagcttcgttgttctcagggtagaggcgacgaattgccggtaccatagagaagcagaaacccagtgcctgcatacgttcgaagttccatgaaccctgaaagaggttagaacgcaggaagacgccacgaatatcactttgagtgagttttttctcggtggtagtttgagttgtatcaaccatttcgctcacctgttagtccagttcgttatcgagatcgttgttaccagcagcctgagcaggcgcaccggctacgcggttgtatttcgggctaagttggatgtagagcactgccataacagtaccaatcacacccagagcaaccaggttaaagttggtgaatgctgcggttacgaagccgaggtagaagaacggcatcaggtagccagcacgcatcatgttgataaccatcgcataaccaaccaccacgatcatgccaccggcgatattcagaccattggtcaccacttccggaatcgcattcagcatgttctgtacttcgctggtaccaacagacagcgcaacgatgacggccggaatagccacacgcattgcttgcaggaacagagaagaaacgtggatccaggaaattgctgtcaggttgccgttatcagctgccttatccgcagcgtgctggaaagcaacggtaatagtacgaacgatgatggtcagtacctggcctgcagcggccagagggattgccagtgcgatacctgcaccaatgctctgatgacctgcgataaccagaatggtagaaatgatagaagccagggcggcgtcaggcgcaacggcagcaccgatgttcatccagcccagcgcgatcatttccagcgtaccaccgataataataccggttttcatatccccaagaacgatacccaccagggtacacgcgattagcggacggtgaaactgaaattcatcgaggattgatcccatacctgcgatacaggctacgataaataccagcacaatttgaagagtggtaatctccattgtacttctcctgtttacgtaagactaaagtgtgaaaactgaatgataatcaacacaatacgttacttatcgattttgctgatcagatccatcattttcagtttcggatcggtggaaaccttacggacttccagctcaataccgcgcgcattcagtttcttgaacgcctcgatatctttttcatcaaccgaaaccgcgttattcacctgggttttaccctgacggaatgccataccaccgacgttaacagaggtgattttcacgccgccttcaacgagacgctctacatctgttgggttggtaaataacagcattacgcgttcgccagcatatttcgggttgttgtagacgcgaatcattttggcaacatcaactacgtgtgctgttacgcccggaggtgcaacctgggtgagcagtgtcttacgaacggtatctgcagccacttcatcactaacaacaataatacgggagacattggtttctttggtccagcgggtggcgacctgaccgtgaatcagacggtcgtcgatacgagcaaggccaataaccatgtagtcgtttggtcccattggttttgccggagttggagccgcttttggtgctgcggtagcgggtgctggcgcggctttttcaaccggtttggctttcagtgctttcacgccttcacggcctgtttctactgccagcgccaccagttcatcaaagcttgggtcatcatcacgggccattaacgtttccacgagcattggaatgttaacgcctgcaatgacttcataatgctctttgtcgacgacaatgcggctggcagcattgaacgggctgcctccccatgtatcaacgagaaacagcacgcctttagtggtgtcgagttttgccaactgagcgttgtacttttcaatcagcgtttcggcattttcacctggaacgaaatcgatccagccgacgttttcctgctcgcctaacagcatttctgccgttttaagcaactgctctgcagcccaaccatgtgtgcctataacaatagcaatggtcacttgctacctcctttattatcgttaacacctcaacgtgccagatgtgtttttgaatcgtcgtccacaatcgaatcgattcagataagggctacaaccaaaaacccctgcgtttcgcgatttattttagatatcgaaaaaattattttatgtgatgaagatccgtaatttaactttcgattagcagaaatttcgaaaggtaaaatatccttgtcacattcgtttgcaaaggaaggtaaatctttgccaaatcagaggcgtctctgatatgtttaactcctgtttaacaaccatggagtatagggcagtagcccgcagtatggatcgtcaccgacgtcatttcagcatcaggccttttaacgcctgcctttctggcactttatgccgcacctttcgtttgcattttgtcgttacgcctgcattatttctggcgtcgaatagctattccttaagcaggagcttgtcatggaattcttaatggacccctcgatttgggcggggctactcacgcttgttgttctcgaaattgtgctgggtatcgataacctggtcttcatcgccattcttgctgacaaactgccgccaaaacaacgcgataaagcgcgtttgctgggattatcactggcgctgattatgcgtctggggctgctgtcgctgatttcatggatggtcacgctgaccaaaccgctatttaccgtcatggatttctccttctccggacgcgacctgattatgttgttcgggggcatattcttgctgttcaaagcaacaactgaactgcatgaacggctggaaaaccgcgatcatgattccggccacggtaaaggctacgccagtttctgggtggtcgtcacacagattgtcatccttgacgccgtcttctcgttggatgcggtaattactgcagtagggatggttaaccatttgccggtgatgatggcggcggtagtgattgcgatggcggttatgctgctggcatcaaaaccgctgacgcgattcgttaaccagcaccccacggtggtggtgctctgtctgagcttcctgttaatgattggtctgagtctggtggcagaaggtttcggtttccacattccgaaaggttacctgtatgccgcgattggcttctcgatcatcatcgaagtgtttaaccagattgcgcgtcgcaactttattcgtcaccagtcgactttgccgctgcgagcgcgtactgccgatgccatcctgcgtttgatgggcgggaaacgtcaggccaatgttcagcacgatgccgataacccgatgccgatgccgatcccggaaggtgcgtttgccgaagaagaacgttacatgattaacggcgtactgacgctggcgtcgcgttctctgcgcgggatcatgacgccgcgcggtgaaataagctgggttgatgctaatctcggggtcgatgaaatccgcgagcaactgctctcctcaccgcacagtttgttcccggtatgtcgcggtgaactggatgaaattatcggcatcgtacgtgctaaagaactgctggtggcgctggaagagggagttgatgtggcggcgatagcttcggcgtctccggcgattatcgtcccggaaaccctcgatccgatcaacctgctgggcgtgctgcgtcgtgctcgcgggagctttgttatcgtgaccaacgagtttggtgtggtacaaggtctggtcacgccgctggatgtgctggaagccattgcgggtgaattcccggacgctgacgaaacgccggaaatcattaccgacggtgacggctggctggtaaaaggcggtacagatttgcatgccttgcagcaggcgcttgatgttgagcaccttgccgatgacgatgatatcgcgacggtcgcgggcctcgtgatctcggcaaatggtcacattccccgtgtgggcgatgtgattgatgtagggccactgcatatcaccatcattgaagccaatgattatcgtgttgatctggttcgcattgttaaagagcaaccggcgcacgatgaagatgagtaagcgttaacgtaacggcataatgggggtgatatgtccattatgccgggcgggcggcggttggctgcccgccagccatttgggaaaatcacatagtggcatcggctgtgcgtacaaatacccttgcaaaatatggacgccatgacggcgcaaatatttcgcctgttcttgcgtttccacaccctccgccaccagttcaatattcagtctttgccccagtgcgatgatgatatcggtcaccgtcgagttaaccgcgtcagaacctatagctgcggtaaatgacttatcaattttcagcacgtcaggacgtaatgtttcaagccaggaaaatgaactattgccggtgccgaagtcatcaatcgccagtttgacgtttttacgatgtagctcgcgggcaatccgataatcaacatccagtaaggcatcgcgttcggtgatttcgaggatcagttgctgaatcgggtgagcgctaaaccagtactgattgagatcttttatcagcacaccacggcgaaaatggctgggtgcgacgttaatgccaacatgaaactgactactcatcgggaaaacatggcgctgacgaatggtttctgccatcacatagcgggtcagtggcacaattaaatgatgttcttccgcgataggaataaacacatccggcgaaatccagccctgacgcggattgttccagcgcagcaaaatctctacgccaatacattgctggctgcgcgcattaagcaaaggctggcagaacaattcgaactcatgttgcgccaggcccagattgatttcgcgggaaaaactcattcggtaagcggtcgccagccaggcgatatagcccacaagtaaacttagcagcaccgccagcggtaattgtgttggaagatagtgccatgccagcgccgtagcccccggaccattaacgttaatggtaaaaggaaagcgttgcgaagaaacctgatagttttcattgttttcaggttgcggaagggaatctaccagcccattaccatagagcaaatgccgactgtccaccgtcaggctggcgctactgatttgcggcagttgtggttcaaggagcattgccgtcagtaagtcgatgttaatcatctccatgaccccagcattgctactgcccgctgcaggcgtccattgaatcaaaaccggactgccttttatcagggcacggtcggtcgtcagtcgtaaaagtggttgcggtgcaggaagttcagccagaatgtccacgacgggcacattgcgataaccaaaaatgctggagcaataaagtgtgccgtcttgcaccaggccaatggatcgcacagtttggagttttgccgcctgtttacgtaatggcaaatgggcgacagagcagggcagaccaatcagcggaagcaagacttcgctacctgcctgtaggggaagcagtactttatctaattcctctacagcgtgattggcgaattgtactacccgttgttgatttaagttacgctgtgaaataaatcgcacgctcagggtcgaagcgagcgtaacgagtgcgcaaatcgtacaaacaatcattcgattacggcgataggttttaatgatccgttgtgctttttgcatgcgggccaccctgtaagcgtatggcgacaaacgcctgacgcaacagtggaagtgtagtggggaaaattacagcagacgagaaagcgggaataaattcgcccatccgttgcagatgggcgaataagaagtattagtcacactggactttgattgccagaccaccgcgtgaggtttcgcggtatttagcgttcatgtccttaccggtttcgtacatcgtttcgatgaccttatccagcgagacgcgcggtgcactggtgcgacgcagggccatccgcgcggcgttaatcgccttcacagaggcaatggcattacgttcaatgcacggcacctgaacttgccctgcaacggggtcgcaggtcagaccgaggttgtgttccatgccaatttccgctgccacacaaacctgttccgggctaccgcccaacagctcggcaaggcccgcagcagccattgaacaggcaacacctacttcgccctggcaaccgacttccgcaccggaaatagacgcgttcattttatacagtgcaccaatcgcgcccgctgccataaagtaacgggtatagatgtctgggctaactgattcaataaagtggtcatag

SEQ ID NO: 9998 - DNA, 12190 bp, Escherichia coli
gtgcatctaacgccggttactggctgctgtcgattactgataagcatctctacagcatgggtgcagccgtctttttcgaaaacctctgtggcgggatgggtacatcagcctttgtcgcgctgttaatgacgctgtgtaataagtcattttccgctactcaatttgccctgctctcagcgctttctgctgtagggcgagtttatgtcggccccgtggcgggttggtttgttgaagcacatggctggtcgacattctatctattctccgtcgccgctgccgtaccagggcttattttgctgctggtttgccgccagacgcttgaatatacacgagtaaatggcaactttatctcccgtaccgaatatcctgcaggttatgcctttgccatgtggacactggcggcgggtatcagcctgttggccgtgtggttactgctgttgacaatggacgcgctggatttgacgcacttctctttcctgcctgcgctgctggaagtcggggttttagtcgccctttctggcgttgtgcttggtggtttgctggattatctggcgctacgaaaaacacatctgacgtaatctgtaatattatttagctgtagtaatcactcgccgtaattattacggctaaataaacatcagcatcgcttattaatatttgttcttttgtgcggcttagcgtttggaaattattgacgcaatttatgaattctatttttcttacacgattcagctaatgagtccttattttctcaccacccagttgtcacctcaatgataattatttgttaaataattgttttattttatattgattataccaattgcccacccaaactccttctgcactcccctttcgttataacgcccttttgcaacagcttcttaaaatcaacttgatatgttttgcaacatatgtgacctgatagccaaatccaagtaacaggaatttaatcatgtttacagtaatgtaaccttcccgtaaaatgcccacacactttaaacgccaccagatcccgtggaattgaggtcgttaaatgagactcaggaaatacaataaaagtttgggatggttgtcattatttgcaggcactgtattgctcagtggctgtaattctgcgctgttagatcccaaaggacagattggtctggagcaacgttcactgatactgacggcatttggcctgatgttgattgtcgttattcccgcaatcttgatggctgttggtttcgcctggaagtaccgtgcgagcaataaagatgctaagtacagcccgaactggtcacactccaataaagtggaagctgtggtctggacggtacctatcttaatcatcatcttccttgcggtactgacctggaaaaccactcacgctcttgagcctagcaagccgctggcacacgacgagaagcccattaccatcgaagtggtttccatggactggaaatggttcttcatctacccggaacagggcattgcagccgtgaatgaaatcgctttcccggcgaacactccggtgtacttcaaagtgacctccaactccgtgatgaactccttcttcattccgcgtctgggtagccagatttatgccatggccggtatgcagactcgcctgcatctgatcgccaacgaacccggtacttatgacggtatctccgccagctacagcggcccgggcttctcaggcatgaagttcaaagctattgcaacaccggatcgcgccgcattcgaccaatgggtcgcaaaagcgaaacagtcgccgaacaccatgtctgacatggctacgttcgaaaaactggccgcgcctagcgaatacaaccaggtggaatatttctccaacgtgaaaccagacttgtttgccgatgtgattaacaagtttatggctcacggtaagagcatggacatgacccagccagaaggtgagcacagcgcacatgaaggtatggaaggcatggacatgagccacgcggaatccgcccattaaaggggttgaggaagaataaagatgttcggaaaattatcacttgatgcagtcccgttccatgaacctatcgtcatggttacgatcgctggcattattttgggaggtctggcgctcgttggcctgatcacttacttcggtaagtggacctacctgtggaaagagtggctgacctccgtcgaccataaacgcctcggtatcatgtatatcatcgtggcgattgtgatgttgctgcgtggttttgctgacgccattatgatgcgtagccagcaggcccttgcctcggcgggcgaagcgggcttcctgccacctcaccactacgatcagatcttcaccgcgcacggcgtgattatgatcttcttcgtggcgatgcctttcgttatcggtctgatgaacctggtggttccgctgcagatcggcgcgcgtgacgttgcgttcccgttcctcaacaacttaagcttctggtttaccgttgttggtgtgattctggttaacgtttctctcggcgtgggcgaatttgcgcagaccggctggctggcctatccaccgctatcgggaatagagtacagtccgggagtcggtgtcgattactggatatggagtctccagctatccggtataggtacgacgcttaccggtatcaacttcttcgttaccattctaaagatgcgcgcaccgggcatgaccatgttcaagatgccagtatttacctgggcatcactgtgcgcgaacgtactgattattgcttccttcccaattctgacggttaccgtcgcgttgttgaccctggatcgctatctgggcacccatttctttaccaacgatatgggtggcaacatgatgatgtatatcaacctgatttgggcctggggccacccggaagtttacatcttgatcctgcctgtattcggtgtgttctccgaaattgcggcaaccttctcgcgtaaacgtctgtttggttatacctcgctggtatgggcaaccgtctgtatcaccgtgctgtcgttcatcgtctggctgcaccacttctttacgatgggtgcgggcgcgaacgtaaacgccttctttggtatcaccacgatgattatcgccatcccgaccggggtgaagatcttcaactggctgttcaccatgtatcagggccgcatcgtgttccattctgcgatgctgtggaccatcggttttatcgtcaccttctcggtgggcgggatgactggcgtgctgctggcagtaccgggcgcggacttcgttctgcataacagcctgttcctgattgcgcacttccataacgtgatcatcggcggcgtggtcttcggctgcttcgcagggatgacctactggtggcctaaagcgttcggtttcaaactgaacgaaacctggggtaaacgcgcgttctggttctggatcatcggcttcttcgttgcctttatgccactgtatgcgctgggcttcatgggcatgacccgtcgtttgagccagcagattgacccgcagttccacaccatgctgatgattgcagccagcggtgcggtactgattgcgctgggtattctctgcctcgttattcagatgtacgtttctattcgtgaccgcgaccagaaccgtgacctgactggcgacccgtggggtggccgtacgctggagtgggcaacctcttccccgcctccgttctataactttgccgttgtgccgcacgttcacgaacgtgatgcattctgggaaatgaaagagaaaggcgaagcgtacaaaaagcctgaccactatgaagaaattcatatgccaaaaaacagcggtgccggtatcgtcattgcggctttctccaccatcttcggtttcgccatgatctggcatatctggtggctggcgattgttggcttcgcaggcatgatcatcacctggatcgtgaaaagcttcgacgaggacgtggattactacgtgccggtggcagaaatcgaaaaactggaaaaccagcatttcgatgagattactaaggcagggctgaaaaatggcaactgatactttgacgcacgcgactgcccacgcgcacgaacacgggcaccacgatgcaggcggaaccaaaatcttcggattttggatctacctgatgagcgactgcattctgttctctatcttgtttgctacctatgccgttctggtgaacggcaccgcaggtgggccgacaggtaaggacattttcgaactgccgttcgttctggttgaaactttcttgctgttgttcagctccatcacctacggcatggcggctatcgccatgtacaaaaacaacaaaagccaggttgtctcctggctggcgttgacatggttgtttggtgccggatttatcgggatggaaatctatgaattccatcacctgattgttaacggcatgggtccggatcgcagcggcttcctgtcagcattctttgcgctggtcggcacgcacggtctgcacgtcacttccggtcttatctggatggcggtgctgatggtgcaaatcgcccgtcgcggcctgaccagcactaaccgtacccgcatcatgtgcctgagcctgttctggcacttcctggatgtggtttggatctgtgtgttcactgttgtttatctgatgggggcgatgtaatgagtcattctaacgcaagcagcggcgcatcccatggcagcgtaaagacctacatgacaggctttatcctgtcgataatcctgacggtaattccgttctggatggtgatgacaggggctgcctctccggccgtaattctgggaacaatcctggcaatggcagtggtacagattctggtgcatctggtgtgcttcctgcacatgaataccaaatcagatgaaggctggaatatgacggcatttgtcttcaccgtgctaatcatcgccatcctggttgtgggctccatttggattatgtggaacctcaactacaacatgatgatgcactaagagcggcggttatgatatttaagcaatacctgcaagtaacgaaaccaggcatcatctttggcaacctgatctcggtgattgggggattcttgctggcctcaaagggcagcattgattatcccctgtttatctacacgctggttggggtgtcactggttgtggcgtcgggttgtgtgtttaacaactacatcgacagggatatcgaccgaaagatggaaaggacgaagaatcgggtgctggtgaaaggcctgatctctcctgctgtctcgctggtgtacgccaccttgctgggtattgctggctttatgctgctgtggtttggcgcgaatccgctggcctgctggctgggggtgatgggctttgtggtttatgtcggcgtttatagcctgtacatgaaacgtcattctgtctacggcacattgattggttcgctctccggcgctgcgcctccggtgatcggttactgtgcggtaaccggcgagttcgatagcggcgcagcgatcctgctggctatcttcagcctgtggcagatgcctcactcttatgccatagccattttccgctttaaggattatcaggcggcaaacattccggtactgccggtggtgaaaggcatttcggtggcgaagaatcacatcacgctgtatatcatcgcctttgccgttgccacgctgatgctctctcttggcggctacgctgggtataaatatctggtggtcgccgctgcggtgagcgtctggtggttaggcatggctctgcgcggctataaagttgctgatgacagaatctgggcgcgcaagctgttcggtttctctatcatcgccatcactgccctctcggtgatgatgtccgttgattttatggtgccggactcgcatacgctgctggctgctgtgtggtaacacaacctctcagttaaaaaggtgctacggcaccttttttcttagcattagaatcatatccctctcgaaatatttactaaaaaatccgcatgtttaccccattcgtttgccgctttacactagtcgcgaatttaaaacagaggtggtaatgaacgattataaaatgacgccaggtgagcggcgcgcgacctggggtttagggaccgtattttcattacgcatgctgggcatgttcatggttctgccggttctgaccacgtacggcatggctctgcaaggtgccagcgaagcattaatcggtattgccattggtatttatggtctgactcaggccgtttttcagattccgtttggcctgctttcagaccgcattggtcgcaaaccattaattgtcggtgggctggcggtgtttgccgccggtagcgttatcgctgcgctctctgactccatctggggaattattctgggccgggcgctacaaggctccggtgcgattgccgctgccgttatggcgctgctttccgatctcacgcgcgaacaaaaccgcaccaaagcgatggcgtttatcggcgtgagctttggcattacctttgccattgcgatggtgcttggcccgatcatcactcacaaacttgggctgcacgtgctgttctggatgatcgctattctggcaacaaccggcattgcgttgaccatttgggttgtgcccaacagtagcactcacgtacttaatcgtgagtccggaatggtgaaaggcagtttcagtaaagtgctggcggaaccgcggctgctgaaactcaactttggcattatgtgtctgcatattttgctgatgtcgacctttgttgccctgcccggacagctggctgatgcggggttcccggcggctgaacactggaaggtctacctggcaacgatgttaatcgcctttggctcggtcgtgcctttcattatctacgctgaagttaagcgcaaaatgaagcaagtctttgtcttttgcgtcgggttgatcgtggtcgcggaaattgtgttgtggaacgcacaaacgcagttctggcaactggtggtcggcgtgcagcttttctttgtggcgtttaatttgatggaagcccttctgccttcacttatcagtaaagaatcgccagcaggttacaaaggtacggcgatgggtgtttactccaccagccagtttcttggcgtggcgattggcggttcgctgggcggctggattgacggcatgtttgacggtcagggcgtatttctcgctggcgcaatgctggccgcagtgtggctggcagtcgccagtaccatgaaagaaccgccgtatgtcagcagcttgcgcattgaaatcccggcgaacattgccgcaaacgaggcgttaaaagtgcgtttgctggaaactgaaggcatcaaagaagtgttgattgcagaagaagaacattcagcttatgtgaaaatcgacagcaaagtgacgaatcgctttgaggttgaacaggcaattcgccaggcataaaagcgaggcgaaattgcctgctgcgctacgcttatcaggcctactaagttcctgagttacaaacctttgtaggccgaatcaggcgttcatgccgcatctgacatgaacaaagcgcaggttgtcgcgattaatcgcggaagtttttgaactggaacggctgaccgagatcgccaccacgtaccatcgccatgacagcctgtaaatcatcacgagatttacccgttacgcggatctcatcgccctgaatttgcgcctgcactttcagtttgctgtctttgatcattttgacgattttcttctgagtcgcgctctcaatgccctgtttcagtttcgcttccacaaaccaggttttaccgctatgaacgatattttccggtacatccagtgaactgccttcaatgccgcgcttcagcagcttggcacgcagaatatccagcaactgattgacctggaagtcggactcgctcaacactttgatggttttgctggcgtcattcagctcaaatgaagcttcaacattacggaagtcaaaacgggactccacttcgcggctcgcgttatcgaccgcgttacgtgcttcctgaagatcaacttcagagacaatatcgaaagatggcatcttttcctctcccttcatttttgatgcgaagcataatacccgcaaagttaaataaccgacagtcccgcaccaggacgtatcccttaattgtgcatagtcgcaacagcatgcacaattaagggatagccttattgaacacccggagtggttgcgggtgaggaggaacaatgaaaattaccgtattgggatgcggtgccttagggcaattatggcttacagcactttgtaaacagggtcacgaagttcagggctggctgcgcgtaccgcaaccttattgtagcgtgaatctggttgagacagatggttcgatatttaacgagtctctgaccgccaacgatcccgattttctcgccaccagcgatctgctcctggtgacgctgaaagcatggcaggtttccgatgccgtcaaaagcctcgcgtccacactgcctgtaaccacgccaatactgttaattcacaacggcatgggcaccatcgaagagttgcaaaacattcagcagccattactgatgggcaccaccacccatgccgctcgccgcgacggcaatgtcattattcatgtggcaaacggtatcacgcatattggtccggcacggcaacaggacggcgattacagttatctggcggatattttgcaaaccgtattgcctgacgtcgcgtggcataacaatattcgcgccgagctgtggcgcaagctggcagtcaactgtgtgattaatccactgaccgccacctggaattgcccgaatggtgaattacgtcatcatccgcaagaaattatgcagatatgcgaagaagtcgcggcagtgatcgaacgcgaagggcatcatacttcagcagaagatttgcgtgattacgtgatgcaggtgattgatgccacagcggaaaatatctcgtcgatgttgcaggatatccgcgcgctgcgccacaccgaaatcgactatatcaatggttttctcttacgccgcgcccgcgcgcatgggattgccgtaccggaaaacacccgcctgtttgaaatggtaaaaagaaaggagagtgaatatgagcgcatcggcactggtttgcctcgcccctggtagtgaagagactgaagccgtcaccactatcgacctcttggttcgcggcggtatcaaagtcaccactgccagcgtcgccagcgatggtaacctggcgattacctgctcgcgcggcgtgaagctgctggcggatgcgccgctggttgaagtggctgatggcgaatatgacgtgattgtgctgcctggtggcatcaaaggcgcagagtgttttcgcgatagcaccctgctggttgaaaccgttaaacagttccaccgttccgggcgtatcgtcgcggctatttgcgccgcgccagccaccgtgctggtcccgcacgatatcttcccgattggcaatatgaccggcttcccgacgctgaaagacaaaatacccgccgaacaatggcaggacaagcgcgtcgtctgggatgcacgggtaaaattgctgaccagccaggggccaggtacagctatcgactttggtctgaaaattatcgacctgctggttgggcgcgagaaagcccatgaagtggcatcacaactggtgatggcggcagggatttataattattacgagtagtgtcggatgcggtaaacgtcgcatctgaccagatgcgacgttacaaccacatattacgggcgatacaccttcacattgttaaagccctgctcgcgcagatagagcgcctgcaggcggctcatcaccccgcgctcacaccacaacagccaggttttgctctggtcgagatcgccaaatttggtgctcagtttatagaacggcagagaaaccacatcaatcccttcgactttcagtggcttatcttcctgttcatcgatagaacggatatcgaggatcacgtcgttcgggccgaagccattgacggtttccacttccaccacttcctgctcggtctgctgggcgatttcgcggatatcaacgttattcgcttcctccaccactttatcgagaatgctgaagtcgaacttctcttcttccgcttcaatcttcgatttaaccgctttcaccgtcgggcttttggaaatcacgccgcaatattccggcatcgtgcgggcaaagtcttcggtgccaatctggcgagccaggttgatgatgtgctctttgtcgtaagagatcagcggacgcaggatcagcgtatcggagacgttatcaatcaggcgtaggttggtcagcgtctggctggacacctggccgagcgcttcaccggtaaccagcgcctgtacgccgtaacgttctgccactttggacgcggcacgcaccatcatacgcttgaggataacgcccatctgaccgtcgtcgattttctcgagaatttccccgacgaccggttcaaaattaatagcgacaaaacgcacgcggtgggagctgccaaagcggttccacagataatgcgccacctgacgtacgccaatttcatgcgccgcgccgccgaggttaaagaagcagtaatgcacgcggcagccgcgacgcatcaacatataactggaaacaccggagtcgaaaccaccggaaatgagcgacaacacatcttcctgggtgccgatcgggaaaccgccaataccttcgtagcggcctttaatcagcagcagacgatcgtcttccacttccagatggacagtcacttccggattggtcagcttcacgcgcgcggattcaatatgctgatttaaaccgccgccgacgtaacgttccacatcaatcgagctaaaatcatgtttgccgcggcgcttcacgcgtacgcagaaggttttgccttccagctgatcgcgatattgaaccaacgctttctcgaaaatatcgtgcatgtcggtaaacggcacgtcttcgacttcgagaatatggtggatacccggaatacgggtcagggcgtcgcgaatagccagacgctggttttcatcttttgcgcgaacttcgatgttatcccagtgacggacgacagcgagcgtctcatcatagtgctttaaaacgttacgaatgttcccggtaaggatttttataaagcgcaagcgcacagattggcttttgatggtgatttccgggaacaatttaatgataaacttcatggcggcaatggttcgttggcaagccttaagcgacttgtatagggaaaaatacagcagcccacacctgcggctgcatccaggcgcggaagtataccactaacatcgctttgctgcgcacatcaccttaccattgcgcgttatttgctatttgccctgagtccgttaccatgacggggcgaaaaatattgagagtcagacattcattatgccgaagaaaaatgaggctcccgccagctttgaaaaggcgctgagcgagctggaacagattgtaacccgtctggaaagtggcgacctgccgctggaagaggcgctgaacgagttcgaacgcggcgtgcagctggcacgtcaggggcaggccaaattacaacaagccgaacagcgcgtacaaattctgctgtctgacaatgaagacgcctctctaaccccttttacaccggacaatgagtaatggactttccgcagcaactcgaagcctgcgttaagcaggccaaccaggcgctgagccgttttatcgccccactgccctttcagaacactcccgtggtcgaaaccatgcagtatggcgcattattaggtggtaagcgcctgcgacctttcctggtttatgccactggtcatatgttcggcgttagcacaaacacactggacgcacccgctgccgccgtagagtgtatccacgcttactcattaattcatgatgatttaccggcgatggatgatgacgatctgcgtcgcggtttgccgacctgccatgtgaagtttggcgaagcaaacgcgattctcgctggcgatgctttacaaacgctggcgttctcgattttaagcgatgcagatatgccggaagtgtcggatcgcgacagaatttcgatgatttctgaactggcgagcgccagcggtattgccggaatgtgcggtggtcaggcattagatttagacgcggaaggcaaacgcgtacctctggacgcgcttgagcgtatacatcgtcataaaactggcgcattgattcgcgccgccgttcgccttggtgcattaagcgccggagataaagggcgtcgtgctctgccagtactcgacaagtacgcagagagcatc

SEQ ID NO: 9999 - DNA, 3851 bp, Escherichia coli
ctttacaacccgaaggccttcttcatacacgcggcatggctgcatcaggcttgcgcccattgtgcaatattccccactgctgcctcccgtaggagtttggaccgtgtctcagttccagtgtggctggtcatcctctcagaccagctagggatcgtcgcctaggtgagccgttaccccacctactagctaatcccatctgggcacatccgatggcaagaggccctaaggtccccctctttggtcttgcgacgttatgcggtattagctaccgtttccagtagttatccccctccatcgggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgttaagaatccgtatcttcgagtgcccacacagattgtctgataaattgttaaagagcagtgccgcttcgctttttctcagcggcgcggggtgtgcatgatacgctttcccgctacagagtcaagcatttatttttgctttctctgccgaagttctcaggagaaccccgctgacccggcggcgtgtttgccgttgttccgtgtcagtggtggcgcattatagggagttattccggcctgacaagaggaaatttaaaataattttctgaccgcgcaacattcaaccaaatcagcctaaaactgccagtttttcgagcgtttcgaagccgtaacgctgtaaaacgggcaataattgttcagcttctggcgtcattgccatacaaaaggcaatattcgcatcggcagattttgcatccggggcttcatgttctaacagccaggccgttcggcgagcaatcgctgcgccagaatccaccagccgggttccctctggcagcacctgtaacagttcttcttgtagtagagggaaatgggtacaccccagtacaacggtatctggcggctctttcattcttaaccacgggcgtaggatacgttttagcgcatccagagaaacatcttcgccatgcagcttcgcttcagccaactcaaccatctctgccgagcccagcatttctatctggcattcattagcgaaacgcgcgatcagctcatgagtataagaacgtttaacagttccgcgggttgccagtaatccgacaatgccatttgccgtcagacgtgcagcaggtttaatcgccggcacgacaccaacaaccgggaagtcgaacttttcgcgtaatgcaggaagtgaaacggtactggcggtgttgcaagcgaccacagccagcgcaaggggataacgttcttgcactgcggtgacaatttccaccactcgctcaacaataaacacttcgcttttttcgccatacgggaaagcgacgttatcgaaagcataaatgtaatggagatccggtaagagatgccggatctcgtcatagaccgacaacccaccgacgccggagtcaaacaccagcacggtgggacgtggttcagaaggtgtagctgccagacaaggtgtattcccgtcctgcagtttggtagccatagactgtctcataatctttgtcgaacaggttggctattttaccacgaactgtcaggtgagaggtgaccggatacgcaaccgcaagatcccacaagctcacaccgcccattttaacggtttgataaggataagatgagtaatccttatcatagcgagtgcctaaatactgataagtaatcccccagtcgaagtcatacaactgccagtcgagctggtatttcacctgctgtttagcacggcgtaacaacggcgtgtcagtaattgcattgcgcgcatcaacataatcataactcacagtatgcgtcagtggtccggtatcaaaattagcggtcgcctcgacacccttaatccgcgctttcccttcgttgtaatatttcagggtgtgatcatcataatcgatcaagtcactgacatcgttacgatatccggaaatacgccagttaaccccagcagttaagccttcaaacgcgccttcccattgtttgcttttctcaggattcagattcggattaccgtaggtgccatacagttgcccaagatttggtgccttataagatgttccgtaggaagcaataaagcgataaccttcgatgaactcccaaccggcgctggtttgccaggtaccatgacgaccaaactgagaattatcgtcgctgcgtcctgcgccttcaaaagtaaaatcgccgacttgttgcagcccagtcagatagatgccggtattacgttgatcatatccatcctcaacataagctgtgcccggtgccgtgctctgcttctgccagtcaacacccgcaccaatattaccgtggccaatgatgatgttgtttgcccactggacggtgtactgtttcatctcatcgagcgtcgcggacgaatcataacgaccataatgcggatcgtagttgtaatctttgctatggctgtagctggtaatcagttgtgatttaatcagttcgccgttatagcgcagtccggcatcccaactttggctatagagtttacgggtatcgaccagtggcaagccgggagaataatatgcgtcataattggtacgattatcatagccatagccgcgcacaaagccgctccagacatcagtaaaattatgctccagcgcgccataaagcgttttacttaaaaaaccatcgttatctggctgcgcttgcgttccggtattaccataggcgacaacatcataaccatgagtatgggcataatcgcccaacagcgttacccgtgtcttatcccccagttgttgctgtgtagaaacatcatagttctgataactattgcttccccaccctgctgaaatttccgttccggggtgatcgcgcgtcgtgatgatattcacgaccccgcctattgcatctgaaccataaacagcggagcgcggcccacggatatattcaacacgctggacaagcgcaatagggaactgactaagatcagcagaaccactcacccccgccaaattcaggcggacgccatcaattaacaccaacacatgactggcatttgtaccgcgaataaaaatagatgagagctgacctgaaccgccgttttgggtgatatccacgcccggaagacggcgcagcacatcattgaccgaggtcgactgccagcggtcgatatcctgacgcgtcacaacagtagttggcgcaagcacagtgctgcgcggttgttcaaaacggttagcagtaacgacgagagtatccgggctggtatcctgtgcccaagcggaaaatgccgtgacagaacacgccgtcagcagcgaagcttttttaatcattgtaaagcatccacaatagaagaaggatgccgcaggtttcatcaatattacgcgatgatgagaaccagatgcgacgttggccggcaggtcttcgggcttggaggggtatctaagatactaagagatgatgacttcccaccggatggcagtgtccgcataacgcaatcatcgcacctttccttaccgctgcgcgtcagctccagattcgcactggattccctattaactcacaggaccggcaagtggatgctacaggttgtaacaagttactgtccagacgtagctcacaaataggaattcatcaagatctggacatctgatgagcaatccctacaatcgccgcgtactttaatttttcaggatacatcatgacccccgaacaccttccaacagaacag

SEQ ID NO: 10000 - DNA, 58754 bp, Escherichia coli
tcgcccgccaaccatgcagattactgattttcctcaatcagcaacgcttcaagcaaatcgagatcgtgcagtaatttttgcagcgtttcgttactgatctcccgcgtggcgcgcaggtggtacagttcagcacgttcagaacgcaatgccgccagacggaagcgacgctccaggttctcttccaggattgaactttctacatcattacgtccatcggcgcgacgacgcaggttaccaatgacgcgagaactaacctctgtgagcagctggttatcgatattctcttcggtatccgccgccagacgctcctccattttctggatcgccacaatcgccacttctgccgttgccgctcgtgcaatacgttcctctttcaattgttgcgaatggtccgcgacttctatgtgttgtagcagaataggcaacatcaccacgccgacaaacaatgagaagagaatgacgccagccgctaggaacaccaactcatagcgcgcagggaagacgttaccatccggcaagagaagcgggatagagagcacaccggccagagtgatcgccccacgcaccccggcgaaagacgcgatcaggatttctcgtgtagtccacgaaccaaactccatcggcttcttcttcaggaagcggttgctgaactttttcatcgtccacagccagccgaaacggaccagcatcagcgccgcatatatcagaataatatcggtaaacagcatccagatttcgacgttagggtcgatttctgccgccatcagcgacgtctccagaatccccggcaactgcagacctaacagcaggaacaccatgccgttaaagacaaattccagcatcgcccaggtgctgtttgcgcgcaggcgcattgccagcggcgcacggcgcatcacaccggagcgggtgatggtcatcccggcggcaaccgcagcgaggatgccggaaacgccaatatgttccgcaatcagataagaagcgaatggcagcaagaacagcagaacgatctgcgtcgcgggttcatcaccgccccagcggctgaggaatcgcagcgagcgaccatacagccagctcaccacaaaaccggcgagaataccgcctattgccactttcataaattcgaccgtcgcaccgccgacggtgaagatcattgtccccatcgccactgccacggcaaacttcaacgacaccaggccggaggcgtcattcatcaacgcttcgccctgcaaaatgcccatgatttttttcgggatgcgcccctcgccaacaatcccggagagcgctacagcatcggtcggagaaagcaccgcagccagcgcaaaggcggggatcagcggaatgcccggcaccacccagtaaataaggaagccaatgccgaccacggtgaccaccaccagcgccagcgcgaggccgaaaatctctcgcccatgttcgagaaattcacgggtcggcgttttccagccatcagcgaacagcaacggcgggataaacaagactaaaaagagttcaggatcaaactccacatgcaaaccaaacgtcggccacgccagtagcgcaccgatggcgatttgcataagcggaagcgggatctgaaagggcatgacacgagtgaccaccccggacagcgagaccacgagggtcattatcagtatggtgaagaagatttccatgcgttccctgtttgcgatgttttttatgatctgagaaaggcgttatgcctgaattctcattttttcagaatatcgcaaaagctcacacaatgtgcggagaaaataaaaacgggcagccattgccacccgttttcagaatcctatgtaagattagatagcccagccacccgcatagaaggtcaccagcgccacggcaataacgaccgtaccgatgttcaacttgcgccattcgccggaaaccagacgaccaatcaccagagtcgcgaagccaatcatgatgcctgttacgatgttacaggtcagcacgatgaataccgccgtaaccagacccgccatcgcatcaacaaaatcagcaaagtcgattttcgccacgttgctcagcatcagcaggccaacgtacatcagcgccggagccgttgcgtaccccggaacgaggtaagagagcggagagaggaacagaatcagcaggaacagcacgccaacggtgatagccgtcaaaccggttttaccgcccgccgccgtacccgccgcagactcgatgtataccgctgccggagctgcacccacgaggccagaaaaaacgctgctcatggagtcggtggtcagtgctttcccgccgtcgatgatctgcccatctttatccagcaggttcgcctgaccggcgacggcacggatagttccggtggcatcaaatactgccgtcatcaccagtgccagaacacttggcaggactacaggattcagcgcacccataatgtccaggctgccaatcagtgaattgccgttttcatcgctcaatgaaggcatggcgaaaacgccggagaaatggacgttaggatcgaagatcaaaccgacaattgagataccgataatggtcagcagaatgccaccagggactttcagtttttccaggccgataatcactgccagccccaccaacgacatcatcaccggaaaggtcgtgaaatcccccagcgcgacgggcagaccatcaagtgggtttttaatcaccagaccgacaccattagcagcaatcagcagcaggaacagaccgataccaatccccgtgccgtgcgccacaccgtgcggcaagttgcgcaaaatccagctacggatacccgtggcagaaattaccgtaaacagcacacccatcaggaacacggcacccagcgcgacaggtacgctaatatgttgccccagcaccagactgaatgcggtaaacgccgtcagagagatggcgcaaccaatcgccaacggcagattagcccacagacccatcacgatagaaccgagtccggcaaccagacaggttgcaacgaaaactgccgcaggcgggaagcccgctttacccagcatgcctggaacgacgataaccgagtagaccatcgccagaaacgttgttaacccggcaaccacttcctgacggacagtgcttccacgttgtgaaattttaaaccaggcgtcgagtgaaccgccggtacgcgctgatggcgtagacataagaaaacatcccctgagagtttaattttcgtcaagatgcgtggcggacaatcccctgccagcgaaacgttatcttcctgctccaggtttgcgacaatttgctgcgtcgcaaaaaaagcaaacgtttagctccgcgcatacaaaacgggtggtaaaaaaagcaaacgattatccggcgatcatagcggctttttcaaccgaagtttgctgcttttttctcttttattgtcttgacgatgaaaaaccaggcaattgatgcgcaaacgttatcgtcgatgcgcaagattgcagcgttatcgagccgtataccgttcaggattgcgataaaaaatcgtctgagatgacaaaaatattgcggctaaaaagtgtacttttacactggcgaagaaacgccggtaacatacaattaaagcatcaacaccaaccggaacctccaccacgtgctcgaatgaggtgtgttgacgtcgggggaaaccctcctgtgtaccagcgggatagagagaaagacaaagaccggaaaacaaactaaagcgcccttgtggcgctttagttttgttcatcttccagtaagcgtgcgccggtaccttcttctcctaatcggtcgcccgggttacgcaacgggcaatcactgcgcgaaaggcagccacaaccaatacatccatccagttcgtcacgcagcgccactaaggtatgaatgcgccgatccaactcttctcgccattgggacgaaagctgtttccactctttcgcacttaacgtatgcccttctggcaacacgccaaacgcttcacgaatggttgcgagcggaatgccaatacgctgagcaattttgataattgcgacatatcgcaacacatcacgtttatatcgccgctgattgccgctattacggatactggtaatcaaccctttgctttcatagaaatgcagcgccgataccgccacaccgctgcgtttcgccacttcgccgggggttagcagcgctttaatgcggggtaatttcttttccataaatcgctttacctcaagttaacttgaggaattatactccccaacagatgaattaacgaactgaacactgaaaagaggcagatttatgtcccatcagaaaattattcaggatcttatcgcatggattgacgagcatattgaccagccgcttaacattgatgtcgtcgcaaaaaaatctggctattcaaagtggtacttgcaacggatgttccgcacggtgacgcatcagacgcttggcgattacattcgccagcgccgtctgttactggccgccgttgagttgcgcaccaccgagcgtccgatttttgatatcgcaatggacctgggttatgtctctcagcagaccttctcccgcgttttccgtcggcagtttgatcgcactcccagcgattatcgccaccgcctgtagttttattgcccgcgcgttaactcccgcgcgggtaattgctccatccattgcataaacacctgcggcggcatcgccttcgcgaagaaccatccctggcaatagcgcacgccgcgtttgcgcagccagttaacctgcgcctcagtttcgacaccttcagcgatcgtttttaaccccaggctgtgcgccagctcgatgatgtgttccgcaatcaaatgactggttttgtgggtggtcagcgtctcaacaaacgatttatcgattttcaaaatatcgacattcaatgatttaaggttatgcaagttagagtagccaataccaaaatcatcaattgccacttcgtaaccggccttgcggaaagccagaataatcggcgtcattttgtcgacatcaagaaatgcatgttcagtcacttcaaatttaatttgctgcggacgcaccgcatgttgctctgttttctgattggttcgcgctatcaaccgtgaggtatgaaaatcggaggctgacaggttaatagaaacatagcgatcggtatgtgttgccagatacgcgcccaaatcacggaagacattatcaataacataatcagttacctgttcgatcatcccctccttttctgccagcggaataaactctgccggattcattacttgcccctgctcaccaggccaacgtaacaacgcttcagcgccgatacatttttctgttttgatatcgattattggctggtaataaaggcaaagttgatgtttttcgagggcgcgttgcaatttgcgtttgggagacaaatagttttgtcgaatacgtagccagagtaatagcagaacaagactccccaaaataccggcgggcaacgcaaaaataagatgattataaaaatgagttataagacgttgatatgaagtcgcaacaatggctgcaattgggcgttttgtcgaataaactgtcgcatataaatagccatttcgttgtacggttaaatcattcaaatgaatcagcggagaaaacgttgctgccgaggcctcgttgcttaacgagaaaaaggttttcgtcaccgtatcatacactccccattgcaatgtcggatcatcagacatcacttcactccagaagagagggttgataaccgccacataatttccccgctgcatgtaggtcattttatagccagagaaaaaaggcgtatcacggtaataatagatagaaacgttaggttcgcgcttataatcggccggtgcaatcgtatagccatttacagacgctatcagcgatgagcataaaaaatggttatcacgagcataaatcaattcattaatataaagatagccacgaataatattcaacattcgcttttgatgggctggagtgcaaacttgcccctgatagcgttcagctgcatcgctcactaaatctgcctgacgaatgaccagctcagatttatccaacgccagctgagcaaaggttcggagctgattattcacttctgattttgcccaaaagaaggcaatccatagcgacagaatgatgggaaagagaactaaaaagataatgcccggaaacgccagtaattggtgtcgtgcacgatgactcattactatcaattccctgcctgtttatacccggttattgcaaggtgaaaccctggctaccgacgtctttagataaatcttacggtataaatagcacttttgcctgatataaaattgagacctttttaatcgtcaccaggatgacgataattcattgatcttaaaaattaatcaccttcaggaatgcagaggcggcgggaagatatacccttaatgccgctgaaaaaacacataatctgtacggcaataaaagtcacggcctaatctggctaacaaacaaccaattgtgatatagttcacaaaattcatgaaacaaacagagtgtttcatttttgtgttctgcaagccccgcgatagccagagtgtatcacgcctcccgtgaacaacgccgcgctgtccagggcatcagctcttttccgaggaattgtttgatggctaccctcaccactggcgtggttcttcttcgctggcaacttcttagtgccgtaatgatgtttctggctagcacgctcaacatccgttttcgtcgggctgattatgtcgggcttgcagtgatcagcagcggtctgggcgtagtttccgcctgctggttcgcaatggggttgcttggcatcacaatggcggatatcaccgccatctggcacaacatcgagtcggtgatgatagaagagatgaatcagacaccgccacaatggccaatgattttgacttgatatgtagaagcctccataacggaggcttcttttttatggctggcagatgctttaatcatccaccttaaaacaatataccctattgttttaaagacaaatcagaacggaatatcgtcatcaaagtccatcggcggctcgttagacggcgctgccggagcggactgctgcgggcgagactgcgcgccgccgctgaactgattgccaccctgcggctgctgaggctgaccccaaccgccctgcggctgaccaccaccgatattgccacctgcaggagcgccaccaccctgacgaccacccagcatctgcatggtgccgccaacgttcaccacgacttctgtggtatagcgatcctgaccggattgatcggtccatttgcgggtacgcagctggccttcgatataaacctgagaacctttacgcagatattcgctggccacttctgccagtttgccgaacagcacaacgcggtgccattcagtctgctctttcatctcgccggtcgctttatcacgccaggattcggaagtagccagcgtaatgttggcaacagcgccaccatttggcatgtagcgtacttccgggtcctgacccagattaccaacgagaataaccttgtttacgcctctgctggccatgttcgtgtctcctgaaaaaaatcgttctgaataagtgtaaacgcgcgattgtaccattaccaatagcgcttttactatgttgtgacctcggttccgggaaacaaacctggccagacattgttacacaacactccgggtaatgcattccaatactgtatattcattcaggttaatttgtgtcataattaaccgtttgtgatcgccggtagcaccatgccaccgggcaaaaaagcgtttaatccgggaaaggtgaatggataagatcgaagttcggggcgcccgcacccataatctcaaaaacatcaacctcgttatcccccgcgacaagcttattgtcgtgaccgggctttcgggttctggcaaatcctcgctcgctttcgacaccttatatgccgaagggcagcgccgttacgttgaatccctttccgcctacgcgcggcagtttctgtcactgatggagaagccggacgtcgaccatattgaagggctttctcctgccatctcaattgagcagaaatcgacgtctcataacccgcgctctacggtggggacaatcaccgaaatccacgactatttgcgtctgctgtacgctcgcgttggtgagccgcgctgcccggaccacgatgtaccgctggcggcgcaaaccgtcagtcagatggtggataacgtgttgtcccagccggaaggcaagcgtctgatgctgctcgcgccaatcattaaagagcgcaaaggcgaacacaccaaaacgctggagaacctggcaagccagggttacatccgtgctcgtattgatggcgaagtctgcgatctttccgatccgccgaaactggaactgcaaaagaaacataccattgaagtggtggttgatcgcttcaaagtgcgtgacgatcttacccaacgtcttgccgagtcgtttgaaaccgcgctggagctttccggtggtaccgcggtagtggcggatatggacgacccgaaagcggaagagctgctgttctccgccaactttgcctgcccgatttgcggttacagtatgcgcgagctggaacctcgcctgttttcatttaacaacccggcgggagcctgcccgacctgtgacggtcttggcgtacagcaatatttcgatcctgaccgcgtgatccagaatccggaattgtcgctggctggcggtgcgatccgtggctgggatcgccgcaacttctattatttccagatgctgaaatcgctggcagatcactataagttcgacgtcgaagcgccgtggggcagcctgagcgcgaacgtgcataaagtggtgttgtacggttctggcaaagaaaacattgaattcaaatacatgaacgatcgtggcgatacctccattcgtcgtcatccgttcgaaggcgtgctgcacaatatggagcgccgttataaagagacggaatccagcgcggtacgtgaagaattagccaagtttatcagcaatcgtccgtgcgccagctgcgaaggaacccgtctgcgtcgggaagcacgccacgtgtatgtcgagaatacgccgctgcccgccatctccgacatgagcatcggtcatgcgatggaattcttcaacaatctcaaactcgcaggtcagcgggcgaagattgcagaaaaaatccttaaagagatcggcgatcgtctgaaattcctcgttaacgtcggcctgaattacctgacactttcccgctcagcagagacactttccggcggtgaagcccagcgtattcgtctggcgagccagattggtgcaggcctggttggcgtgatgtacgtgctggatgagccgtctatcggcctgcaccagcgcgataacgagcgcctgttgggtacgcttatccatctgcgcgatctcggtaataccgtgattgtggtggagcacgacgaagacgcgattcgcgccgctgatcatgtgatcgatatcggtccgggtgcgggtgttcacggcggtgaagtggtcgcggaaggtccactggaagcgattatggcggtgcctgagtcgttgaccgggcagtacatgagcggtaaacgcaagattgaggtgccgaagaaacgcgtacccgccaatccagaaaaagtgctgaaactgacgggcgcacgcggcaacaacctgaaagacgtgacgctgacgctgccggtaggtctgtttacctgcatcacaggggtttcaggttccggtaaatcgacgctgattaacgacacactgttcccgattgcccaacgccagttgaatggtgcgaccatcgccgaaccggcaccgtatcgcgatattcagggactggagcatttcgataaagtgatcgatatcgaccaaagcccaattggtcgtactccgcgttctaacccggcgacctataccggcgtgtttacacctgtgcgcgaactgtttgcgggcgtaccggaatcccgtgcgcgcggctatacgccaggacgtttcagctttaacgtccgtggcggacgctgcgaggcctgtcagggcgacggcgtgatcaaagtggagatgcacttcctgccggacatttacgtaccgtgcgaccagtgcaaaggcaaacgctataaccgtgaaacgctggagattaagtacaaaggcaaaaccatccacgaagtgctggatatgaccatcgaagaggcgcgtgagttctttgatgcggtgccagctctggcgcgtaagctgcaaacgttgatggacgttggcctgacgtacattcgcctcgggcagtccgcaaccacactttctggtggtgaagcccagcgcgtgaagctggcgcgtgagctgtcaaaacgcggcaccgggcagacgctgtatattctcgacgagccgaccaccggtctgcacttcgccgatattcagcaactgctcgacgtactgcataaactgcgcgatcagggcaataccattgtggtaattgagcacaatctcgacgtgatcaaaaccgctgactggattgtcgacctgggaccggaaggcggcagtgggggcggcgaaatcctcgtctccggtacgccagaaaccgtcgcagagtgcgaagcttcgcatacggcgcgcttcctcaagccgatgctgtaatcgttaaggccgctttcagagcggccttcttctttcagagttgcaccagcaatttacgtttttcttccggcagcaaattcaccgcctgctgataagacgcatccaccagataatagatttgcgaatccggcagcgaaccgtcgagatacacggtgctccagtgcgctttattcagatggcggcttggacgcacatcgctgtgctgctgacgtagcagctccgccagctccgggctggttttcagcgaaacagctgggcgattttctacttctttcaccatcgcaaacagcacatcttccactttgatctgcgtcgctttccagtcgttatgcacgctctgttctgcgcctggttttgccatgcaatattgtagcaactccgaaatggtcatttttcactccccttgtagtgtcgcgatgatgcgacgcgatccgccgtggatgcgatgttcccccagccagatgccttgccaggtgccggtctgaatacgccctttatgcaccggcaatacaagcgatgttcccagcattgaggatttgatatgagaaggcatatcgtctgctccctcatagtcatgctcataatttccgttatcgggaacggcgcggaggaaaaaacgctccatgtcgtggcgtacggtgggatcgcagttctcattaagtgtcagagaggcggaggtatgttgcagcaacagatgcagtaaaccgatgttaacgcgcggcatatcagccagctgattcagaatttcatccgttaccagatgaaacccacgagatttggcgctaagcgtgagcgtcttttgataccacatgtgctgctccttgataaaactctcttaatcagtttgcagcaagacagcgaaaggataaaggtgtgattaaaaaaacagcattcgggagagtattacgctctcccgctctgtcagtattctgaattgacgatcacctcttcaccaaacgcacccgcttgtggcaagggtttgtaggtagagttggaggcgcgcagaatgcggataccacgagcgccaacatcgcgtgcggcggtaatatcgttatcggaatcaccataaaaaattcggatatttttatcctgcagccattgcgattttgtattttgacctggcttatcgcccgcaaagatcaccggattcatgttggtggcaggaatatgaaaattatccgccagcgtttttgaaaccgtttctgttttggtcgggctacgaccagtcacaaagaagatcgcgtcaccgcggcgtacatgcatatcaatcagctggcgagcgacctcttttggaatgctgaattcatcccagccattgttcattttttcccagaacacaggatttttcagataatcttcgctttctggcgagaaggtttttttgccgcgccagaaacccggactggaaaaaagtaccgtatcatcgatatcaaaccccaccgccattggcggacgtcctgcgaggctattttcaatttgtgcaaccgaaacccaatgaattggcgcctgttcagcgagtttggctacgttagtacccggattaagcggtgaaggagatgaggccagggcaacagcggaactgtttagagcgaacaataagcaaacggcactcaatgcctgtgtgatcttgcgcatatttttccctaaatagtcagtaagttgaaacttattattgtgcgtttgttgaaaaaaccatctgaccataacgccaaccgcgggggaaaggaaggattatctgcggatttgtcacataaaaagagcatgatcacatttggaatacctgtgcgataaaccacacattgccacggttattctgcttacacattcacacaatggcactcttttggttctcgcaaacattgttcagggaatatactgatgataaatataaatgcattcaatggatgatgaatgaaaatatcgtggaattatatatttaagaacaaatggcgatttcacattacaagcatttcactttttcttatcatgctcgcggtttcaatcgcttttttgcacttgcgttttaataccttgtccggtaccgataaaatgcggcttgaaatgtataagtccacattatattccaccatcgagcaattttatgttttaccctatatgctctcaacagaccatatcatccgtcaggcggtaattacgcctgacgatatgacgtccagcgaactcaatcaacgaattgcacatttcaatactcaactcaaaaccgcagcaatatttattctggatacccaaggtaaggccatcgcttctagcaactggcaggaccccggcagctatgtagggcaaaattatagctatcgcccctattataaacacgccatgtctggcttaaatggacgcttttacggtattggtagcactacaaatacaccgggattcttcctctctacaagtataaaagataaaggaaaaattgtcggtgttgtagtagtaaaaataagtcttaatgaaattgaaaaagcatgggccgaaggtcctgaaaatattatcgtgaatgatgaacatgggattatatttttaagttcaaaatcgccatggcgaatgcgaacactgcaaccgttacctgttcaggaaaaacaaaaactacaatctacccgtcaatatagtctcgacaatcttttaccggcggattattatccctgttataccgtgagcaattttactttcctgaaagataaaaaagaacaactctgtttattcccgcaatattatacgcaacaaatagccattccagaatttaactggaaaatgacaattatggtccccttagataacctgtactggtcatgggctatttcgttagtcattacactaattatttacctgctgtttttgttatttattaaatactggagaatgcgatctcatgcacaacaattattaacactggcgaatgaaacattagaaaaacaggttaaagagcgtacatctgccctggaattgatcaatcaaaaattaatacaggagataaaagagcgcagtcaggctgaacaagtattacaaattacgcgtagtgaactggcagagtccagcaaactggcggcgcttggacagatggcaaccgaaattgcccatgaacaaaatcaaccgttagccgccattcacgcacttactgataacgcgcgtactatgctaaaaaaagagatgtatccgcaggttgaacagaatctgaaacacattatttcagtgattgagcggatgacgcagctcatttccgaacttaaagcatttgcctcgcgccatcgcgtacctaaaggttctgccgatgtcatcaaagtgatgtatagcgccgtggcgttacttaatcacagcatggagaaaaataacattgagcgacgaataaaagccccatccatgccgttatttgtcaattgcgatgagctcggtcttgaacagatattcagtaatttaattagcaacgccttagattctatggaaggtagctcttacaaacgactggatatcgccattcgccaggcaaataacaaagttattattaccattaaagacagcggtggcggttttgcacctgaagttgtcgatcgcatatttgaaccattttttaccactaaacgtagaggaatggggttgggactggcaatagtcagcgaaattgtccgaaattcgaacggcgcactccacgccagtaatcatcctgaaggcggcgcagtaatgacattaacctggcctgaatggggagaagaacatgaataataaatccagtgaaattactatagtttatattgaggatagtgacgatgtacgttttgcctgtgaacaaacgctcacgctggctggttatcgtgttatttcctgttgcgatgcagaacacagtattccccttattcaaagtcaagccaacattattatactgaccgatgtcaggttacctggaatatcaggactagagctcctcagttacatcaacgaaatggatagcaaaattccggttattttaattaccggacacggtgacgtggaaatggcggtggatgccatgcgtaatggtgcattcgatttcattgagaaaccaagtagctcagataaattattgagtattattgccagagcggtagaaaaacggcgattggttttagaaaatcagcaattactggcgaatctgcaacaggaaaatggcccggtgctgattggtcgtagtccgcagatgcaacaactgcgtaaaatgatccttaatgtcgcagataccggtgccgatgtccttatttatggtgaaacaggttgtggtaaagaagtcgtcgccagaatgctgcatcactggagtacccgccgtcaggggcagtttgttgccttaaactgtgcaggcttaccagaaacgttgtttgaaagcgaaatatttggtcatgaggcgggcgcatttaccggtgcggttaaaaagcgtattggaaaaattgaacatgcaaatggtggtacgttatttctcgatgaaatagagggaatgccatcaggaatgcaggtaaaactgctacgtgtattgcaggaaagaaccattgaacgattaggtgccaatcaattaattccggtgaattgccgtgttattgcagcgaccaaggaagatttactgcgtcgcagcgaagaacatctgtttcgtctcgatctctattatcgtctgaatgtggttagcttgaatattccacctctacgccagcgacgagaagatatccctgaactgttttactggttcgccagtcaggcggcacaaaaatataatcgtcctctgcctgatatttctcccatgttactggcctggttgcaatcacaaagttggcctggcaatgtacgtgaacttaaacacaatgcagagcgttttgttctcggtttactgacccaccaccagccagtgccaatgactcagcaagaagagagtggccttaccgcctgcattgatgctttcgagaaaaagttaatcgaagatatgctgcgacaaacggaaggccaagtcagtttgacagcgcggctattacagctgccgcgcaagactttatatgacaaactcaacaaacatcagattcaaccgcaagtttatcgaccagaatcatccagctaatgctgattcctgaggatgtaaccccaaatcgatacctttgcgggcgtaatgttcaactatccaggaccagaatgataccgggatcgtaatcatcttcgcattgcgttcccggttggcagcttctggcataccggggtaaatcaccggattgccgccaggttgaggctgcgtagctaacagataatccgcaaagaactgccctttctcccctgccagatcggtgaattgatcaggatcgataatcaacgcaaaaagatgattatgcgcagatccatccgtctgatgatcttcggcgatcgtgtcaccaccagataagatccccgccatcatttcaatcatcagtgccaggccaaatcctttatgctcaccaaatggcagtaacgcccctggaggattgctgaataacaccccaggatcattgcttggattcccctgtgcatcgatcaattgtcccggcgcggcctgcttcccggtggacgacattacccgtgctttatttagcgccatgctactggtggcaaaatcaaccagaatcggcggacgcccatcactgaacggccaggcaaagcagaaagggttagtggtcatacgcggttccgcaccgccccacggggcgaccagtgccggacgcccggtgacgttactcatggccagcatcgccaggccttgatcagcaaccatttgcccgtaatgccccatacgccctaaatgatgcgcatggcacaacgttaacaggcaaaaaccgcggtgttttgcttgttcgatggcagcatttaccgccacttttccggcgtgttgaccaaagccattgtgggcatgaaaacgttgtaaattaccttcacttgttaagcattccgggcgggcattcgcggttacatcgccacgagcgatattttccagatatttcggtagcagcgtgacgccgtggctggcaaagccataacgttccgcttcaatcatatgttccgccacatcctgagcgatatcggcatcacagccattaagttccagcagcccggcagctaaccaacgcactttttcaacagcaatttgtaatgacatcgttggtttcctcacattagacctaaaattttccaccaggtggcggcaaacagtagcaacaacaggtagccgattaccgtcaggtacagtcccacacgggtaaactggcgtggcgtgaaggtatccgtacccatacacaccatattttgtggcgcgttaatcggcaggatgaagccaaaactgacactgaaggcgagcagaatggtcatgccgaccgggttaacgccgagttctggcggcagactgcttaacaggctaatcaggatgggcagcaatgcggcagttagcgcagtggcactggcaaaccccaggtgaataattatcaagaaagcggcgagaatcgcgaagatggctaatgatggcaagccatcaagaccaaaacctttcaccacatagttcgccatccatgaagctgcctgcgtatcaagcagcgtggaccctaggctgataccaataccaaacatcagcaacgtgccccactgcacacgtttttcgacctctttccagctcattacaccgatgcctggcagcaacataatcgccagtccggcaagggtgacagaggtggtatcaatactgtgtaattttccgccagtagaccaaaagagcagtaacaatagcgaaataccgatcaagcgtttttctttaccggtggttggccctaactctgcgagtgcttttttaatggcctcgctccccccttcaacagcttccgtttctggcggcaacaatttacgtgcgaggaaatagaggatcaccgacatggtgaggctccagggcgcgcccgctaacagccagtcaagccagctgacagaatgcccggcgccgaaagttttattgataaaaccgatagaaagcaggttttgcgccgccgaagtttgaataccaacgttccagatactggtcgcctgggcgataacaatcatcattgacgccgctaaacgtgaatgtttatccaccttaaatgccgcaatgacccccatcataatcggcaccacgcaagccgtacgggcagtggcactgggtacaaccaggctcaggacgatggtcaccacaatggcaccgataataatgctgcggctgctggcacctattttcgacatagtaaacagcgcaatgcgtttatccagcccggtaatggtcattgccgccgcgataaacattgctgctgccaccagcgccagagcagaattagaaaaacccgacagagtcattttcagcgctttcgcggtgccaaggatcgtgtccgggtgattcatatccggggcaaaaccaaccataaagataatcagtgcggaaataacaattgcactggcggtgtaatccatcgcttcgctgatccagacaataatggcaaacaccagaatggcgatcatattttgtccggcgacgggcaaggtatcgcccagtggcagaagggtaataataattccggcaatgatcgccaaccacaggccgggattagggataattcgacgcttttgtggtgcgccatgggatattgatgacatattcacctcattgtgaaaaataaaaaacctgcctggctattgcaggagctatgccatctttaattttttaataacgctttgttatttaatgagttagctatttatcctttttattttatgcgcggttttccgcacagttattaaaagatgattcccttaccacacagataaaaaaagggagcgatatgctcccttgatattcatttatggattacttaataacattccataacgtttcgccaagcaacgccgggtttcttgtccatgccatgcctgctttatcgaacgcacggaatttatcctctgcactgccgctaccgccagaaataatggctccggcgtgccccatgcgttttccttttggtgcagtaacaccggcaatataacctacgaccggtttattcatttcatgacgaataaattccgcagcccgttcttccgcattaccaccaatttcaccgatcataattaccgcgtctgtttgcggatcattttcgaataaacgcagcgcatcaataaagttagtccccggaaccggatcgccgccaataccaatacaggtggattgcccaagtcccagcgccgtggtttgcgctacagcttcgtaggttaatgtaccggagcgggaaacaatcccaatacgccctgggcggtggatttcaccaggcataatcccgattttgcactcgcccggcgtgataactcctgggcagtttggcccaatcagccgcacatccgggtggcagtcaagcagccgacgaactttcaccatatccagtgtcggtacaccttcagtgatcaccacaaccaatttgacgccagcttcaatagcctcaacaacagaatccagcacaaacggtgcaggcacataaatcacgctggcatcagcctcagtttgtcgcatcgcttctttcattgaatcaaaaaccgggcgatccagatgccgttgcccgcccttacctggcgtcactccacccacaatctgcgtgccatacgcaatagcctgctctgtatgaaatgtgccgtttttgccggtaatgccctgcaccagtacccgcgtgtgtttgttgatcaaaacgctcatcttaacctcctgttaattcagtaacgcaatgatgcgtttagcggcatcatccagagaattgacggcttccaccgtcaggccactttctgccagtaaccgctgcccttcggcagcgttattaccggagagacgcaccacgacaggcagggtgatacgggcctcattcagagcatgaataatggctctggcgatcatgtcgcaacggacaatcccaccaaaaatattaaccagaatggctttcactttgctgtcggaaacaatcagccgaaaggcttcactgacgcgctcctgggttgcgccaccgccaacatccaggaagtttgcgggttgttcaccgtatagcttgatgatgtccatggttgccatagccagccctgcaccattgaccatgcagccgatatttccgtccagcgagacataattaagatcaagcttcgctgcctggctttcgcgtggatcttcctgggtttcatcacgtagcacctggagttccgggtgacgatacagcgcgttatcatccagcgatactttcgcgtctgcacacataaattcgcccgtttcccgcaacaccagagggttaatttccagcagggcgaaatccagttcgttaaaggctttccacgcctgattaaccaggcgactaaaggtagcaaatagcccgtgttccagttgcagaacagcaaacatttcgcggatatggcaaggctgcacgcctgtcagtggatcaatgctgacactgctgattttctccggtgtctcatgggcgactttttcaatttccacaccaccttccgggctgacaataaacgtgacccgctggctttcacgatccaccaccatgccaaaatagagttcctggcgtaccggatagatgttttcgcacagcaaaatactgctgacatactgcccttctggcccggtctgataagtcaccagttgcgatcccaacatttgctgtacaaaagcctgtgcttccggcagctgcttaagcacttttacgccgccagctttaccgcgcccaccagcatgtacctgcgctttaagtaccgcgcctttactcgggcaagcaatatgttgccaggcatctgccagttgcgaaatctgttggatggctatctcttttggacacggcatccccatgccagccagtaacgatttggcctgatactcatgtaaattcatatattccctcagtggtatgtgttatccgtgtaatgctttattattcaaggccattgctgcttcgtggatgacttcgcttaaggtcggatgcgcatggatcgcacaggcaatatcctcgccagaggcgctaaaagtcatcgccagcgcaatttcattgatcagctccgatgcctgcgggccaacaatcgctccgccaagtacgcggtcagtgtgtttatcgctgtataacgtgcaacgcccaccttcctggcctaatgctaaggcgcgaccgttaccggcaaacagagaatttcctttgttaaagactctgccagcggctttcagtgaggcctcgttttcccctacccacgcaacttccggttgggtgtaaatcaccgaagggatcagcgcaaaattaatcggctctaccgccagtccggcaatttgatccgcaaccaccacaccttcagccatcgctttatgcgccagcatcggccctcgcacgacatcaccaattgcccacagcccggctttcccggtacggcataagttatcgacggcaataccgccacggttatcggcttcaagaccgagttgcacgagatcgacaccagaaagtcgcggtacacgtccaatggcaagaattaatttatcgaagcggctttcttctcgcttctcaccctgccgccagcgcacatgcacaccgtcatcccgttgttcaatagcctcaatctctactgccagttgcattttcatcccactggcaatcattgctttacggacttcgttcgacaggcgagcttccagtgcaggcaagaacgttggcgccatctccagcagcgtgacatctgaaccgacccgattccacacagaccccagttcaaggccaatcacgccagcgccgatcacaccgagacgcggcggcacttcgctcaatgccagggcgccacgattgtcgaggatctgttgattatcaatggtaacgccaggcagctgacgcggctgagaacctgttgcaatcactacattacgggcgtgaatgtgttgatcgtttacgcgtaattgccaaatctcatcctgagcacgttctaacgttgcgaggccgcacaagtgcttcactttatttttcttaaacagcaagctgatgcccattgtcaggcggcttactatggcatctttacgttgaatcatcgcggcagcattgaaagatacgccttcaacgttaacgccatgaatgcttgcctcatgctgtacttgcgcgtacagctcggaagattgcagcaacgattttgacggaatacagccgacattgagacacgtaccgcccggcgaaggttcgccctgtgcattaacaccatcatcaatacatactacggaaagcccattctgcgcagcccgcagtgccgctacgtaaccacctggcccaccccccataactgccacatcaaaaattgtactcatcggcgccctccttaaagatccagcaacagttgttccggtgattccagtagctcacgtattgccaccaatgtctgcacggcttcctgaccatcgataatgcgatggtcatagctgagagcaaggtacatcatgggacgaataacaacctggccgttttctgcgaccgggcgcggcgtgatggcatgcatcccaagaatggccgactgcggcgggttaatgattggcgttgacatcatcgaaccaaaagtaccgccgttggtgatagagaacgtgccgccctgtaacgcctccagcggcaatttgccattgcgtgcctgtgtggcgtattcggcaatttgccgttcaatttccaccaaagagagtgattgcgcattgcgtaacacaggcactaccaggccgcggttgctgctcactgcaatgccgatatcgcaataatcacgccagataatctcgttgccatcaacgctggcattcactacagggaagcgctccagcgcccgggtaacggccttaacaaagaaggacataaagcccagcttcacgccgtgcttctcggcaaaacgatctttccagcgggtgcgtaaatccatcacgctctgcatgtttacttcgttgaatgtggtaagaatggcgttattttgttgggaagccagcagacgctcagcaattcgctgacgtaagcgcgacatcggctcacgacgttcctgacgagcacccggtgtcaagggtttagctggcgcgatctccgccacccgttcaggctgaatgactggtgcaggagtaacgcgctgtacatcctctttcaggatacgtccatttctcccgctccccgcaacgtcagcaagttcgacaccactacgctgtgcctccagccgtgcggaaggcatcgccagggtttcggtgactggtgtgacggtttcttctatgacagcttgcggcttaagatgcgccaacagttgcgcggacgtgaccgtgctaccttcgctgacgataatattgcttaacacgccatcgtgcggggccggtatttccagaatgactttatcggtttccagctcggcaatcacatcatcgcgttttacgtgctcgccttcttgtttacaccaggttgtcagcgtgccttccgtgacagattccggtaatacagggacagtaatttcgatcataaaatgttctccttattatttttgtgcgcctttcatggctgaatatctgcaaacgcagcagcaagaaattcgtcgatttgttgtttatgtacacgcccataccctgtcgccggagctgccactgccgggcggcctgcatactgccagtaaggagtgttaattttcagtgccgccagctcatgacgaatctgccgccacgcgccctggttttctggctcttcctgcaaccaaatccattcgcagcagttcggccaactcgccagaacatcattcagttctgcgaccgggaacgggtagagttgctccaggcgaacaatcgctacctcatcttcacactcacgctgcttacgggcttccagtacgtcgtaatagacctggccgctacacaaaataacgcgcttaactttctgggactgatgcaattgcggatcggtgactaccggtttataagcgccatcagtgaattcagaaagctcgctcatagcgcctttaaaccgaagtaaacgcttactcatcattatcactaacggtttgcgcattgggcgtaatgcctgaccgcgcagcaaatggaacatttgtgctgactcactgggcatcaccacctgcatgttgttttctgcgcacagttgcagccagcgctcaggacgcgcagaagagtgctccggcccttgtccgtcatagccatgcggcagaagaatggttaaaccgctatagcgatcccacttggtttcgccagacgagataaactggtcaatagcaacctgagcgccgttggcaaagtcaccaaactgcgcttcccaaataaccagttgctgaggcgcagacgttgaatagccatattcaaaggctaagagcgcttcttcattaagcaccgaatcataaacatcgaaagatgcctgaccagcgcggatatgctgtaacggcagataacgacgggcttcagtttgatgatgtaccactgcatggcgatgactgaacgtgccacgccctgagtcttcaccagaaagacgcacaccaacacccgcatccacaagcgatgcataggccagcatttcagccattccccagtctattggctgagtacctgcggccatatcctggcgtaacgccagttgccgtttaatggtaggatgtgcgaccacatcgggtggcagtgtagaaatgatttcaccatacgctgccagcttttgccgaggcaatgccgtagataccggggcgctccagtgagggttggtcaacccataccagttagcgctaaaagagtgaattgcaggtttgagaggctgcggttcacgtttctggcagctatccagccagtcgcgatagcgtgccgtcatctcatcttgttgcgcctgagttaacaggccgcggcgggcaagagattcaccataacgggcgagcgtaccagggtgagcatccactgcctgatacatttgtggctgggtaagacgtggctcatcgctttcgttgtgtccgtgcttacggaagcagcaaatatcgatgatgatgtcgcgccggaaggtgtctcgccattcgcacgccagttccattacctggcaaacagcgtcaacgtcatcgccattaacgtggataattggggccgctaccattttggcaatatcggtgcagtaccgtgaagaacgcatatcctgcaagcgggaagtggtgaagccaatctgattgttaatcaccagatgtagcgtaccgccagtgccgtagccctgagtctgcgataagttaaacgtggtttggttgacgccgaggccgcccaacgcggaatccccatgaataagtacgcccaccacttttgcctgaccatcctcaccacggcgttcctgcctggctcgcacctggcccagcaccaccggattcacgatctccagatgtgaggggttatacgccagcgccacatgcagcgaaccggcaggtgtttccagattgctggaataccccatgtggtatttcacatcgcctgaaccactgccgatcgtctgcttgccttcaaactcagcaaaaagctgtgccgggtctttattcaacagattaaccagaacattaagtcttccccggtgcgccatgccaatgaccatttcctccacaccttgcgcacgcaggcgttttgtcagcgtatcgagcgccgggattgcactttcgcccccttccagagaaaaccgtttctgcccaacataacgggtatgcagataacgctctaacgtctctgccgccatcagtttttcaaaacgggcaatgcaggtttgggcatcagcttgtggcgcattgctgctctcaatccgtgataacaaccagttgatttcttcacgattttccagatgagcaagttcataagcctggctaccggcccaggcttgctccagcaggttaagcagttgcttaagtggcatttgcgtggtgtgtgcgccaaaggtgacgctaaactcctgcaacaagtcttcttcgcttaatccccaaaaaccaggctggagggagggaacgtcagctgggggattcaaaccaagtggatcaagctttgcgcgcagatgcccctgcgtgcgccaggcattgatcagttgtattaccgcagcctgtttttttaacgtcgcaccgctgacgttgttatcaccggatacgctttggacagtcagttcaggtgaaagaaaaaaacgccgccagtcttccgggagttgttccggcgtacgcaaccaggtctggtagtactcttcaagccaggtcgcgttatctccactaagcagcgtgccgggcgaggtcatgttctccatgtttttctcctgatggtcatagacagccgcattactgcacaatccgtaccaacagttaaaaacactaattttcaaaaacttatagaaaagagatgatgtaaaagtgggcgaaaaaagggacagaatagtaggggatggctggagtcaggaacaggcggagagatccgcctgttgattaaaatcacatcaccgcagcaaacgcctttgccacgcgatgcacattttgcgcgttaagcccggcgacacacatgcgaccgctggcgatgagatagacaccaaattcttcacgtagtcggtcaacctgagcggttcttaaaccggtataactgaacatgccgcgctgattaagcagataatcgaaattgcgctctggcatctctgtgctcaataccttcaccagttcctgacgcattgccagaatgcgagtacgcatctcttctacttccgccagccagctggctttcaatgcctcgtcattcagcaccgcagccaccacctgcgcaccaaaattcggcgggctggagtagttgcggcgaacggttgctttcaattgccccagtacgcggcctgcggcttcggcatcttcacacagaacagaaagtccgccgacgcgctcgccgtaaagggagaaaattttcgagaacgaattgctcaccagagcgggtaatccagcgctggcaatggcgcgaatggcgtaggcatcctcttccataccggcaccaaatccttgataggcaatatcgaggaatggaataagctcgcgggctttgagaatttcaatcacggaatcccactggtcattagtgagatcggcacccgttgggttgtggcaacatggatgcagcaacacaatactgcgggcaggtaatgttttcagcgtcgccaacaggtcattaaagcgcacgccgttagtcgcttcgtcataccaggggtaagtacttacttcgaatccagccccggcgaatattgctacgtggttttcccaggtaggatcgctgacccagacgcctgattccgggaagtagcgtttcaggaaatctgcacccactttcaatgcccctgagccgccaagggtttgaatggttgctacgcgctgttgttgcagtaccggatggtccgcaccaaacagcagcggcgcaatggcatggcgatagctgttaagcccttccatcggtaaataaagcgaagcaccatgaggctgcgcattcaggcgcgcttccgcatccgctacggctttcagttgtggaataattccgtcttcgttgtagtacagaccgatacttaaattcactttgtcgctgcgagggtcttctttaaaacgctccataagcgtaagaatcgggtcgccagcgtaggcgtcaactttttgaaacacgcgatggttctccaggtttacgggcaggtggttaaaacacaataaaccggaagtagacgaagatcgagtggatgttcaaagtcagtcgggaaggcgatgtagaatttgccccagtcgctcttgcagcgaacccgaaacagaaagataaggaatattcctgcgcgataattcctgttcataccacacctgttgccgtgcgcgaaatacctctccttgccgggtgccatcctgcacgaagggaaattctgcgccgcaaagcaccaccagagagtattcccgctccgccagttgatgaagttcttgcggagcatgaccatattgatcaagggcatagaacaaggtcgtgagtggcgacgtgtcacatataagatagtgattagcttctgcttgttgttcccggcgtacctgttcgcaggcgatatgcaacaaatcatccgcggttaagattccgtttttttcttcccaatagtcgcggccaaattcagcgacatacaccgtatcaagcccatccgccagcgcttttgaaagcgtgcttttaccggtagattcgccaccaagcagacagatacggcgaacgaaactgtaataaacatcattcgccaacatgtagcgatagcggtgaacatcggaacgaataagcgttcccgaaggcgcttcatcgccaactgggcgcgccattcgaacgtgttcaacgggttgggcaaaacgccgcgccagcacgttagcaaagccatcgccatagtcttctgcagtaaatacagcatgtggacgacagcgtaatatctgcaggcacagcgtcgccacataatgacggtggatgtcggcatcgttatgcggtatggcaggtaagttataacgcgcaacaagctctggcgtcagtaccaaaatcgtcgcttgcgggaagcgcacttgcagccacgtcaggcgcttttcaggttcacagtcaggcatttccggcacggaataactgatgatgaacagttcttcacattgcgccagtgcggtattgatcaacttttcatgaccacaatgcaaaggcgcgaatttaccaaccaccaggcccgttgcaaaaggcttcatgatgtttgcaactctttgcgccattgatacaaaccatgccaggcgttaatccagaacaggaaatataagccagcggtcaggtttaaaccgcgcgtcatatacagtggcactgccagggtattcaccgctaaccagacgaaccagttttcgatacgtcttcccatcaacatgaattgtgccagaacgctaaaggtcaaaatcaacgaatccagccagggtgcccaggcattggtaaaggtgtggagtaaaaagccgtaaccgcctgccacgacgacagcacagagcaacaaaaggaaaaagtgactggcttgcgttcggcgcaccggcaagatgtcgccaccctgacctttcagccagtggatccagccagtgatgctggtcgcgatgaagaataactggagcgtaacgtcggcatagagttgcacagaccaaaaaacccagccgtacaatatgctgccaattatgccgatccaccatgtatgcacattgtttctggcagccagccagacggaaaccgcgtatgccagacacgcggcgatttctgaataagacattgtccctccctggagacgaatattaatccacgtatttcatcgcgactcttgaggtcaggcgcgtgataagttcgtaagcacttactttcgtcatttcagcgatacgttctacgggcaaaccttcgccccataaaatgaccgggtccccggctttatcctgcgcctgtggacctaagtctacgcagatcatatccatcgccacgcgcccgacaatcggcacttcgcgaccgttcaccagcactggcgtaccggacggcgcggcgcgcggataaccatcgccatagcccatcgcgactacgccaagacgagtatcacgttcgcttacccaggttccaccataaccgacaggctctccggctttatgctcacgcacggcaatcaggctggaggttagcgacatcactggctgacagccaaaatcggcaccggtggagcgatcttccagcggagatacgccgtaaagaatgatgcccgggcgcacccagtcaaaatgcgactgtggccagagtaaaatgccacccgacgcggcaatggaacgttgaccaggtttgccttcgcaaaaggtattaaagatagcgagttgcttctcggttgcgccgcattttggttcatccgcgcgcgcaaaatggctgacgatattcaccggctgacgaacgtttttgcactgggtcagacgatgataaaacgcctcagcctgttccggccttacgcccagacggtgcataccggtatcgagtttcatccagacggtaaccggctcgtccgggctagcctcttccagcgcagccagctgttcttcgttatgcacggcggtatgaaaatgttgcgcagaaatcgtcggtagatctctggcatcaaaaaagccttcgagtaaaagtacaggtttggtgattccccccgcacgcagtcgcagagcttcttcgagacgggctacgccaaaggcgtcagcatcggggagcgttcgcgcggtctcaagaagaccgtgaccataagcgttcgctttcaccaccgcaaccattttactggcaggcgccagttcacgaagacgttgcaggttgtgtcgcagagcgcggcggttaatcacaacagttgccgcttgcattagtgttccttgataagtgtttgctttaattacctaattcataaaataattattattcgtcgtcgtactgcggccccgcatagttgtcgaagcgcgaccattgaccgttaaaggtcaggcgtaccgtcccgattgggccgttacgttgtttaccgataataatttccgcgatgccttttaaatcactgttttcgtgatacacctcatcacgatagataaacatgatcaagtccgcatcctgctcgatagagccagattcacgcaggtcggagttgaccgggcgtttgtcggcacgttgttccagagaacggttcaactgggacagcgccaccaccggcacgttcagttctttcgccagtgctttcagcgagcgggagatttctgcaatttccagcgtacggttatcggaaagcgccggtacgcgcatcagttgcaggtagtcgatcatgataagcccgatgccgccgtgttcacgggcaatacggcgtgcgcgggaacgcacttccgttggcgtcaagccggaggaatcatcgatatagatattgcgtttttcgagcaaaatacccatggtgccggaaatgcgtgcccagtcttcatcatcgagctgcccggtacggattttagtctggtcaacgcgcgacagcgacgccagagaacgcatcataatctgttctgatggcatctccagcgaaaagataagcaccggtttatcctgcaacatcgccgcgttttcgacgaggttcatcgcaaatgtcgttttacccatcgacggacgcgcggcaacgatgatcaaatccgacggctgcaagccagcggtttttttgttgagatcgtcataaccggtatttaccccggtaacgccatcgtgtggctgctgaaacaactgctcaatacgcgccacggttgcgtcgagcacatcggcgatgttcttcggcccttcgtctttgtttgcacgactttcggcaattttaaagacgcgggattcagcaaggtcgagcagatcttcactggtacgcccttgtggatcaaaaccagcttcggcaatctcgttagcaacggagatcatctcacgaacaacggcacgttcgcgcacgatatccgcatatgcactgatgttcgccgcacttggcgtattttttgacagctctgccagataagcaaaaccaccgacgctatcgagttgcccctggcgttccagcgattccgcaagggtaatcagatcgataggactaccgctttcctgcaaacgcgccatttcagtaaagatatgacggtgtgggcgggtgtaaaaatcatctgccaccacacgctcagctacatcatcccagcgttcgttatccagcattaaaccgcccaacaccgactgctccgcttcgatcgagtgcggaggcactttcagcccggcaacttgtggatcgcgttcgcggttatcagtctgttgtttgttgaaaggtctattgcctgccataacgaatggtgttacctgctgttgaatgggggacaagagagtatagcgagaaacagtttctcgctacagcatttaacgcccccgctttccggtggaagcgcgaatttgcagggtcgggcgatagatgtaatggctgagcggtgcgtctggttgcgcaatacgccgtaaaatttgctgcgccgcctgtttccccagagccaatggttctaccgcaattgtggttaacggcgggttactgtaagcacaagccgccacgccatcattaccaatcaacgaaatatcttccccggcaaataatcctctttcgcctagtgccgactccgcgccaaaagccattaaatcgttataacaaatcaccgctgtgggtggcgaaggcatatccaacagctgttgcatcaactggtagccgttggcctgagtcggttcagcacgcagcgaaaaagcatcagtactccacggctgtaaaccatggtgattcatcgcctcaaggtatccctgataacgcatatggtgcgtaagaccaccaataaacacgatatctctgtgcccttgttgaatgagatattccgtcgcttcccgtacacctgcgtggctgtccacgccaacgtaatcgacgggcaattgttgccaatccagagggcgcatcgtgattaataagggtgtggaactgttggcataacgctgtaaatcggcttctgaggtactgttcactggacagaggacaatgcccgcgacgtggtgttccagcaaggtatcaagcacctgtttttgccggtcactacgctgggaggtattggacatcacggtgataaaaccgtgctccgccagcgtcatctcaagacccatagtaaattcagcgaagaaaggatttatcaaatcgtcaatgactacgccgatagttagcgatttttgcgaacgcagattggcagcaaaacggttatagacatagcctaattgttcaatggcttgctggactttttgttgagtctcttttttgataagtgaactgtcgttgagaaccagcgatacggtcgatttcgaaacgccagccgcacgcgcaacatcggttaatgttacccgctttcttcctgtatccgacttcgccatgcctgctccaaacccccataagatcaaggcaattactttatcataatctccttttactcatgcgatccgttaacgcaagggatcgcaggagatcgtcgtttcgatcacagattcgcacttcccttgttgtgttttttacaccctaatcgtacaaattacgcataaattagatcgttccaattaatttatgaaaattatcatattgttttaaatgcatatttttaattatttttatatcgaaacaaggaaattattatgtgctctgtacgcacgatcactgcaccggaagctgcagatttgattgttgatggcgcagttgtcaccgtctcctcctccagtggaatggggtgtccggatgcggtgctggcagcaataggtgaacgctttcaacgtgccggacatccgcaaaacatcacctccatccaccctatcgccgctggtgatatgtatggcgtaaaaggcatcgatcatctggcgcaaccgggcttactggcaaaagtgatcgctggctcctacccctccggtccatcatcaatggcgcctccgttaatctggcaaatgatcaatgacaacgcgatccccgcctggaatctgccttccgggatcttatttgatatgcaccgggaagcggcggctcatcgtcctggcgtgctgacacaaacaggcatggatacctatgtggatcccctgttgcagggcggtgcaatgaatgaaaaagcggcgcaacaatctctggttgaacgtgttcgatttgctaacgacgactggctgtttttccccagtatcgtgccgcaggtggcgatcattcgcgctaccactgccgatgaacgcggcaacctgacttatgaacatgaaggggcttatctggggccactggaacaggctactgccgttcgcaataatggtggcatcataattgcgcaagtaaaacgacaggttgccgccggaagtctgaaaccaaaagaggtgcgtattccgggtgtactggtggattacatcgtgattgcgccggaacaaacacaaacgacacaaacgcaatatgaacctgccatttccggcgaaatcagtcgtccgctatcagcctttcgttatatggaacatggcccggcgcgagttattgcccagcgagtcgcgcaagaactacaaagtggagatgcggtaaatattggctttggtatttctgccaacgtaccacgcattttactggaacaaggtcgccacggtgacgtcacctggctgctggaacagggcgcgattggcggagttccactgctggaatttcagttcggttgtgcctctaatgcagaagcatttttgccctctccccagcagttcacctatttccagggcggtggctttgatctcactctgatgtcgtttttacaaatcggcgcagatggctcagtgaacgtctcacatctccccgctcgtccacatgtcactgccggatgcggtggatttattgatatcacctcacatgcgaagcgcattattttctctggctttttcaatgccggtgcccaactgcaactggaagagggtcagctgcgtatcattaaagaaggcaaagccaaaaaactggtacaggacgtcgcccacgtgacgttctccggcaaacgcgcaataagactcgggcaacaagtgcagtacatcactgaacgctgcgtgctggaattaaccccagacggactactggtcacggaaattgccccaggtattgatcctgaacgcgacattctcgcccaaagcaatgccccactccgtctggcagacgatctcaaactaatgaatccccactattttcaacaaggacgtcaccatgaataacggcaccattgacctccagcgcaacggtttcattgccactttggtgattaatcgcccggcaaaactcaacgcattaaccccagagatgctcgaacaactgctggcgcattgccacacgttggaaactgattcggagatccgcgtagtactgctgaccagtgccagtgaaaaagcgttttgtgtcggcgcggatattcatcgctggacctctctttctgcactcgatatgtggcgcaactggatccgccgcggtcatcaggcatttgatgctctggcacaactgccacagcccgtaatcgccctgttgcacggcctggcttatggcggtggtctggaactggctgctaccaccgatatccgtatttgtagcgccgaagcacaaatggcactaccagaaaccgggctggcgacagtgcctggctggtcaggaacgcagcggctgacggcactgcttgggcgctcactggtgaaagaactggtatttaccggtgaaccactggatgcacagcgggcactgtcctgcgggctggtgaatcgcgttgtcgccagggaggcgttacacgacgccggactgcaactggcacaacgtatcgcccagcgtgctcccgttgcagtgcagatcgccaagcaggttattgatgccggagaaggtattgctgtggcctcgacgcttgaagcactggctggcgctttttccgccacgactgaagatgctcatgaaggcagtcaggcatttactgagaagcgtcaaccgcactttagtgctcgataacttagcatttcattttggattttaataataacgcaagaatcccattgattttaggcggatttcttttatccgtctgaaaggagacacatcatgcaaccttcacaaccagcagagaaagcgaatgtttcatcggcagatctgcgtcgcgcggcgtggacctgctctctcggcagcgcactggaatactacgatttcgcactttacagcctggcatccgccattatttttggtccactcttttttcctaatcaggaaccgggaatggcgctgatcgccagttttggcacctactttctcggatttgccgtcagacctgtaggcggaattatcttcggctcattaggtgatcgtttgggccgtaagttcgtcctgttagcaacggtgttgttaatgggaatcgccagcacgttgatcggggtattacccacttacgaaacagcgggaatctgggcgccaattatgcttattgcattacgcctgctgcaagggcttggtgctggggctgaacaggcgggagccgccgtactgatgaccgaatatgctcctgacggcaaacggggttattacgccgcgctgccgttcctcggaatccagattggtacgtttatggcatctgccgtttacttcatcctgctgcataatgtgacaaatcttgccgaaacctggtggtggcgcttgcccttcctctccagcgtggtgattatcgcggtggctatttatattcgactgcatcttaaagaatcgccatcattcgcaaaactcgaagctcgtcaacaagttacagaatcacccttacgaaatttgctgaaaacatcacgccgtaatgtcttcgtcgggattggcttacgtctggcagaaaacggcggctcgtcgatttatcaggctttagcgatcagttatatcgttggtgtggttgggctggacaaatcagttggtacgctatgcctgatgtctgcggtagtagtcggtgcaattatggtgcctattgccggttggctgaccgatcgcttcggcagggttcttgtctatcgtagtctggcgatttttcagttgttgattacctttccggtgtggtggtctttcagccacggtaatgttcctgtcactattgtctctctttctctggccttagggattggagcctggggtatgtttggtgcacaaggtgcttttctgcctgaactctttggtgctcgccatcgttatattggcgtcgcactggcaagggaagtttctgccgttattgccggagggatcgcgccactggttggttctgcaatcatttcctgggtgatccacactaacgatcccagtggtattgctgcctggatgccaatcgctatttaccttagtctgctgaccgttggtacgattattgcgactttctttgctccagaaacacgcgatcgtgatcttgatgatcttgccgacgctgaaacgatcagcgtttcccaacataaccagactacgggcacctcccatgacgcataatgtctctgaatctattatcgattccctgactgacgtgaaaatgccccattacgcaccgctggctcaagtcagcggtagtatcgaccttaacggtaccattttacctgagtaccgctgcaacacgctggttctgggcagtggcgcggcaggatggcgagctgccgtcgagctgaaacggcaaaatgtcgatgtaatggtcgcctccagcaaagccttctggggaacttccgcctgttctggttctgataaacaaacgcttcacaccgcgaatacccgtgcaaatggtgaccattttctgacattaagtaacaccctggcggcaggtggtgcgatggatcatgacaccgcatatgttgaggcggtcggatcggtgaacacctgtgaagtactgaaatatctgggtctggatctgcctgaagatctctttggcgcaacgttgcgttaccaaaccgatcacgatgaatttggccgtgccactagctgcggtcctcgaacatcgcgcctgatggtgaaggtgctggcccaggaggcaatgcgccttaatattcctctttgcgatcacacaacggcgattcgtatcctgaccagtggtgaaggagaaaatcgacgagtcgagggggtgatcgccatcgataaagcctgtcgggataatccctggagaatggtagtgattcgctgtcagcatctggttttagccacgggcgggcctggtgaactttatcgtgacagtgtttatccggtgaactgttttagtgcgttgggcatggcgctggaagcagggataactctggttaatcttacggaaagtcagtttggtatcggtacaccgcgcaaccagtttccgtggaatctttccggtacttacatgcaggcgataccgcgcatctattcgcaggaccactccgggcgtcagtataattttctggcaacttattaccccacgactcgtatgctggcctccgcgatatttcgcaaaggttaccagtggccgtttcacgcggaacgaatgctggaatatggctccagcttgctggatgtcgcagtttatgaagagactcaaaaagggcgcgatgtttttctcgattttctacgggaaccagaacccgcagcggacggaacactatttaacctgcgggagctggatgatgatgtcatcgactatctgcaacaaaatcacgccctgctggcacaaccgctggcgagattaacacagatgaatcctctggctattcgtttgtatcagatgcacggtcatgatctcacagcctcaccgctcaagtttacgctaaataatcaacatcttaatggcggaattgaagttgatatttgggcacgtacatcgctaactggttgttatgctgccggagaaaatgccggaacacatggtgtcacgcgcccaggtggagcagcgctcaatgccgggcaagttttcgcccgccgctgtgcattacatattgctcatcagaaaagccaggaccggcctctcgagaggcaacaaattctcagtacgattaatgaggcgcaacagcacctgaatcaggggctgctacgtgacgacgtgcgagaaacgatacaaaataccatgagccaccatgccgcaattttgtgtcatacacaggggatcaacactgccgcgcaaaccctggcaacactttgtgaagatattcgccgggaaggtattcaatgcgatgaaaacagcctggcacaatctttccagtggcgacaaagtgcgcaactggcgctggctgtactgcgttctttacaatgttatgtcgaaaacggtggtgggagtcgtggtgccagggctatctatgatggcgaagccggtattgcaccgcaaacaccaggtgggccactcctggcctggcgttttcggccagaaaatcaggatgccaggcaatatatgatttgtgtttgtcgggaagctaatgattaccaaaccaggactcgcccgtgccgtgaacggggcgtattaacgctaaccaactttgagcgccagtggcaaaactggattgcggcgacgccgtttcaatactgatcagagatattccgggttgtgaccgcagcccggaaaaaatccccgcgcggcctggcgactactgttaggcttaaaacagatatgtcgctcagtaaaggagtttaaatggcaatacgaattgaatttcacaagcacggtggcccggaagtacttcaagccgtagagttcactcctgccgatccggcggagaatgaaatccaggtcgaaaataaagccatcggcatcaattttatcgacacgtatatccgcagcggcctttacccgccgccatcgctacccagcggattaggtaccgaagcggcaggcatcgtgagtaaagtcggcagtggtgtaaagcatattaaggcaggcgatcgcgtagtctatgcacaatcggcattaggcgcttacagctctgtgcataacattaatgcagataaagcggcgattctgcctgcggcaatttcttttgagcaagctgcggcatccttcctgaaaggcttaacggtttattatctgctgcgcaaaacctatgaaattaaacccgatgaacagttcctgttccacgcagcggctggcggcgttggcttgattgcctgccagtgggcaaaagccctgggcgcgaaacttatcggcactgtaggaaccgcgcaaaaagcgcagagtgcgctaaaagcgggcgcgtggcaggttattaactatcgtgaagagaatctggtcgagcgattgaaagagatcaccggtggtaagaaagtgcgcgtggtgtacgattcagtgggcagagacacctgggaacggtcgctggattgcctgcaacgccgcggcttaatggtgagttttggcaactcatcaggtgcggttaccggtgtgaacttaggcattctcaatcagaaaggctcgttgtatgtgacacgcccttccctgcaaggctatatcaccacgcgggaggaattaaccgaggccagtaatgaactgttctctttgattgccagcggtgtgattaaggtcgatgtcgccgagcagcagaaatatccgctgaaggatgcgcggcgtgcgcatgagattctggaaagccgggcgacgcagggttccagcctattgattccataaaagaaattgggcttccacctgggaagccctttcttttatagttcggctgtatgtagggtacagctcgatgaatttgtttgacgcgcaatagtgacagatttgattatcaattcctattttgttctaaggataaaaccttaggttgtgatcatccgcacaatcccttagtaacgccagcggtcataacgctgatatttcggcacttttggtgcttttatcgccctgatcacccacaccaccgcaaccgccaacagcagccacggcagcaacttaatcatcaatgccagcataccgccgaggaacataaaggccgtcgccacaatcagcgcggcgataatacccagcaacgaaacaccggtgaccatcagcatgacaaaaaagccaattacaaaaagtagttccagcatgatgctctcccaaatatgaaatctcttgctggcattacaagaatcatgccaaaaataatctattgatttaacagcaaaacgccccgcgacggggcgcagggcgtggtgaatttgactactttttggtgaaaagttaacgcttatccgccaccagtttgagcgcgtgttccagcacattaatgtctgcacccgctttatgggcattttcacttaaataacgccgccactgccgcgcgccaggaataccctggaacaagcccagcatatgccgggtaatatggccgagatacgtaccctggctgagttcacgctcaatgtacggatacatggcgcgcactaccgccaccggatcggcatcggtatccgaggaaccaaaaatctctcggtctaccgccgccagaatccccggattctgatacgcctcgcgcccgaccatcacgccatccatatgttgcaaatgcgctttagcttcttccagcgacttgataccaccgttaatcgacatcgtcagatgcggaaagtcacgcttcagttgatacacacgcggataatcgagaggcgggatctcacggttttctttcggacttaacccagaaagccaggctttacgtgcgtggatgatgaacatctcacactcacctttgccggaaacggtgttgatgaaatcgcagagaaattcatagctgtcctgatcatcgatgccaatacgcgttttcaccgtcaccggaatcgacaccacatcgcgcatcgctttcacgcagtcggcaaccagctgcgcattacccatcagacacgcaccaaacatgccgttctgcacccggtcagacgggcagccgacattcaggttgatctcatcgtatccacgcgcttctgccagcttcgcacactgtgccagcgccgccggatcgctacccccgagttgcaacgctaccggatgttcttcttcactgtacgccaggtaatcacctttaccgtgaataatcgcccctgtggtcaccatttcggtatacagcaacgtattgcgggaaagcagacgcaagaaataacggcaatgtctgtccgtccagtcaagcatcggggcaatcgagaaacggtaagcgggataaacagtgtgtgattctgctggcatggcgactttttaagcatctggtaaattgggggcgctactatagcataacgaatatgcgatcaggcaatatgacagccatgacaccctgttctcggcgtttaagcgagaactatggtaaagtaagggcattcttaaccccactgtcgaggtgcccaatggaaaagaccacaacgcaggagttattagcgcaggctgaaaaaatctgcgcacagcgtaatgtgcgcctgaccccacagcgtctcgaagtgttgcgcctgatgagtctgcaggatggcgctatcagcgcttatgatctgcttgatttgctgcgcgaagctgaaccgcaagccaagccgccaacggtttatcgcgcgctggagtttctgcttgaacaaggttttgtgcataaggtggaatccaccaacagttatgtgctctgtcatctgttcgatcagcccacccatacttcagccatgtttatttgcgatcgctgcggcgcggtgaaagaagaatgtgctgaaggcgtggaagacatcatgcatacgctggcggcaaaaatgggttttgccctgcggcataatgttattgaagcacatggattatgttcagcatgtgtagaagtagaagcgtgtcgtcatcccgaacagtgccatcatgaccactctattcaggtgaaaaagaaacctcgctaaaagggtgtacatccttgtacatgtcgggcaggagggattaattaccagcggtaatcatggcgtttttcccaactatcaacctctttttctgcctgatctttctgataaccgtagcgttcctggattttacccactaactgatcacgttttccttcaatgatcgtcatatcatcatcggtcagtttgccccattgctctttcactttacctttaaactgtttccagttaccgccggcttcatctttattcataatcaagacctcatcgttaggttgtgaatgagagtacgttcacttttcttctgaacgtgagattaagtgtagtcagcaatttggcttaggattatttattcagaatttttaaccgtcacgttgcgacaaaccaggtatcgttacgccagtgacgccgccagatagccgccagagaaagcccgcgtaacgccagaaagacggttaacgccagccacaaaccatgattccccagccacggcagcgtaaggagcgtcagtgcaaaacctgcggcggccaccgccatactgttacgcatttcggcggcacgcgttgcgcctataaacatgccgtccagcagataacaccagacgccgaccaacggcaaaatcacctgccagataagatagcggtcagccagctgctgaatctgggttaacgacgtcagcaacgcaatgatgtgttcccctgccagcaaataaaccaccgaaaacagtaacgctacgatccccgactggcggcacgctgcccgccagacatccagcaattgactaccgtcgcgcgcaccgtatgcctgaccggaatgtgcttcaaccgcgtaggcaaaaccatccagcgcataggcggtaaaggtgagtagcgtcatcagaactgcgttaacagcgataatgtcactccccagtcgcgcgccaagtacagtgatcgcgccgaaacagagttgcagcaacagcgagcgcagcatgatatcgcggttaagcgccagcaagtgacggaagtttcctcgccaggctgttttcagcatttcgccggagattccgcgtagtttgagaattttacgcaccattagcagaccaatcagcaatgttgcatattccgcaataaccgtcgccagagccgcgccctgcacgttcatatgcagccccatcaccagccagacatccagcacaatgttgaggatattgccgaccactaacaaaattactggcgcacgggcatattgcacgccgagtaaccagccaagtaataccagattcgccagcgacgccggtgcgcttaaccagcggatttcaagaaagcgtcgcgcctgttccaggactgcttcactaccaccaacaatatgcagcgccagatcgataatcggcgtacgcagcagcgcaattaacgccccggcccccaacgccaacagcaacggttgcaccagcgcacgggctaatgcctgaggatttttggcaccataagcctgtgcagtcagcccggtggtgctcatgcgtaaaaacagcaacaacataaagagaaagctggtcgccgttgcaccaaccgccacgccgcctaaataaaccggactatcaagatgaccaattaccgccgtatcgaccagtcccagcaacggaacggtgatattggagaaaatcatgggtaaggcgagatgccagagtgctttatcagatgaagtgaggaatgccatgcagacaagcctgatgaagagagatgaaaaacaaaccgcgacgccaggcggcatcgcggtctcagagatatgttacagccagtcgccgttgcgaataaccccaaccgccagcccctcaatggtgaagctctgctgacgaaggtcaacgacaattggtttaaactcgctgttttctggcaacagttcgactttattgccctgttttttcaggcgtttaacggtaacttcgtcatcaatacgtgcgacaacgacctgaccgttacgtacatcctgagttttatgcactgccagcaaatcgccatccataatgccgatatctttcatcgacatcccgctgacacgcagcaggaaatcagcattcggcttgaacaaggaaggatcgacctgataatgaccttcaatatgctgttgcgccagaagcggttcaccggcagccacacgacctaccagcggcaacccttcttcctcttcctgcaataaacgaatcccgcgtgatgcgccggaaacaatttcaataacgcctttgcgtgccagcgccttcagatgttcttcagccgcgtttggggaacggaaccccaaacgctgcgcgatttccgcacgcgtcggcggcatacctgtctggctgatgtgatcacggatgagatcaaacacctcttgttgcctggccgttaacgctttcattccgccccctgggtgtatatacagttatgctgtgagtatatacagcaaaaggcgattttggaaccataaactgcacaataaaccagagatttatcgaaatctggaagggttatccaaaatgcgaccataacaggatgcaccaggtaatcacggcgacgataatggcaatcagcactgcggcggatcccatatctttagcgcgtccggaaagctcatggtattcagagccaattcggtcaaccacagcttcgatggcgctattgagaatttccacaatcatcaccagcatcacggagctgataagcagcacgcgggtaatcgcgtccacatccagccagcaggcgataaccaccgctaacaataccgctacgccttcctgacggaatgccgcttcgttgatccatgcagcgcgtaaacctttccaggaatagccagcagctttaataattcggatgaatccagtggtattattggccattgaaagaacctttttacattatgagcgtcaatatcagtgtaccgttaaatccgatgattcgggtttgcgtaacgccgcgcgaaacatgagcggataccacagaatttcccatgactttctgctatccttgccgcgcatttgcattattaaccagaggctttacatcgtttatgtccggctggccacgaatttactacaaattactgaatttaccattaagcatcctggtaaaaagcaagtctattccggcggatcctgccccggaactggggctggatacctctcgtccaattatgtacgttttaccgtacaactcgaaagctgacttgctgacgttgcgcgcccagtgtctggcacatgacctgcctgacccgttagagccgctggaaatcgacggcacgctactgccgcgctatgtgttcattcacggcgggccgcgtgtgttcacctattacacgccgaaagaagagtctattaagctgttccacgactatctcgatttgcaccgcagcaacccaaatctggatgtgcagatggtgccagtatcggtgatgtttggtcgcgcgccggggcgtgaaaaaggcgaagtgaacccgccgctgcgtatgcttaacggtgtacagaaatttttcgctgtactgtggctcggtcgcgacagttttgtgcgtttctcgccgtcagtttcgctgcgccgtatggcggatgaacacggcacggataaaactatcgctcagaaactggcgcgcgtggcgcgtatgcactttgcccgtcaacgcctggctgccgtgggtccacgtctgcctgctcgtcaggatctgtttaataagctgctcgcctcccgcgccattgcgaaagcggtagaagatgaagcgcgcagcaaaaaaatctcccatgaaaaagcgcagcagaacgcgattgcgctgatggaagagattgcggcgaatttctcttacgagatgatccgcctgactgaccgcattctgggcttcacctggaaccgactttaccagggtatcaacgtccataacgccgagcgcgttcgccagctggcccacgacggccatgagctagtgtatgtgccttgccaccgcagtcacatggactacctgctgctttcttacgtgctgtatcaccaggggctggtgccgccgcatatcgccgccgggatcaacctgaacttctggccggccgggccgattttccgccgtctgggggcgttctttattcgccgtacgtttaaaggcaataaactttattccaccgttttccgtgagtatctcggcgaactgttcagccgtggttattccgtcgagtatttcgtggaaggcggtcgttcccgtacggggcgtttgctggatccgaaaaccggtacgctatcgatgaccattcaggcgatgctgcgtggcggcactcgtccgattacgctgattccgatctatatcggttatgagcacgtcatggaagtgggtacttacgccaaagaactgcgcggtgcgacgaaagagaaagagagcctgccgcagatgctgcgtggtttaagcaagctgcgtaatctcggtcagggttacgtcaacttcggtgaaccaatgccgttgatgacctaccttaaccagcacgtaccagactggcgtgaatctatcgatcccatcgaagcggtgcgtccggcctggttaacgccgacggtcaataatattgctgccgatctgatggtacgcattaacaacgcaggcgcggcaaacgccatgaacctgtgctgtactgcgcttctggcgtcacgtcagcgctcactcacccgcgagcagttaaccgagcaactcaactgctacctggatctgatgcgcaacgtgccttactccacggactctaccgttccttcagccagcgccagcgagcttatcgatcacgcgctgcaaatgaacaagtttgaagttgagaaagacactatcggcgacatcatcattctgccgcgcgagcaagcggtgctgatgacctactatcgcaacaacattgcacatatgttggtgctgccttcgctgatggcggcaattgtcacccagcatcgccacatctcccgcgacgtattgatggagcacgtcaatgtgctttacccaatgctgaaagcggagctgttcctgcgctgggatcgcgacgagttaccggacgttattgatgcgctggcaaatgagatgcaacgtcaggggctgattaccctgcaagatgatgagttgcatatcaacccggcgcattctcgcacgctacagctgctggccgcaggcgcgcgcgaaacgctgcaacgttatgccatcaccttctggctgttgagtgccaacccgtcgatcaaccgcggtacgctggaaaaagagagccgcaccgtcgcgcaacgtctctccgtgctgcacggtatcaacgcgccggagttcttcgacaaggcggtgttcagttctctggtgctgacactgcgtgatgaagggtatatcagcgatagcggcgacgccgaaccggcagaaacgatgaaggtgtatcagttgctggcggagttgattacatcagacgtgcgtttgacgattgagagtgcgacgcagggcgaagggtaatcagtgagaattgccggatgcgacgcaaacgccttattcggcctaccatgatctgcaaattcaataaattgcgatatgttgtaggcctgagaagcgcagcgcatcaggcaacccagaagaaagccggatgatcatccggcttttttacatcatcagaaatgccagtaactcattgccagccctaaaaacagtaccagaccaacatagttattattcataaatgctttaaagcaggcttcacgctcgcggttggcaatcagtttttgttgataaacaaacagcgcgccagctaccagaattgaccagtaatatccccagcctaagccatttaactcaccgatgatcgccatcagcgctagtacgccaatctgaaaaataccaataatcaatttatcgtattggccgaacaggattgcggtggatttaatgccaatcttcacatcatcatcgcggtcaaccatcgcatactgcgtgtcgtaagccaccgcccagagaatattggcgaggaacattaaccagcaactcaatggcaccgactcactcacagcggcaaaagccattggaatcgaccagccaaacgccgcgcccagcaccacttgcggtagatgggtataccgcttcataaacgggtatacccacgccagcgccagcgcggcaatcgacaacagaatagtcatcgtattcagcgtcagcaccagtaaaaatgaaatcagtaccagcactacaaacagcgcgcgcgcctctttctccgttaccgcgccgctgggaagtggtcggttcgccgtgcgcttaacatgaccatcaaacttgcggtcagcataatcattcaccacacaaccagcagcgcgcatcagccagacgcccgcgacaaacaccgccaggatccagagctggggaacgcccggtgtcgccacccacaacgcccataatgttggccagagcagcagtaacgcgccaattggcttatccgtacgcattaagcgatgaaacgccagcagcttattctgcgtcagactccactccatatttttttcctcttagtacaacggtgacgccggtaaaaacagttctgttagcaacagcggtttaccgcttaatcgcaggcgggaacgtcgcccccacagtccggcatcacggcctatctcaataaagtcccgggttaatgtcgatgatgtgaacagatagcgtcctaacggcgttttacctaatttttgtaacgccagctccggcccgcttaacgttgacacaggaacgacggtacgaccggcaagccacggttcaccatcggcacataacaaaatttcacgtaaccagtaacgagactctttcggcagcagtggcagttcttcggggatttcattctgctcgacaaacccttcgcggatcatcgtcacgctcaccgtttttccctgctgttcaaaacgttttgtcatggaatcttccagcaacagccagtcgagcagttgcggctccagggcagggatctctgtaaaatagcgcagcgcacgcagttgcgttaacgcggggtgtgacatgccgaactctccgttacataacgtaaaggcattgtatcgcagaaaaatatttacgggagatgtaaagcaaattaagtgaactaatgcgcaacaaaaacgcaacaatagtacaggaggagaaaaaaaggtgcgccaggagacgcaccagttgttgcaaaatcagcactgtggggcgtaattaccccttgccttttacactgctgataaaggtggaacgggcagatgtcgaccccaggcgttcagcttcatcaagcagttttaacgccttatcaacatcacctttcgcgacagcgtttttgatcgcggtattaaaataactttccgtgtcgttgagcatcggctcgcttttcttcaccggtgccggagcgggtgcagccacagctggtgccgccgtgttgcctaccgtaaccggagctggagcggaagaaccaaatagtggtcctaccaacacgctggagctggagttcgttttcactttcagtttcagtaagccatcggtggtatgacgagcaaccggatcgggaatatccgggatcgagttaccgacgcctttggcataggctttagccgggtcgagcagttgagtcgtctgctggagatctttttccgtggtaaagaccagaacataaagtttttgctgccccaacgccggtgtcaggcgcataacgccttccagccgatctgcactcatcacgccgggttcctggtaggtgaaataactgctggggaagaaggctgatggagtcatgttctgatcaagaatcagcacattcggcgcaaatacgctggtttgtttgttcacttcgctggtcagcgtcagtgtcagttcaccaatgtttgccgggacgctgtacgcagcaaccggaccactgatgccagggacattcagttgttggccgccggtcgacagttgagtagtctgggttttagattgatcgaccggtgtccaggtgagttgttgcagcgcggcagatggaatggctggcgcgtcgctggtgttttgcggtacgtagttaacatcggcaagactgattccaggtgcgcttgccagcaaccctgctgataaacagagagcgatgagacttttattcattttcattgttttcacctcaaaatctggagctcagcggtagccaggcaatagcgcgctaaacccgataatcagaggggctttcgccccttaaagctgtttttatgccggatgcggcgtaaacgccttatccggcctactttcggcagcagttgtaggcctgataagacgcaacagcgtcgcatcaggcattggttgccggatgcggcgcaagcaccttatccggcctactttcggcagcggttgtaggcctgataagacgcaacagcgtcgcatcaggcattggttgccggatgcggcgcaagcaccttatccggcccaggttttgctattaccaccagatttccatctgggcaccgaaggtccactcgtcgctgtcgccacgaccgaagctaccgccgttgaaatcagccgacacagccttgccgtagtatgggttggttgaagagctaccggtgtagtcataaccccatttctcatcccacttggcgtaggttgcgaagacacgaatagccgggcgtgaccagatgctgtcgccagcctgccattgttgtgcaagggtaattttgtactgattgttcttgtcgccggtgcgctgggattcgacgttgtcgtagccgatttccatcacggtgctcatgattggcgtccacttgtacatcgggcgaataccgacggtccaccacttggtgccgttgtcgttatcccagttgatatcctggtacatacccacgtacatcatgtcccagttgtcgcccatggagatcgcaccgtggtcgaggatacgcagcatgtgaccgttgttattgatattgtaggcaaatttttcgttatcaaacgcgacgccagaaccctgcgacagacctttaccctgcgaggtcatcgagtcagtagcgtactgaacaacaaacttgttaaagcccttcaggacactctgagtatgttcagcagtgaataaccagccgtctttcgatgcgccatcaaccagacgatagttatcacgcaggttggcacgaccgtagtcgacacccagttctaatgtgccgcccgggttgatttccatctgcgctaaacgcacatcgaaaacgtcgttcgcggtttcgttggtatagtcataaatattgttgctggcgaaagaggaagaaccacccgcttcagaggagcgggttgctgccagagagagtttaccgaagccaacatcgatgttttccagaccggcaccaggaccagaaatatcccagtagtagaagtcgatcatatgaacgtcatgacgttggtagaagcgcttacctgcccagatggtggagcctggcagccattcgatcaggtttttaccctgcacgtttgcttcacggaaggccggatcggtagcttcccagtcattctgttgcgcgacggaataggccacgttagtgtcgaaatagaagctcttatcgccctctttccacacttcctgacccaattttaattcagcataagtttcacattcgttgccaagacggtatttactttgagcaccggtagtctggaaacactgttgttcgccgccgctacctgtccagccaataccggaacgtgcatagccgtggaaatcaacagccattgcctgagcagacattacgcccgctgcgacggcaaccgccagaggaagtttgcgcagagtaatcatcattctatctcctgagtcattgcttttcttttttcacatcacctgtgacaggctttgtgtgttttgtggggtgcttaaacgcccggctccttatgcagtcgacgacatgcagtgccatcctcacggaacagatggcaacgctctggcggcaggccgatagcgaatgtggcaccttcttctaccaacaccacgtcgttctggcggtacaccaggttttgacgaatggaagggatctggatatggatttgcgtttcgttgccgagttgctcaacgacctgaacttcaccctcaaggatgacgtcagcgatatcactcggcagtagatgctccgggcgaatacccagtgacatattggctccaacctggacatcacggctttcgaccggtagccagacttgctgacgattcggcatcggcagctccacctgcacttgatcgattgcggtggcggtcacttttactggcaggaagttcatctttggcgaaccgataaatccggcgacaaaacggtctgccggatagtgatacagctccagcggtttcccaacctgcgccacgcgaccagcgtccagcaccacgattttgtcggccagcgtcatcgcttcgacctgatcgtgggtgacgtaaatcattgtgcggcccaggcgtttatgcagacgggagatttcgatacgcatttgcacacgcagtgcagcatcgaggttggagagcggttcatcgagcaaaaatacgcttggctcggccaccagcgtacggccaatcgccacacgctgacgctgaccaccggagagcgctttcggtttgcgatccagcaaatgcgccagttgcagcacttccgcaacctggttaactcgctggttaatcacttcttttttcgcgcccgccagtttcaggccaaatgacatgttttctgctactgacaggtggggatagagcgcgtaagactgaaacaccataccaacgccgcgttctgcaggcggagtgtcattcatccgcttctcaccgatgaacaggtcgccgctggtgatcgtctcaagcccggcaatcatgcgcagtaaagtcgatttaccgcagccagacggtccgacaaacaccacgaattcaccttcatggatatcgagattgatatctttcgataccacgacctcgccccaggctttcgttacattttgcagctgtacgctcgccatgcccttctccctttgtaacaacctgtcatcgacagcaacattcatgatgggctgactatgcgtcatcaggagatggcttaaatcctccaccccctggcttttttatgggggaggaggcgggaggatgagaacgcggcttctgtgaactaaaccgaggtcatgtaaggaatttcgtgatgttgcttgcaaaaatcatggcgattttatgtgcgcatctccacattaccgccaattctgtaacagagatcacacaaagcaacgatggggcgtaggggcaaggaggatggaaagaggttgccgtataaagaaactagagtccgtttaggtgttttcacgagcacttcaccaacaaggaccatagattatgaaaataaaaacaggtgcacgcatcctcgcattatccgcattaacgacgatgatgttttccgcctcggctctcgccaaaatcgaagaaggtaaactggtaatctggattaacggcgataaaggctataacggtctcgctgaagtcggtaagaaattcgagaaagataccggaattaaagtcaccgttgagcatccggataaactggaagagaaattccctcaggttgcggcaactggcgatggccctgacattatcttctgggcgcacgaccgctttggcggctacgctcaatctggcctgttggcagaaatcaccccggacaaagcgttccaggacaagctgtatccgtttacctgggatgccgtacgttacaacggcaagctgattgcttacccgatcgctgtcgaagcgttatcactgatttataacaaagatctgctaccgaacccgccaaaaacctgggaagagatcccggcgctggataaagaactgaaagcgaaaggtaagagcgcgctgatgttcaacctgcaagaaccatacttcacctggccgctaattgcggctgacgggggttatgcgttcaagtatgaaaacggcaagtacgacattaaagacgtaggcgtggataacgctggcgcgaaagcgggtctgaccttcctggttgatctgattaaaaacaaacacatgaatgcagacaccgattactccatcgcagaagctgcctttaataaaggcgaaacagcgatgactatcaacggcccgtgggcatggtccaacatcgacaccagtaaagtgaattatggtgtaacggtactgccgaccttcaaaggtcaaccatctaaaccgttcgttggcgtgctgagcgcaggtattaacgccgccagtccgaacaaagagctggcgaaagagttcctcgaaaactatctgctgactgacgaaggtctggaagcggtcaataaagacaaaccgctgggtgcagtagcgctgaagtcctatcaggatgaacttgcgaaagatccacgtattgccgccaccatggataacgctcagaaaggtgaaattatgccgaacatcccgcagatgtccgctttctggtatgccgtgcgtactgcggtgatcaacgccgccagcggtcgtcagactgtggatgctgcgctgaaagatgcacagactcgtatcaccaagtaatgctgtgaaatgccggatgcggcgtaaacgccttatccggcctacgaaattgaaacgtatgtaggcctgataagacgcgtcagcgtcgcatcaggcagttgttgtcggataaggtatgaaagccttatccgtcctggaatgaggaagaaccccatggatgtcattaaaaagaaacattggtggcaaagcgacgcgctgaaatggtcagtgttaggtctgctcggcctgctggtgggttaccttgttgttttaatgtacgcacaaggggaatacctgttcgccattaccacgctgatattgagctcagcggggctgtatattttcgccaatcgtaaagcctacgcctggcgctatgtttacccgggaatggctggaatgggattattcgtcctcttccctctggtctgcaccatcgccattgccttcaccaactacagcagcactaaccagctgacttttgaacgtgcgcaggaagtgttgctagatcgctcctggcaagcaggcaaaatctataattttggtctttatccggcgggcgatgagtggcaactggcgctcagcgacggcgaaaccggcaaaaattacctctccgacgcttttaaatttggcggcgagcaaaaactgcaactgaaagaaacgaccgcccagcccgaaggcgaacgcgcgaatctgcgcgtaattacccagaatcgtcaggcactgagtgacattaccgccattctgccggatggcaacaaagtgatgatgagctccctgcgccagttttctggcacgcagccgctctacacactcgacggtgacggcacgttgacgaataaccagagcggcgtgaaatatcggccgaataaccaaattggtttttaccaatccattaccgccgacggtcactggggggatgaaaagctaagccccggttacaccgtgaccaccggctggaaaaactttacccgcgtctttaccgacgaaggcattcagaaaccgttcctcgccattttcgtctggaccgtggtgttctcgctgatcactgtctttttaacggtggcggtcggcatggttctggcgtgtctggtgcagtgggaagcgttgcgcggcaaagcggtctatcgcgtcctgcttattctgccctacgcggtgccatcgttcatttcaatcttgattttcaaagggttgtttaaccagagttttggtgaaatcaacatgatgttgagcgcgctgtttggcgtgaagcccgcctggttcagcgatccgaccaccgcccgcacgatgctgattatcgtcaacacctggctgggttatccgtacatgatgatcctctgcatgggcttgctgaaggcgattccggacgatttgtatgaagcctcagcaatggatggcgcaggtccattccagaacttctttaagattacgctgccgctgctgattaaaccgctgacgccgctgatgatcgccagcttcgcctttaactttaacaacttcgtgctgattcaactgttaaccaacggcggcccggatcgtcttggcacgaccacgccagccggttataccgacctgcttgttaactacacctaccgtatcgcttttgaaggcggcgggggtcaggacttcggtctggcagcagcaattgccacgctgatcttcctgctggtgggcgcgctggcgatagtgaacctgaaagccacgcgaatgaagtttgattaagggagataacaaaaatggcaatggtccaaccgaaatcgcaaaaagcacgtttgtttattactcacctgctactgctactttttatcgcggcaattatgttcccgctgctgatggtcgtcgccatctcgctgcgtcaggggaacttcgcgaccggtagtctgatcccggagcaaatctcctgggatcactggaaactggcgttaggttttagcgtggaacaggctgatggtcgcattacgccaccgccattcccggtactgctgtggctgtggaactcggtaaaggtcgccgggatttccgcgattggcattgtggcgctctccaccacctgcgcctacgctttcgcccgtatgcgctttccaggcaaagcgacgctgctgaaaggaatgctgattttccagatgttcccggcagtactttcactggtcgcgttgtatgcgttgtttgatcgtctgggtgagtacattccattcattggcctgaatactcacggcggcgtaattttcgcgtatctgggcgggattgcgctgcatgtctggaccatcaaaggttatttcgaaaccatcgacagttcgctggaagaagcggcggcgctggatggtgcgacaccgtggcaggccttccgccttgtcctgttgccgctgtcagtaccgattctggcggttgtgttcatcctgtcgtttatcgctgccattactgaagttccggtcgcgtcgctattactgcgtgacgtaaacagctacaccctggccgtggggatgcagcaatacctcaacccgcaaaactacctgtggggtgactttgccgccgctgccgtgatgtctgcattaccgatcaccatcgtcttcttgctggctcaacgctggctggtcaacggcctgacggcaggtggtgtgaaaggttaaagatgttgttctgccaatgttatgccgctgcaccctcaacttacgttatcccaacttgtgactgttattcggcgctccacggagcgcctttttttactcccgcttcagccgtttcgaattacacagccacagggtgatcaccagtaacaggatcgctgccgagtagatcaacacatccagtggcgatttatgatcgacgatgatcaagcgcacaatggcggtgatcccaatatagacaaagtaacgtagcgggaagtgaaaaccggactgaaagtacttcacaatcagcgcgataaattcgaaatagagaaagtaaaccaccagcccttctaccagctcatatttactggcttgttctggcgcaaacagcacatcagccagatgcaccgtttctttgccgaggaagacaaccaaaatcaggccgaggcacaacaggccaagattgagtacggtctgcaaaatggtggagataaactccacgcgcggacgagagagtgacgtcatagcagtacctccttcacagtggcgagcttcctgtataacgcaaaaatgtgacggagatctatattttttgtgtatgttttgttcagctcaattaagtgggcatctcccatcaacgtcgcatctggcaaaacacacagcccaaaaaaatcacccattcaggtgattcccagccaccagcaatgcgcgaaaaatcgacaatgttcctctggaacaaatgaaacgtaacctgataaaggtggtaaaaatgaagtcttattttgctgctttgatgttatcagtctctgttcttcctgcttatgctggtccgctcggtactgctgataaagccgacctaccgcaaagcaatgtctccagtccaatgatggcccagtcgctcaggcaaccagacctgcaaccgatatcgacggacaggaagacagaatgttttcgcctttacacaccagatcgcaaaccgggggtgaactgcgttcctgatggctcgacaggccattaagaatgaaggtgccagtgagtgcgaaaactggcacctttcccatgacttagcggaaattgacgctacggtcgctggtcatatcatacaactggaacttacgcccaagttgctgaccaccgtcacgcgtcagcggcgtccagccaatcgccgcacggctgcgtgtcgggccagacgagaagagatccagcggtacagagacatacacgcctttggtgaagtccccttcgccgtactcctctttcgaaacattcgtgatcgtggcatagccccccactaccacgccgctatcaaagcgtttggcgatctccagcgtgccgcctttatccccagccagatactgcccgacgctcgctttcactaacacgtcctgggcgaaagatggcgtccagtacgcggtcagatgtccggttttcacgctgtaatcggtgaatttcatcatatcttttgcgctacgccagtcgcgctgtttaacgtagttggcatccagaccaaacgcccagttgctgtccagcgggcgatacaacacttctgcccccgcaccgccaaacatggtttcgagataacctccgtagacctgaccgtagaagccgttgcccagatgctggaagtagttggcttgcaggttattcacatagacatcgttctgcacatactc

SEQ ID NO: 10001 - DNA, 52436 bp, Escherichia coli
ccttgatcattcatgctaccaaagacgaagttagtcccttcgttggcaaatccgagcagtttttcgaacatttcggagaagcctttcacgaagcccagaccaacgtcggagttcaggaagaaccacgccagtaacacttcgataacaagcagttgaataacataacggatacgaatttttttgcggtcgctgcttaccagcagtgcgagaatcgcaacaacggcaagtgccagtacaaaatgaaggacgcggtccatatttgctccaaatatgaggcaggttaaatttccgtgcacattctatgtaacatggttaaggaaaacgagatctgacacacaatataatgacgtcctgtgacaagcttcaaaaatagtgatctgtcatacatttctgctatgttgtgtatggaagcggaaggttatgtaaatgtgctaatattaaacataaccataacattcgagtcatctatcttttcgtagtcataatcctggtctatcagagaaatcatcacaacccatttaaatgagtttgataatcattctcatttaacgtagcatgaaacatagcaaaggctatgttttagaggcacaagatgacgaactatcgcgttgagagtagcagcggacgggcggcgcgcaagatgaggctcgcattaatgggacctgcgttcattgcggcgattggttatatcgatcccggtaactttgcgaccaatattcaggcgggtgccagcttcggctatcagttattgtgggttgtcgtttgggctaacctgatggcgatgctgattcaaatcctctcggccaaactggggattgccaccggtaaaaatctggcggagcagattcgcgatcactacccgcgtcccgtcgtgtggttctattgggttcaggcagaaattattgcgatggcaaccgacctggcggaatttattggtgcggcgatcggttttaaactcattcttggtgtttcgttgttgcagggcgcggtgctgacagggatcgcgactttccttattttaatgctgcaacgtcgcgggcaaaaaccgctggagaaagtgattggcgggttactgttgtttgttgccgcggcttacattgtcgagttgattttctcccagcctaacctggcgcagctgggtaaaggaatggtgatcccgagtttacctacttcggaggcggtcttcctggcagcgggcgtgttaggggcgacgattatgccgcatgtgatttatttgcactcttcgctcactcagcatttacatggcggttcgcgtcaacaacgttattccgccaccaaatgggatgtggctatcgccatgacgattgccggttttgtcaatctggcgatgatggctacagctgcggcggcgttccacttttctggtcatactggtgttgccgatcttgatgaggcttatctgacgctgcaaccgctgttaagccatgctgcggcaacggtctttggattaagcctggttgctgccggactgtcttcaacggtggtggggacgctggcggggcaggtagtgatgcagggcttcattcgctttcatatcccgctgtgggtgcgtcgtacagtcaccatgctgccgtcatttatcgtcattctgatgggattagatccgacacggattctggttatgagtcaggtgctgttaagttttggtatcgccctggcgctggttccactgttgattttcaccagtgacagcaagttgatgggcgatctggtgaacagtaaacgcgtaaaacagacaggctgggtgattgtggtgctggtagtggcgctgaatatctggttactggtaggaacggcactgggattgtagttgaatgagcgtcgcatttggcaccattggcggatgcggcgtaaatgctttatccgccctacgcgttaaagagctggtttgtaggcctgataagacgcgctagcgtcgcatcaggcattgtgctccattgacggatgcgtttaatggcggtgtccatgtccgcggccttttccacgatgatcgtcacgatcgcgccagccttcacgatagccacgctcatacgctttacgcttatcccagccacgatggtagccattatcatgacgccaccagcggtttttacgccattcataattgcggtgccagtagtcacggtcgcgccagtgaccaccgtcccagtaattaccgtaatgatcgcgatcgccaatttgtaatttgattgatggcagtagggtgatttcacttgcgtttgccgcaagcggggtaaatgccatcagggcggccgccagaaacagtgacctgaacattgttattctccttcacgatcgaagccgtcagcggcctgttaacgcaatattacggggaggtaaagcgccgtatcatcgccataactcttaaatcataaaggagagcattttttgctaaacgttatcgtggggtggctgttgcttctgacgattgaccatcatcatcggcttacctgctaataacagccatgccgggagcatgacgatacagagcagcggtagcaatgtggtattgggtacaacgactgccgccataaaaagacttaaccagccatcgcgtgttaccaccagcacgatgccgagtatagcgcaggaaacggttattgccgctggaacggcgggaacgtgctcatgaagcatcaaccctaatgccacgccgacaaacactgccgggaagattcgcccaccgcgaaagccactggcggcagcaacgaccagggcggcaagttttatcaccgccagcaaaaagtaatcgctggtgctgaaagcctgatttgccaccatctgctgcatctcatccagccctttaaacagcgaaaccggtccaccaataacccccagaataccgagaataagtccgccaatacccagcacgaacaccggatttttcatttgatgcatcatcgcgtgcaaccgtggtaagcaccatacggcgaccatccctgctgcgatggcaatcgccgcgacaattgcaccgctgagaatatcggtcatttccatctgtccgtaatgcgcaatgggcagtgaaaaatgaggatggaaaaataatccggtagtaagtgcaccagctgctgccgccattaacggcgcaaagagacgatcccatagcggaacttcattactgccatttaaggtttgcgaaaatatcaatgccgccgcaacaggtgtgccaaacagcgcgccgatagttccggcagaggctaaaatagtccactccattcggttgacgcgcggtaacagacgagcgccaatggcgacggcaagggcgatattgacggtcatgatcggatgttccggccccaggctgacgccgccagcaagaccgagaattaatgctacgataagtcctggtagcgcagagggcggaaccggtgcgccgataagcggttcacaggcggggtctggtccggcatgaccctggctgaaacggataaccaaccccaccgcaatacccgttagcgttaatacaccgatgatccagagaggtgaatcctgggctatccccagagttcccggcagtcgttgccagagcaaattctgtaataccgaggcgattttcatcaccataatcagaataagactggacgcaatcccaattgccacggcggggagcgataataacaacatggttctggctcgcggatggagcatgttctattccttatgcggggtcagatacttagtttgcccagcttgcaaaaaggcatcgctgcaattggtgctgaaacgataaagtaattgtgtgacccagatcgatatttacagggagcctgcctttccggcgttgttgttatgcccccaggtatttacagtgtgagaaagaattattttgactttagcggagcagttgaagaatgacaaagtatgcattagtcggtgatgtgggcggcaccaacgcacgtcttgctctgtgtgatattgccagtggtgaaatctcgcaggctaagacctattcagggcttgattaccccagcctcgaagcggtcattcgcgtttatcttgaagaacataaggtcgaggtgaaagacggctgtattgccatcgcttgcccaattaccggtgactgggtggcaatgaccaaccatacctgggcgttctcaattgccgaaatgaaaaagaatctcggttttagccatctggaaattattaacgattttactgctgtatcgatggcgatcccgatgctgaaaaaagagcatctgattcagtttggtggcgcagaaccggtagaaggtaagcctattgcggtttacggtgccggaacagggcttggggttgcgcatctggtccatgtcgataagcgttgggtaagcttgccaggagaaggcggtcacgttgattttgcgccgaatagtgaagaagagggcattatcctcgaaatattgcgtgcggaaattggtcatgtttcggcggaacgcgtgctttctggccctggactggtgaatttgtatcgcgcaattgttaaagccgacaaccgcctgccagaaaatctcaagccaaaagatattaccgaacgcgcgctggctgacagctgcaccgattgccgccgcgcgttgtcgctgttttgcgtcattatgggccgttttggcggcaatctggcgctcaatctcgggacatttggcggcgtgtttattgcgggtggtatcgtgccgcgcttccttgagttcttcaaagcctctggtttccgcgccgcatttgaagataaagggcgctttaaagaatatgtccatgatattccggtgtatctcatcgtccatgacaatccgggccttctcggttccggtgcacatttacgccagaccttaggtcacattctctaaatccttcctgttatatcgggaggtaactctcccgataatcttttaaatcatacagttaattaaattttctttgtgtccccctcacaaggccgacctgcgtcacacttccgtacagcgggattaattctccagtaaatgcattatttgtctggtaacggcgatttgttttgcacgttcataattccactcgtcaactatcactgaacgaggaattaacgatgagtaagaaactgattgccttatgtgcctgcccaatgggcctggctcacacttttatggccgctcaggcgctggaagaagcggcggtagaagccggttatgaagtgaaaattgaaacccagggcgcggacggtatccagaatcgcctgacggcgcaggatatcgccgaagcgaccatcatcatccactccgtggcagttaccccggaagataacgaacgtttcgaatcacgcgacgtttatgaaatcactttgcaggacgcaattaaaaacgctgcgggaatcatcaaagaaatcgaagagatgattgcctctgaacaacagtaatattcgacagggataattgttatggccattaaaaaacgcagtgcaaccgttgtgcatggcgcatccggtgcggcagcggcagttaagaatccgcaggcctctaaatccagcttctggggtgaactcccgcagcatgtgatgtcagggatttcacgcatggtgccgaccttaattatgggcggtgtgatcctcgctttcagtcagctgattgcttatagctggcttaaaattcctgctgatatcggcatcatggatgctcttaatagcgggaaattctctggtttcgacctctccttacttaaatttgcctggctgtcgcaatccttcggcggcgtgttgtttggttttgccattccgatgtttgctgcttttgtggcgaactctatcggtggcaaactggcgttcccggctggttttatcggcggcttgatgtctacccagccgacgcaactgctgaacttcgatcccagcattatgcaatgggcgacctcttcgccggtgccgtccaccttcattggtgcgctgattatttctatcgttgccggttaccttgtgaaatggatgaaccagaaaatccagttaccggatttcctgttagcgttcaaaaccacatttttgctaccgattctttccgccatttttgtcatgctggcgatgtactacgtcatcaccccctttggtggctggatcaacggcggtatccgtaccgtgctgaccgctgcaggtgagaagggcgcgctgatgtacgcaatggggatcgccgcggcgacagcaatcgaccttggtggcccgatcaacaaagcggcaggtttcgttgccttcagctttaccactgaccacgtattaccggtcactgcacgttctatcgctatcgttattccgccgattggtctgggtctggcgaccattatcgatcgtcgcttaactggcaaacgcttgttcaacgcccagctttatccgcagggtaagaccgcgatgttccttgcctttatggggatcagtgagggtgcgattccgtttgcactggaaagccctatcaccgccattccgtcgtatatggttggcgcgattgtcggctcaaccgccgcagtctggctgggcgcagtgcaatggttcccggagtccgctatctgggcatggccgctggtcactaacctcggcgtctacatggcggggatcgcgctgggggcagtcataactgcgctgatggtggtgttcctgcgtctgatgatgttccgtaaaggcaaattgttaatcgatagcctgtaagaaggaaaaatccagatgacattactcgcttcgctgcgtgactggcttaaggcacaacaactggatgcggtgcttctctcctcacggcagaacaaacagccgcatctggggatctccaccggatcaggttatgtggtgattagccgtgaaagtgcgcacattctggtggattcgcgctattacgcggatgtagaagcccgcacgcaaggttaccagctgcatttgctcgacgcgatgcacacgcttgccaccatcgtcagacaaatcattgccgatgagcagttgcaaacgctcggttttgaaggccagcaggtgagttgggaaaccgcgcaccgctggcagtccgaactcaatgcgaaactggtgagcgccacgccggatgtgctgcggcaaatcaaaacgccagaagaggtggagaaaatccgccttgcctgcgggattgccgatcgtggcgcagagcatattcgccgctttattcaggcgggaatgagcgaatgcgagatagccgctgaactggagtggtttatgcgccggcagggcgcagaaaaagcctcttttgacaccattgtcgccagcggctggcgtggggcgctgccgcacggcaaagccagcgacaagattgttacagcgggcgagtttgtcactctcgatttcggtgcgctctatcagggctactgctctgatatgacgcgcaccttgctggtgaatggcgaaggggtgagcgccgaatctcacccgctgtttaacgtctatcaaattgtcctgcaggcacagctcgcagcaatctccgcgattcgccccggcgtgcgctgccagcaggttgacgatgccgcgcgccgggtgattacagaagccggttatggcgactatttcggccataacaccggtcatgctatcggcattgaagtccatgaagatccgcgtttttcaccgcgggacaccacgacgctacagccaggtatgttactgaccgtggagccagggatttatttgccagggcaagggggcgtgcgcatcgaagatgttgtgctggttaccccgcaaggcgcagaggtgctctacgccatgccgaaaacagtgttgctcacgggagaggcataatggatttatcgctattaaaagcgttgagcgaggcagatgcgatcgcctcctcggaacaggaagtgcggcagatcctgctggaagaagcggatcgcctgcaaaaagaagtgcgatttgatggtctgggatcggtgctgatccgactcaatgagtcgacaggtccgaaggtgatgatctgtgcgcatatggacgaagtgggatttatggtgcgcagcatctcccgcgaaggggcgatcgatgtgttgccggttggcaatgtacgcatggctgcccgccagcttcagtcggtgcgtatcactacccgtgaagagtgcaaaattccaggcctgcttgacggcgatcggcaggggaatgacgtcagcgccatgcgcgtggacattggcgcgcgctcctgtgacgaagtgatgcaggcaggaattcgtccaggcgatcgcgttaccttcgataccacttttcaggttctccctcaccagcgggtgatggggaaagcctttgatgaccgcctcggttgctatctgctggtgacgttactgcgtgagctgcacgacgccgaactgcctgcggaagtgtggctggtggcaagttccagcgaagaggtgggattacgcggcgggcaaactgccacccgcgcggtgtcgccggatgtcgccattgtgcttgataccgcctgctgggcgaaaaactttgattatggcgcagctaaccatcgccagattggtaacgggccgatgctggtgttaagcgacaagtcactgattgcgccgccaaaacttatcgcctggatcgaaaccgtggcggcagaaattggcgtaccgttgcagtcagatatgttcagcaatggcggcacggacggtggggcggtgcacttaaccggcactggcgtacccacagtggtgatggggccagcaacccgccacggacattgcgccgcatcgattgccgactgccgcgacattttgcagatgcagcaacttttatctgcccttattcaacgttttacgcgtgagacggttgttcaactgacggatttcagatgatctcctgattaacccggagcggttatgttaacgattcaatttctctgtcctttgcctaacggtctacatgctcgtccggcgtgggaacttaaagagcagtgcagccagtggcaaagcgaaatcacttttattaaccatcgccagaacgcaaaggccgatgcgaaaagctcgctggcgctgattggcactggcactttatttaatgacagttgcagcctgaacattagcggtagcgatgaagagcaggcgcggcgagtgctggaagagtatatccaggtgcgctttatcgacagcgatagcgtccagccgacgctggcagaactgacggcgcatccgctgccgagttcattaagccgcctgaacccggatttactgtacggcaacgtgctggcaagcggcgttggcgtgggtacactgaccctgttacagagcgacagcctcgacagttatcgggtgatccctgcgagtgcgcaagattccaccctactggagcacagtctggcaacgcttgccgagcaactgaaccagcaattgcgtgagcgtgacggcgaaagcaaaactatcctcagcgcccatttgtcgctgattcaggatgatgaatttgcaggcaatatccgtcacctgatggcagaacagcatcaggggctgggggcggcgatcatcagcaatatggagcagatttgtgccaaactttctgcttctgccagcgattatctgcgcgagcgggtcagcgacattcgcgatatcagcgaacagttgctgcatatcacctggccggaactaaaaccgcgcaataatctggtgcttgaaaaaccgaccattctggtggctgaagatttaaccccaagccagtttttgagcctcgatttaaaaaatcttgcgggcatgattctggagaaaaccgggcgcacctcgcataccctgattctggcccgcgcttcggcgatcccggtactgagcggcctgccgctggatgcgattgcccgttatgccgggcaacctgcagtgcttgatgcccagtgcggcgtactggcaattaatcccaacgatgcggtgagcggttattaccaggtggcgcagacgctggcggataaacgccaaaaacaacaggcgcaagctgccgcgcagctggcctattcccgtgataaaaagcgtattgatattgcggcgaatattggcacagctctggaagccccaggcgcgtttgccaacggcgcggaaggcgttgggctgtttcgtaccgaaatgctctatatggatcgcgacagcgcgccggacgagcaggaacagtttgaagcgtaccagcaggtgctactggcggcgggcgacaagccgattatcttccgcatgatggacatcggtggcgataaaagcattccttacctcaacattccccaggaagagaacccgttcctcggctatcgcgcggtacgtatttacccggaatttgctggcctgttccgtactcaattgcgggcgattttgcgcgctgccagtttcggcaacgcccagttgatgatcccaatggtccacagtctcgatcagatcttatgggtgaagggtgagatccaaaaagcgatcgttgagcttaagcgcgatggcctgcgtcatgcagagacgattacgctgggtatcatggtggaagtgccgtcggtgtgctacatcatcgaccacttctgcgatgaggtcgatttcttcagtatcggctccaacgatatgacccagtatctgtatgcggtcgatcgtaataacccgcgcgtatcgccgctgtataacccgattacgccatcgttcctgcgcatgttgcagcagattgttaccgctgcgcatcagcgcggcaaatgggtaggtatttgcggtgaactgggcggtgaaagtcgttatctgccgctactgctagggctgggcctggatgagctaagcatgagtagcccgcgtattccggcagtgaaaagccagcttcgtcaactggatagcgaggcgtgtcgggaactggcgcgtcaggcgtgcgagtgccgcagcgcgcaggaaattgaagcgttacttaccgcgtttgcgccggaagaagacgttcgcccactgctggcactagagaatatctttgttgatcagtcctttagtaataaagagcaggcgatccagttcctgtgcggtaacctcggtgttaacgggcgtactgaacatccgttcgagctggaagaagatgtctggcagcgggaagagattgttactactggcgttggttttggcgtggcgatcccgcacaccaaatcacagtggatccgtcattccagtatcagcattgcccggttggtgaaaccggttgactggcagtcagaaatgggcgaagtcgaactggtgatcatgctgacgctgggcgctaacgaagggatgaatcatgtgaaagtcttctcgcagctggcgcgcaaactggtgaataaaaacttccgccagtcgttgtttgccgcgcaagatgcgcaaagcatcctgacgctgctggaaacggaattaaccttctgacgttagccctgaaaacgggcgctgtactctcccggcgtcaggccaaactgacgccggaaaacgcgacaaaaatagtcgctgtccggaaaaccgcaacgctgtgccacatcatgaatcgacagatgatatttctgcaaaatcatccttgcctttgccattcgtacccagcgaacatactcgataaaacgcattgttccatgctgagcaaacagttttgacagatgattgggcgtgatattaaaaaactgagccacgctctcgcgggtgagcggctgggcataattatcctgaacccagttacaaatgctgtgatagagaaaatcgccgcgcggctgcgaattgcccggcggcatattcaccacgttacggcaaagatgcagcaaacttaacaccagtggctgaatgatattctgctccagcggcgaacggctaagatgggtgagggcggtaagcatcgcttcaccttcgccgcgttgcaggctgggaagttggatctggcgagcaggatgtaacaacgacgtggtgcggctatcgtaaaatgataagccaagccaggtcggtgcgaacaccaggcttaacagcatcaccggtttgttgttgaccggtaaattagccgcgcgtgccggaataaacagcatttctccttccaccatacgttgctgctttgcttccagcagattgccgtattcgccgcgtagcacgatatccagacggggaaaatcaatacataaactgcccactggcaatgaggcggggtggctggcaaaccagacgcgcccaaggagttgcgggttaagcaccaggccgctgaacagatcggcgaaaaattgttgatcggcgggcaagcctggtgctttcatgaaagttcccgattacagatgcattaactggcggaattctttaactttgctacggctgaccggcacttcaaaatccagatctttcagccgcagaatgtaggtgttattaaaccacggttcgatttcgcgtattttgttcagattgacacaaaatgagcgatggcagcggaaaaaatgcgacggcggcagcttgctgcaaaactcggtaatgttcatcggcattacgtaggattcacgccgcgtatagacaaaggtcattttctcgtgcgcttcggcgtaatagatatcgttaattggcgtgacgatgattcgctcatctttcaccagattaatggtgtcattctcacgcgttaccgtcgcggcaggtgtcgtactgctggtctgctgttgttgccaggctgcttccagtttttgcagcatcccggtaatgcgtgactcctgatacggtttgagaatgtagtcaaacgcttccagttcaaatgcttccaccgcatgttctttccacgcggtgatgaatacaataaacggtttatgggcgaactggctgatgttttgcgccagcaacacaccgtccagcgacggaatattgatatccagaaaaatggcgtcgacgcggttatgctgcaaaaacttcaacacgtccagaccgtcgtcaaaggtgccgacaatctccatctggctgtgctctttaattagccagctcagttcctgttgtgccaggaattcgtcttcaacaatgatgactttcacaatatcactccggctcaaagcaataaggtagcctgtgaggcgactggggtgcgttggttaggaatgtaaaacgcaatttccgttcctggttccaggcggcggatatgcagcccctcgccatacaataacttcacgcgatgatggacattcagcaggccaattttattgcccggcatttcgttcgcttcgacccgctcaatcacctttggatcgatgccgtgcccggtatctcgcaccgcaatgcgtacccgattaccgcactctgcaacgctgatggtgacaacgcctttacctttgcaaggctggataccgtggacaatggcgttttccaccaacggctggatcagcaggctgggaatgcagcaattcacctcttcatcaatatcatagataaccgtcagcttgtcgccaaagcgggcctgctcaatggcaatatagtctttaatttgatacagctcttttttgatatcgatttgctcatcgtcttttaattcaatgttatagcgcagatagcgcgacaaattaaagatcagctggcgagcagtatccggattcagacggattgacgatgaaatagcgttcaaagcgttaaacagaaaatggggattaattttgctttgcagggcgcgaagctctgccttatttgccatttcacgcagctgctcagcgcgcgaaacctccagttgcgtggagatgatttgtgacagaccgaccgccatttcctgtaatgacgaggttatctgatgcgcgtggcagtagtaaattttcagcgttccggtcacaacgcctttctcccacaatgggatcaccagcatggaatgaatctctggtgtgcggtgggcttcatcattgtttttaatgatgatttttccgtaattcatcgcctgtcgggtagtcgggctaatgaagtcatcgccattctgatagttgtgttcacccacgccgacataggccagcacatgatcagtattagtcatcgccaccgcatcggcgtgaatatcatcgcgaataatttcacaaactttgcgtaatgactcgctattgacatggcgaaacagcggtagcgttttgttggcgatatccagcgccagcttggcctgccgcgcggcgctggcctctttttcgccctcaacgctttgcaccagcagcacaataaagccgatacagacgctaccgaggatcattggaatcccgattttagagacgatatcgatccccaatgcggtagttggtgcccagacaatcaccagaatcatggtcaacgtttcacacaacatgccgccgagaataccgacgcgccagcgctgtgctttggggattttcaggttgatccagcccgatatacaacccgccagaatgctggtgataaagcaggggatcgccgttacgccgccgatgtcaattaaataacggtgaatacccgcaatcacgccggtaatgatgcccacccacgggccaaacagaattccgcctgacatcaccgcgataatacgtacgttcaccagcgagccttctacgggaacgccggaccaggtgctgaacagggcgaacagcgagaaaatggcggtaacggcgagcagctctttcggtgagtgtgccgacttgtgcaacagttcgcgaaacaggcggatacggatgagaaaaaacaggcagataagcattaacgcggcccgatcgaagaccgccagcagcatgttgaatatttcgtgcacgggtgactctgaataaggattaaacctctatgataggtaacctgaaggctgatgaccagcaggccgtttttgaggaaaaaccacaattttaaaaggggattgaaagataaatggtgtattagcaatgcatctcttgataatgcacatctggttggtaaatttattgaaattataatgttaataaaatgagtggtaattttcttgttagcgtagataaatttcctgtttttgaagtggagttcctcatttaaagccattgataaaaatgttctaaaacgctggacagacagaaattaatcaggctattttcaaaacagccaccatcgtggcgacgtcgctcggacggtccgggcgctaacgttaatctgaggaaattatggctgacactcgccctgaacgtcgctttacgcgtattgatcgtctcccgccctacgtttttaacattaccgctgaactgaaaatggctgcgcgtcggcgcggcgaagatattatcgatttcagtatgggtaacccggacggtgcgactccgccgcatatcgtcgaaaaattatgtacggtggcccagcgcccggacacgcatggttactccacttcacgcggcattccgcggttacgtcgcgccatttcccgctggtatcaggatcgctacgacgttgaaatcgacccggaatcagaagccatcgtcactattggttcgaaagagggcctggcgcatctgatgctggcgacactggatcacggtgacacagtgctggtgccgaatccaagttaccccattcatatttacggcgcggtgattgccggggcgcaggtacgctcagtgccgctggtggaaggtgtcgatttcttcaacgaactggaacgcgccattcgcgaaagttatccgaaaccgaagatgatgatcctcggcttcccgtcgaacccaaccgcgcaatgcgtggagctggagttcttcgaaaaggttgtggcgctggcgaaacgctacgatgtgctggtggtccacgacctggcctatgcggacatcgtctacgatggctggaaagcgccgtcaatcatgcaggtgccaggtgcacgcgacgtggcggtcgagttctttacgctgtcgaaaagctacaacatggcgggctggcgtatcggctttatggtcggtaacaaaacgctggtcagcgcgttggcacgtattaaaagctatcacgattacggcacctttacgccgttgcaggtggcggctattgcggcgctggagggcgatcaacagtgcgtgcgcgatattgccgaacagtacaaacgccgccgtgatgtgctggtgaaagggctgcatgaagcgggctggatggtcgaaatgccgaaggcttcgatgtatgtctgggcgaaaatcccggaaccgtatgctgccatgggctcgctggaatttgccaagaaattgcttaacgaagcgaaggtctgtgtctctccagggattggctttggcgactacggcgatacgcatgtgcgctttgcactgattgaaaaccgcgaccgtattcgtcaggcgattcgtgggattaaagcgatgttccgtgccgacggtttactacctgccagcagcaaacatattcacgaaaacgcggaataaacaccatcgccagaaatgcaaacaggagcctgatggctcctgtttttcattgcacagtttgcttttagatcatcagggcaaaagtaccggcccaaacgatgaccataaaagaaatgcccataaagaaatatttcactttacatctctccgcgtaactactgttacgcctgaatgactttattacacctgatacagtgagttgacaccgggcaaaacgaccttaaacgtcctgtattttaccgtgggcatcatcccagaattctgagctaaactgctcgagacggcgctaatgtacgcctaaaactgaaacgagacaagaggcattttcttatttacttttagtaacttacaggtgtctcatatcggcgacagtttaatttctgacggtaataattagatattcagcgaaggaaaaaaccttaagaaaaaagccataaaaaccatgaggttattatggctgatttgaggagggaaagagtgagagccgtttgttaaatgtataacgacgattcacccaccgggcgcgttttaaagcgacggtggatccagaggtactgctccggtgcgcgcatgatctctttctcgataatcttgttcatataggcagcggcttgattttcatctgtcgggtagccttccatctctggggtgatgtacaaacgatatccgctgtaatccgcttttcttaccatcgttacggtcaacatggctgcgccagagagacgagagaggacataggtgccattggttgtggcgacattttccaccgcaaagaacggcgcgaaggagctgcctttacgaccataatcctgatcgggagcaaaccataccgcttcacctttcttcagtgcactgacaataccgcgcagattatttctgccgatcatcgctttgttagagcgcatgcgaccacgggtctgcacccattccatcagctgattattatgcgggcgataggtggccatcattggttggcaaagtcccatcacccgaccgcccagttccagcgacataaaatggacgccgacaaccattacgccgcgattttgcatttgtgcgcgtttaaggttatccagcccttccacatcaaaccatttacgtacgcgactgtcgggccagaaccacgccatgccggtttctaccagcgccatgccgagtgaacgaaagttttcggcaatcatcttctcgcgctctttcgcagaatgctgcgggaaacaaagttccaggtttttacgggcgatagattcacgacgtttcaggaatggtcgcgccattgtgccgatacgcgtgccgagaaagcagagaacaggataaggaagctgtacccaaagccagagtacaccaagcccaaaccacgtgagccagtagcgaggatgcagaaactcgcgggaaaatttgcattttggaaacatagttaccttctgtagatacgaattgttgtatcgcagaagattccatgtcgacagcggtacactcaattgattaggccatcatgtacgacaatggttcctgtaaagagtgtaaagactagtcaggacataaccacgaggagcatgaatgcggtatctgtactttatcactcgctgactgctttcagctactgattattaatcgtgcaaagtaaaaagttttccgcacgcaatagcgttgcatttaacttgctgttttcattgatgcttagcaaaaattgccagaggttaaggattgtcttactattaaagtgactgaagttacaggttttttagcgcggcaggaggttgagctatgatttatttatggatgtttctcgccctgtgtattgtctgcgtaagcggatacatcggtcaggtactgaacatgatatcggcggtctcttctttcttcggcatggtgatcctcgctgcactcatttactacttcaccatgtggttaactggcggtaatgaactagtgacggggatatttatgtttcttgccccggcttgtggcttgatgattcgctttatggtggggtatggcaggcgatagtgggtcaggatggctcatttgggcaggtgttcacatcagcatcagacatgattgttcacctgccgtgtgacagacgctatcgcacaggatggataagataattcgcctttgtcggaaaagggggcggaatttcttctgtgaggtttaatggtggcgcatcttctctcatttttaacaaaatcgcctgtgatggctgaatttttgtagagtgagttgtcgtcatcgctgacgttttttctgtctctttatagctcgcctcactaccaccaccagaaatagaaaatgcaaaaacattgcatgccataatagagaccaataaaaataagctaaaaagcattaagtttactttcatagaaagttatcctgaaaatggttcactgaaaacctacgacgttattgctgtatttacatataattaatcagtatttacatcgatataataaatgacatctctttttggtatataagaatagttctctgtgacaggaagcatattcctacaactgtaagactaaatgccgctttgcgataataactacagttgtaagataaccctttcaaaatgtccgttgctctctgatttctcatttcatgctcacccaatatgatggcggcgttttctaaaactgttaaagaatgaggtaagtatgaaacgtttaattatggctacgatggtcacagcaattctggcatcttcaactgtatgggctgctgataatgcaccggtagcggcacaacagcaaactcagcaagttcagcaaacccagaaaacggcagcggcagcagagcgtatctctgaacaaggtttatatgcgatgcgtgacgtgcaggtagcgcgcctggctctgtttcatggcgatccggaaaaggcaaaagaactgaccaatgaagcttccgctttgctgtcagatgatagtaccgaatgggcaaagttcgctaagccaggtaaaaagaccaacgtcaatgatgaccaatatattgtcattaatgcatctgtcggaatttctgagagttatgtagcaacccccgaaaaagaagccgcgataaaaattgccaacgaaaaaatggcgaaaggggataaaaagggtgcaatggaagagcttcgcctggccggtgttggtgtaatggaaaaccaatatttgatgccgcttaaacagactcgtaatgcacttgctgatgcgcagaaactgcttgataaaaagcaatactacgaggcaaacctggcgcttaaaggtgcggaagatggaatcatcgttgatagcgaagcactgtttgtgaactaaacctgacaggcaatatattgaggtaaaggatttaactccctccagtcgacaattttttatgaccacaatacgacaggttgtggtcataaaattatttggcgctcgcggttctataaactcgcattttatcttcctcaaagtaaaccgcaataatcccatattatcacaaatcatttgttatgttatattttatggtacgctttaaatagtgtaatcataaccttacttgtaaatcactgacacttcttacagttgtaagaataacatcacaaatgtcgcggctctctctgattaccgcgagccaatatttattatattcttcttttcgtcctcactacttaccatgcagaaaggaattggaagtagcgatgaaatgattttcagcacttgatacaggaatttaaaaatttcgagtgcagctacgacgatattttgcagattatttatagaggcgttatgccttaaataaacgctaaattaacacatatttaattaactaataggtattgctatgtcaactccacttcaaggaattaaagttctcgatttcaccggtgtgcaatctggcccatcttgtactcaaatgctggcctggtttggcgctgacgtcattaaaattgaacgtcccggcgttggtgacgtaacgcgccaccagctgcgagatattcctgatatcgatgcgctttacttcaccatgcttaacagtaacaaacgttctattgaattaaataccaaaacagcggaaggcaaagaggtaatggaaaagctgatccgcgaagctgatatcttagtcgagaactttcatccaggggccattgatcatatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatctactacaggtttttgggacggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtgttgaacctttgccgcgtgaaattacgcgaccagcagcgtctcgataaattgggttatctggaagaatacccgcagtatccgaatggcacatttggtgatgcagttccccgcggtggtaatgcgggtgggggcggtcagcctggctggatcctgaaatgtaaaggctgggaaaccgatcctaacgcctatatttatttcactattcaggagcaaaattgggaaaacacctgtaaagccatcggcaaaccagaatggattaccgatccggcatacagtacagcccatgcccgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgtcgaagtggaacaaccgttgcgtggaaaatatctgacagttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgatattaacgggggcttctggctcccaatttataaaaatttcgaggttattaatcatgtcagatcaacttcaaatgacagatggtatgcatatcatcgttgaagcattaaaacagaataatattgacactatttatggtgttgtaggtattcctgtgacggatatggcgcgccatgcccaggcggaaggcattcgttatattggttttcgtcatgagcagtcggcaggctatgccgctgcagcaagcggttttcttacccaaaaaccagggatctgcctgacagtgtctgcgccaggattcctcaacggtttgaccgcattggccaatgcaacggtaaatggttttccgatgatcatgattagcggctccagcgaccgcgcgatcgtcgatctccagcaaggtgattatgaagagctggaccaaatgaatgcggcaaaaccgtatgccaaagcagcatttcgcgttaatcagccgcaggatcttggcattgcattggcacgcgctatccgggtctcagtatcgggtcgtcctggcggtgtttatcttgatttgccagcaaatgtcctggccgcgacgatggaaaaagacgaagcgttaaccacgattgttaaagttgaaaatccgtcgccagcattattgccatgcccgaagtcagtcactagcgcaatttcgcttttagcaaaagctgaacgaccattaattatccttggcaaaggcgcggcgtattcacaatctgatgaacagcttcgtgaatttattgaaagtgcccagattccattcctgccaatgtctatggcgaaagggatcctcgaagatacgcatccactttctgcggcagctgcgcgttcgtttgccctggcaaatgctgacgttgtcatgcttgttggtgcacgactgaattggttactggcacacggtaaaaaaggatgggcggcagatacacagtttattcaactggatattgaaccgcaggaaattgacagcaaccgccccattgctgtgccagtcgttggcgatattgcatccagtatgcaaggtatgctggcagaattgaaacaaaacacatttacgactccactggtgtggcgcgatattttaaatatccacaagcagcaaaatgcacaaaaaatgcatgaaaagttaagtacagatacccaaccattaaattactttaatgcattgagtgccgtgcgcgatgttttgcgcgagaaccaggatatttatttagttaatgaaggggcaaataccctggataatgcacgaaatattattgatatgtataaaccacgtcgtcgtctggattgtggcacctggggtgtcatgggcatcggtatgggctatgccatcggtgctagcgtgacctctggttctccggttgtcgctattgaaggtgatagtgcttttggtttcagtgggatggagattgaaacgatttgtcgatataacctgccggtgacgatcgttatttttaataatggcggcatctacagaggagacggtgttgatctcagcggcgctggtgcaccatcgccaacggatctgttgcaccatgcaaggtatgacaaattaatggatgcgtttcgtggccttggctataacgtcaccacgacagatgaacttcgtcatgctttaaccaccggaattcagtcgcgcaaaccgaccattattaatgtggtcatcgacccagcagcaggaactgaaagtggccatattaccaaacttaacccaaaacaagtcgctggtaattaaatactgacatcgtctcctcttgccaacttattatgcgatggtgaggggacccttatcggaaatactattatgctaacattttttattggcgatttattgcctattatcgtaatcatgctgttgggttattttagcggcagacgagaaactttttcagaagatcaagctcgggcatttaataaactggtattaaactacgctcttcctgcggccctatttgtttctattacccgggcaaacagggaaatgatttttgcggacactcgcctgacccttgtatcacttgtggttattgtcggatgtttctttttctcctggtttggttgctacaaattttttaaacgtacccatgcagaagcagcagtatgtgcattaattgcaggctcacctaccatcggattcctggggtttgcagttctcgaccctatttatggtgattccgtatcaacaggtttagtggtagcaattatttctattattgttaacgcaattactattcctattggtctgtatttgctgaatccttcctcaggagcggatggtaagaagaatagtaatctgagcgcattaatttctgcggcaaaggagccagtagtatgggcacctgttctggcaacgatcctggtgctggttggggtaaaaattccggcagcatgggacccaacctttaatctgattgcgaaggctaactcaggggtagcggtattcgctgcggggttgactctggctgcacataaattcgagttcagtgccgaaattgcttataacactttcctgaagctgattctgatgccactggcgctgcttctcgtaggtatggcatgtcatttgaatagcgaacatttgcagatgatggtactggcaggcgcattaccgccggcattctccggaatcattattgccagccggtttaatgtctacacccgcactggtacagcgtcattggctgtgagcgtactgggttttgtcgtcacggctcctttgtggatttatgtcagtcgactggtttcataattaatcatgttattgattttacataaatgccgaagtgtcttttcaccttcggcttttttcaaggcataagcaaatgacaaataatgaatgcaaagggccgtttgaaggcttattagttatcgatatgacgcatgtccttaatgggcctttcggaactcaacttctttgtaatatgggtgcaagggtaattaaagttgagccgccgggtcatggtgatgatacccgcacatttggtccctatgtggatggacagtcactctattacagttttattaattatggcaaagagagtgtggttcttgatttaaagaatgatcacgataaaagtatatttataaatatgcttaaacaagcggatgtattagctgagaattttcgcccaggtacaatggaaaaactggggttttcatgggaaacgctacaagaaatcaacccgcgccttatatatgcttcatcgtcaggtttcggacataccggtccgctaaaagatgctcctgcctacgataccatcattcaggcaatgagcgggataatgatggaaacaggataccctgatgctccgccagtgcgcgttggtacctctcttgcggatctctgtggcggtgtttatttattcagtggaatagtgagtgcactttatggccgcgaaaagagccagagaggggcgcatgtcgatatagcgatgtttgatgccactctgagttttctggagcatggactgatggcatatatcgcgactgggaagtcaccacaacgcctgggaaatcgccatccctacatggcaccttttgatgttttcgatactcaggataagccgattacgatttgttgtggtaatgacaagcttttttctgtgttatgccaggcactggagcttacagaactggttaatgatccccgatttagcagcaatattttacgcgtacaaaaccaggctattcttaaacaatatattgagcggacgttaaaaacgcaggcagctgaagtttggttagccagaatacatgaagttggtgtgcccgtcgcgccgttattaagtgtggctgaggccattaatttaccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaatgtaagatgtgctggtaaatagctcccacatttgaacattgtgggagccgctatttagtcattttgctgacagaaaacagtaatctcctggtccagctctgcaatgtgttcttttacagagttcagcaactgaagaatttcaggcttactgtcatctgaaacaggtgttatttctaactggtggctaatattaatcaacttttgcaaattcaggatgttagccgcaccgtggatgcgatgaatacactgatggaaagttctgttatcgccagcttctagtgcatgaaacgcagcgggtagatctttatgcgtttcatgctggaaagtcatgagaatctcctgcatcagttgtagatcattcgccgtattattcttcagggcctcgatatcaaggtggcgatactgaggtgcaatatgcgcaacctggtgtaactgacttaaatgtgttttcagtacatccagagtcaacggtttgaacaaacataagttcatgccgcaatttaaccctttttcacgttcgttagcctgtgcgttggctgtaagcccccagatgggtaaggaagaattttgctcacggagtttgcgagtcaactcaaaaccatccatattcggcatattaacgtcagtaataagcagatcataatgttgcatactgactttgtgtagcgcttgcacaccatcagtggcttcatcaacatcatatcctaatagatttagctggcgtttgagtaatagcctgttggtcggatgatcatccgcgattaatatgctcaacttttcaggtagtgttataggttgttctgcttttgcctcgacagccgccacttgttgggtaatttctaccgggattgtgatcgtaaatatcgttcctatgcctggatgactttctaatgacaaatcgccctgcatgtttttaattaattctttgcagatcattaagcctaaaccagaacctgtttgctgacgacctgcacttgtttggctatagcgtttaaacagttgttgttgttcttcctgcgataatccacttccagaatccataatcgtcattttgataacagcgtggttgtcatcaatgtgacccagggaggtcgtaatttttactgccccctcggtagtaaatttgagagcattactcagtaaattagataagacctgcttaaacgcctgagggtcgatcttaaccaggtagcgttcaggaagcgtactgctgcaacttaatgcgatcgatttgcttgcagcaatcgcagcgaaagagtgacaagtgttctggactaaagtagggatatcgacccattgtggttgaagttgatagttacccgattcaattttgtcgacatcaaggatttcaccaattaagccgaggagtgattgtccggtggcgtaggcaagtgaaatcgcctccacccgttgttccttgctaagaccagaacccgacagaagttccaggaagcccataatggagcttattggtgttcttatttcgtgactcattgttgccagaaactggctttttgcgacagttgcattgatcgctttatttctctctacttcgagtgcatgaattaaatcacgcgtctcggtaatatcttgccaaccacaaatataaacagcatgttcgcttgctggcagattacataaggtatgccagtgattaatgcatcttttctcgatgccattatcaatttcaaatacctgtgtgtatattgttcggttttctttcgtttctgctgtgacttcatgcgtattagaaaaaacatctttaaagggggattcactgttttctaatggcaacattgcatttttgtagtaatcatcagtgaaataatgttcaaatgcactattatgactaatgacattaccttgccagtttacaacataagttggattcggtaaggagtccgagagtgctttccggaatgatatttggttttctaaatcaccctgaataactttacgacgacgaactgagcgtaacaggtagaatccccataaaaggctactgccaactaataaaacggataatgtcgtaacaatataaaactgctcgctatagaggtcccatgtgtcaatggtcacattgggcattttaatccatttttcggtcaggcgcagaacttcgcttgggggaattgcattcagtgctttattaataatatccttaagttccggttctccgcgaggaaaagcgaacgaaagtgatgcattctgaacgccgggaataagaaaatgataaagttcattaggatagtaatggtcgatcatgtaacgcgaatttaactgtgtcgcgaccagagcatcaagttcaccttccttgaccttgtgaaatgcagcgctggcgttatcgacttttatccactctacctccggatacatctcttttaattgcgaatgaagctcataataatatggaatggcaactttcattcctttttttaatgtttgttcactgtcaggcgctttttgcatgacaaaaacgtaaggcgttgttatgaagacttcagcaaatgaaacattattttctcgatcttcactataaatagcggcgggcaatatatcccatccaccggggttaagctgtgtcccagcatgaatattatgtgaaacggtgatcggagaaaaatttaaacctgtttgcaaggtaataatattaagaatatcacccatcacgccccgaactgagccagtttcatctgtcatagaatagggtggcgagtaaggattttccagcacctttaaatcgggatgctgcttaatccactgtttttcatgttcagtgagttctaatggtttgttcagaaaggccaggtttcctgtatcaagccaattttgtgatacttcatagcgaacttcatttgttaaagcatcaacaaatcgattgagtacttcattaagaacgattgaatcttttctggttaataaaaagttatattgacgcggtgagttataatacttcactacatttaaggagtgagtaaaataacgggaaatcatactgctggtaatgatgttactaccaataaagtaatcattctgtccggctgagacggatgctaatgcctgatataaatttgtaaaagagataattgttgcttttggaaatgattgatgaattacctcgtctgggggataatttgctactcgagcaatatttactggttttgatgaggtaagcggtcgcattgaatcgtgaagggtagtgaccagcgccggaaaggtaattatcagaggattagttgcagcaatgtcatcattaagaggcggcgaagcaactaaatgtgataacactatatcaacttcaccgtcttccagcgcgtccattgctttttgatgatctgcgtattcccggagtgttaatttgatatttaacgctctttttaaaagatttaaataatcagcattaataccacgaatccgttgctgcgaatcggtatgcaacaacgtagctgtttgggacttgtgtactgcaatcacaagattttttttgctcgcgagccaacgtaattccttgttgctcagacgtagtggatcaagtgtgacacggttgttactactgatgccacgatattcgatgtaatctccgtctgcgaagcttatggtcgaccaaagaccacaacagagaagaaaaatatagggtaaaaacttcatgtggttagccgattttgttacgttgtgcgaatgtgtaaagatccatcagtgatttgcattctaatttttccatcaagcgacttttataagtgctgacagttttgttgctgatgaacattttttcagcaatgtcattattatccttgccatcaagaatataccgcatgacactaatttcttgtttcgataaggagtcgagtttttgctggtcggacgttaaacttccaacaaaccggttgagagagaaggggaaatagcagtagccattttttgcagcttcaatagccgcaatgatattgttcatgccttcttttttactcacgaaaccattagcgccagcatcagcacaatgtttcccgtaaaaatggtcatttttagcggagacaataataataattccgctatattggcgctttctcagcgtttctaacacctggataccgttaactccggggatatcgacatcaatgatgacgatatcaggcttaagtgtttccacccgctgaacggcgcttccgccttcagtcaactctgctaagatttcaatatcgtttttgatcaataaattacgaattgctgcgatagcaagaggatggtcatcaataattattgcgttcatagattattccctttgcaatgaagcatttcccttctccttgtagtaatacagacataaggtatcatctcattttctcaataaaaataagaaaatttgagcttcctttaagataattcgacaagtataccatataaatagtcggcataaataaaatgtcaacaataaaatcagggatgataccgatgatttatagtttcaaatgagcactataagttttctcactaatcctacaggcgtaagaattgtattgcaaaagccgcggtttagtcctctgttgttttttttgcacctcatttaaattagccctccaacgttcctgggataatgtgcaaaacatgcactgtgtttgatatgaagaatgaatactcttttcattcaattcataaatttcatctatgcgaaatgagagataatagtggaacaggttaattcaaataaaaaacattctgacagaagaaagtattttgctttgttagcggtagttttatttattgcgttttcaggtgcctatgcctattggtcaatggaattaaaagacatgattagtacagatgacgcctatgtcacgggaaatgcagatccaatttctgcacaagtctcaggcagtgtcactgtcgttaatcataaagatacgaactacgttcgacaaggtgacattttagtttcactggataaaactgatgccactatcgcactcaataaagctaaaaataatctggcaaatattgttcggcaaacgaataaactatacttacaggataaacaatacagtgccgaagtcgcttcagcacgtattcagtatcaacaatctttagaagattataaccgtcgtgtgcctttagcgaagcaaggggttatttcaaaagaagcgctggagcataccaaagatacgttaataagtagcaaagcggcattgaatgctgctatccaggcttataaagcgaataaagctttagtaatgaacacaccattaaaccgtcagccacaagtcattgaagctgcagatgcaaccaaagaagcctggttggcgcttaaacgtacggatattaagagtccggttaccggttatattgcccaaagaagtgttcaggtcggcgaaacagtgagtcccggacaatcgttaatggctgtcgtaccggcgcgtcaaatgtgggttaatgccaactttaaagaaacacaactcacggatgtacggattggtcaatcggtcaatattatcagcgatctttatggtgaaaatgttgtgtttcatggtcgggtgacagggatcaatatgggaaccggcaatgcgttctccttattacctgcacaaaatgcgacagggaactggatcaaaatcgttcagcgtgtaccggttgaagtttctctggatccaaaagaactcatggaacaccctttgcgcattggtttatcgatgactgctactattgatacgaagaatgaagacattgccgagatgcccgatctggcttcaaccgtgacgtccatgcctgcttataccagtaaggctttagttatcgataccagtccgatagaaaaagaaattagcaacattatttcgcataatggacaactttaatggcaatcactaaatcaactcctgcaccattaaccggtgggacgttatggtgcgtcactattgcattgtcattagcgacgtttatgcaaatgttggattccactatttctaacgtcgcaataccgacaatatctggctttctgggagcatcaacagacgaaggcacctgggttatcacctcgtttggcgtagcaaatgccattgcgatccctgttaccggcaggctggcacaaagaataggcgaattaaggttatttttactttcagtaacctttttttcgctgtcttcattaatgtgtagtttatcgaccaatcttgatgtgctgatattttttagagtcgttcaggggttaatggcggggccgttaattccactgtcacagagtttattattaaggaattatccaccagaaaaaagaacatttgctctggcattatggtcaatgaccgtgattatcgctccgatatgtgggccgatattgggcggctatatttgcgataactttagctggggttggatatttttaatcaatgtccctatggggattatcgtcctgacattatgcttaaccttacttaaaggacgagaaactgagacttcaccggtcaaaatgaatctaccaggactgaccctgttagtgctcggtgttggtggcttgcaaattatgcttgataaagggcgcgatctggattggttcaactcgagtacaataatactactaacagtagtatcagttatttctctgatctctttagtcatttgggagtcgacctcagagaatccgattcttgacctcagtttgtttaagtcccgtaatttcaccattggtattgtgagtatcacatgcgcgtatttattttactctggagcgatagttcttatgccgcagttactccaggaaacgatggggtataatgcgatatgggccggacttgcctatgcgcccatcggtatcatgccgctattaatatcacctttgataggacgttatggcaacaaaattgatatgcggttgttggtgacatttagttttttgatgtatgcggtttgctattactggcgttctgtgacatttatgccaacgattgattttacaggcatcattttgccacagttttttcagggattcgccgttgcctgtttctttttacccttaacaacgatttcgttttcaggcttgccagataataaatttgccaatgcctcgagtatgagtaatttttttcgcaccttgtcaggatcagttggtacgtcgttgacaatgacactgtggggacgccgcgaatcgttacaccatagtcagttgacagcaaccatcgatcaatttaaccccgtgtttaattcatcgtcacaaattatggataaatactatggttcgctttcaggagttcttaatgaaattaataatgaaataactcagcagtcactttctatttctgcaaatgagattttccgtatggcggctattgcttttatcttacttacggttttggtttggtttgcgaaaccgccgtttacagcgaaaggcgttgggtgatggaaaaagaggaggctatagcaggtaaaacggcagaatcttaagtctgcgtcatcggcagcatcgctcacccagggaaaggatggcgatgctgcgttgaaacgttattaacggccttttgccagatattgattcatctcttcttccggcaccattccacctcccgtcgcccacaccagatgagtggcattacgcagttgttctgcgctgaaaccgtgcatctgttggtaacttactgatgcgcacacgcgctgaggcccggccatacccgccagtgccgatggttcaagacgaataccttcttcctgcgccaaccagctaagcatgtcatacatggtttgatcgctaagggtatagaagccatccagcagacgctccattgcccgcccgacaaagcccgatgcgcgaccaaccgcaaggccatcggcagcggtaaggttgtcgatgccaatatcctgaacagaaatctgatcgtgtaatccggtatggacgcctaataacatacacggggagtgcgttggttcggcaaaaaagcagtgaacatgatcgccaaacgccagtttaagtccgaatgcgacgccaccaggaccaccgccaacaccacacggcagatagacaaacagagggttatcagcattgacgatgcgaccttgctgagcaaattgtgccttaagacgctggcctgcgacggaatatccaaggaacaacgtgcgggaattctcgtcatcaataaagaaacagttcgggtcagactgcgctgctttacgtccttcctcgacagcaacaccataatcttgctcgtattccacgacagtaacgccatgactgcgcagtttcgcttttttccaggcgcgggcatcagcagacatatgcaccgttactttaaagccgatgcgggcgctcataataccaattgataaccccagatttccggttgatcccacagcaatactgtattggctaaagaactgtttaaactccggggaaagcagtttgctgtaatcatcctcaagtgtcagcaaacccgcttccagagccagtttttcagcatgggccaggacttcataaatcccgccacgtgcttttatggagccggaaatcggcaaatggctgtctttttttagtagcaattgcccggcgatcggctggtgatattccttttccagccgtttttgcatagcaggaatagcaaccagttctgattcaataatcccccccgcggcagccgtttcaggaaatgcttttgccagatacggcgcaaaacgagacaggcgcgcatgggcgtcctgaacatcctgttcggtcaggccaacataaggtaaaccttctgccaatgaggtcgtgccaggattaaaccaggtggtttctttaagagcaaccagatcctctaccaacggatactgggcgatgagcgaattcattttagcgttttccatagtacgtctctttgcgcttagatgataaatgacagcaggaatgtgcccgccagagcgatgactgaagcgataaatgtcgctgtcgtatagtatttaaatgtttcattgagcgtagcaccgcaatattgcttcaccagccagaaaagcgagtccgtaacgatcgtgcagccaatcgcacctgaaccgatggcaattgcaataatttccgggctgatgtcgggatacagcggcagcatgggtgcaacaattgccgttgcccccatcattgccaccgtagcggagcccactgcagcatgcagaataagtgccaccaaccaggccagaagaatcgggtgcatatgcatattggagagaataactgccagcgtatcagcgagactgctgctttttaaaatggcgttgaatgcgcctccggccccgataatcagcaaaatattagcaatagaaccgaaaccattttccgtatgtgtgagcatcgtccccatgctcatatgctgacgtatacccaacacataataggcgacaaatacggcgataaacatggcagtgatagggttgccaataaactcaagcaaggtatacaaaccactctcacgcgccatattcaattcggcaatcgttttaaccaacatcagcgcaatgggtagcagtatggtgaataacgttgcgcctaatgacggtagtgttttttcatcgcgaactttgagatcggcaaactctgtgggtacaggtttaaagggcagtcgttgccccagaaatttaaggaaaagtgggccaccgatcagtgatgccatcagcccaaccagcaaaccgtagacgatcaccgaaccgatatctgcgcccagcttattggcaacatataaagcagccggatgtgggggaaccacgcagtgcactgccatcaatgcggtacacagcggaatggccagctttaacaatgaggtattggtttttttggcaattgaaaaagccagaggaatcaatagcacgacgcccacttcaacaaacagcgtgatgccgcaaatcaggccaaccagcaccataatgacatcagctgaaagccaccggcagcgttgaagtgtcagaccaattctttctgcggccccggatacttccatcatttttcccagtatcgtgccaaggccgataaccgcagcgaggaaccccagcgttccgccaattccactttcaatagcatttaccatatccagtggccccatgcccatcatcgttcccacgaagaagctggccagcaacagcgccagaaacgggtggaatttgaacttcacgatggtcagtacaattaacacgatgctgataagcagcgtgctcacaacccagatttgagagtgcatatctcaccttcccctgtgattaacctgatgatattggacaaaaaaacaacgcaggctgacaaacgataaaatttgcctttcacgtgagctaaattgcatcaatggagtgatttacatctaaaaatgaaggtgaattgagatatggttcactttagctcacctagaagctgaaattttgccgctatttttttacacttaagagaaaaatgaggtgattatggaaccccttcgtgaaataagaaatcgactgcttaacggctggcaactatcaaaactgcatacttttgaagtggctgccaggcatcagtccttcgcccttgcggcagaggaattgtcgctgagccccagtgcggtaagtcaccgtatcaatcagctggaagaagaattaggtattcagttgtttgttcgttcccatcgcaaagtggaattaacgcacgaggggaaacgtgtttattgggcgctaaaatcgtcgctggataccctgaatcaggaaattctggatatcaaaaatcaggagttatcgggaacgttaacgttgtattcccggccctctatcgcccaatgctggttggtgcccgcattaggtgactttacacgccgatatccgtctatttcgctcaccgtgctcactggtaatgacaatgtcaatttgcaacgtgccggaatcgatttggcgatctactttgatgatgcgccgtcagcgcaattggctcatcactttctgatggatgaagaaatcctgccagtttgcagcccggagtacgctcatagacatgatttaaccaacacggtaattaacctgcgtcactgtacgttgctccatgacagacaggcatggagcaacgactccggtacggatgaatggcatagttgggcgcaacattatgcggttaatttgccgacatcttctggaattggctttgatcgctctgatttagccgttatcgccgcgatgaatcatattggggtggcgatgggaaggaaacgtctggtacaaaaaaggcttgccagtggtgagctcgtcgcgccgtttggcgatatgacggtgaaatgccatcagcattattacatcactacattaccgggcaggcagtggccaaaaattgaggcatttattacttggttaagagaacaggtaaaaaccacttcataatgaataagaccacgagttcctggtgtgccttattcggcattgctagtgcgaatttaataatttacggtttttacgtggttttagggataaacacaagaatggtgtccctgcagacatctacttgaggcggcaggggattgattggaatggtgttttttagatgtgagaaatattttacccgctattttacccattggcgcggcttaagagcttatttttgaattcacaatggtcacgatataaccatcttgctcgcccgtggataactttggcttttggcaggtcgccggacttaatccggtcatagatgaaggttttaccgaagccagtatcggccatgatgaatttcaaatcaaccagtgaatcaggttgtagttcgtgttgcatgagtgctatctccgaatagggaatcgaacctgcaaatcaggcaataaaaaaccgccatcaggcggcttggtgttctttcagttcttcaattcgaatattagttacgtctgcatgtgctatctgcgcccacagcatccagtggtcatagcagtcgttgatgttctctgcttcgataactctgttgaatggctctccattccattcacctgtgactcggaagtgcatttatcatctccataaaacaaaacccgccgtagcgagttcagataaaagaaatccccgcgagtgcgaggattatcattcattgtcgatattcacctttatagcgaacacctttaccggtttatcgccgaagtgcggatgtgtgattgtcttgatttcatatccgtcatacgggacgtcaattctgcggctggaatcgtcgcgcttcggatatccctttgtgataatcaggcggtcatactcgcggaacataattcgcttattccagtagtcattacacaggcgatactcttccgttttctctccgcgaatcatggcatcgaagtattcacctttaacggcaagttgcaggttagccacgaccttcctcctttggcttgtgaatttgtatcgtcatgccgctttgagtggtgactacaacgacagaaccaggctgaagactgttaagattgaatgcttcgtaaaacgaagccaaggccagcgcttttttattctttcggttccaccaacgccatccattgctacaggctacactgacaatccactgtccactcctgtaagccatataaaaccagatgagcaaaacctgaatgaatgctatccagtcaataatcgtatatttcgcgaaggagaccatcaattaacctcctgcggcggttccggtagaggcatccagtacaaggcgttccctaaccacgataaagtgccgtcgctcaactccacgtattccccttgtacctgtcctgccatatactcgccgtgctttgaataaattaaaatccaatcatcttgagcgggcattcgctcactacagcttatccaaccatccggagttaccggatagttgcccgacagctcgttcaacttgtaagtttggcttacaggttcggcttccagttctgcaatgcgcttctctgcagcttccagctcaacgcgcagcttccctaccgttagcgcaatttcctcgttctcctggtcgcggcgtttgatgtattgctggtttctttcccgttcatccagcagcgccagcacggtttctggtccggtcagaaatttgaaggcgttgagcgcatcaatatccacaccgtaatccttaagttcctgttcacttaacaaatcatcatcaactggcaacattaacaggcgttccattgccggaattgcacgttctgccgcctcacgcagtgcctgatagttaattttggtcatatcacatccccctgaagccgttgcatttacgtaaaaaatcgcagatatagcccttcattttttcgtgccaatctcgatcattcccattgcaccaaccatcaggtggagtccagttttctatcagagcagccattttctttgctttcgccggagtagctgttgcggtatcgcagtaatgacgagtgtcaaccaacgtatccataccatcgatatcaagtacgcaaaaccatgtgtgattcggcatttcaacagatggtatttgttgcccacgtcgacgtttatcaataagacatacagtcactggttgcctcctttgcgaagctgggcagcaaagtcaactaaccactcagtcatttcaaccttccctaccaggtctgaaccagggtgcatacagcaatcactctgcgccgctttgaaatccttatactcatattcttgggccaccagattttttgcagcttctatagcagcatccaccccctgcgcccgcacttcagccagaaaagcatcggtggctggggtttcagtaacatcatcttcccattcgctaaactcctcacgacaaaagtcattaaattccttctcagattgcttaagtgaggtattttcagcagccatcttcgcgcatttagcctcaaggttatcaatcgtgattccagcagaactacactcccgcaacgccgtttccagttttgattcaagttcaccgaacttacggacaaggtattcagcgtttgtttcgttaacctttaaatcacttgggatgcatttacctttcagaaaaccatccatctcaattagtgacatttgtttcatttcttcccactccgccacatcgcattcagatatttgttgtcattaacagaaccgaaactctttctcttaagcaagtcctctcatggtaaattcctcagtcattactgatagcgccatagcgtgagcggtaattacgcaggcgcgggtcgatatattcagggaagtgggtatatgtggctttgcggaatggtcggattgatgtctggtaaattcgctcgcgttcttctttctctgcaagccatatacagtggcgaaattccttttcctctttcgtttcctgcggtagagacattattcgatcgtagttttttctgaatttatccagcacctccgatacggaattgccggaacagcggcgcgggtcatccgcaccatacaaaggcgctggcataattaaatccttatttttctaaatcagaatgggatggaatcgtcgtattcaggattattttgatgattgctactttgctgctgttgtctgtttcctgaagttgcaaatccaatctttgcattcagtaattcaagagtgattgattgaccattttgcccctgataaacatcaaccctgatgttttctccggtaatttctacaatgcctccttcaaccagaacgctacgatagtaatccgcttgcgctcccggcttggcaaatacaacggcgctgtagtttgtccattctttcttttttgtctggcgatcgtaatactgaacgccagcacggatgttgaatccgatattttccccgccctgaaactctcttgcgggtttgtttagtcttactgtaatcgaatgtgccattaagcagttgccccttctaattcgtctcgtctgatgttgtaaacgtcctgcgctttgtgctgctccggcgtcccttcgagcatcttccacgctttggcgaacgcctgtttaagctcttctacggtgtttttctgcattgctgcgtcagtgaatgcttttagaacctgttcaggtgtaagtgatggttttgattgctttgctgctgcgttctgctgatgtttatgctcgtctgtatctgcatctttcgcatcatcaatgccgaacaaaccattgaggcaatacttgcgtgcataagagcttgtagctcccgtaacttgtgcagaatccattcctttcttgctttcttcctctcgtgcaagagcggttgccgtatgactgttttcgccatcggtaatagttgccgtggctttcacgtaataccgatcaccaatcaacacaacttcatcgctgattgataaaaacagaccgttcagtaacggcttaacgccttcaagaatatcttcgcagcttctgtatttatatttgccgaatgagttgtactgattctttggcgcgttcagattctcctgaatagctgccagtcttgcgtaaaattctttgctcatatgattgctctcagaatggacacggcccaaggaaataacgctgatttaatacttcgactcgggacaaattaaggcatacccgcattccttcgcggtcaccattatggcgataccagagagctttctgcgtgtacatgcgtctctgtaacttgctctccttcactgtggttgcaagtgacatgaatatctccttcgttaccgattaattctttaatctgacgaatgaattcttcgtctgaccagttatctgtaaaactcatttcctgcgataccacggaaggttgatagctgatttcatcgctttatttgcttcaagccacattttggaatcaccaataaatctggctattactgctttgttctgtgcagcacgaagcatctggtgattgatggctatttcattgcgcataataagacctcaactcttttccatccgtcacgtaatttacgggtgattcgttcaagtaaagattcatttagttggaaggcacccatgcgagcgcctcccgcgattgcgtaaatcatgggtggttccttatgttggttttattagtaggttatttttgttgcgaatacttcgccttttacgatggctgttatgatatttttagcaacatcttctgatgcgccaaccttgataaggtcagcaagtattttgttatttacttctttccggtgagctttatcctttgctctacgctcttcttcgtccttgattcttttttcttctgctattctggcttgctcttttgcttcagcctcgcgacggattcgttcagcctcctcctgtgcttttctgcgttctgcttcaattgctgcctgcttttctctttcagctcgttctgctgcctcttttgcttcgcgctgtgctcgttgctcggcttcaatgcgttcacgctctgcacgttccgctgcggccttagcttctgcttctcgccttgctgctgcttcaatttcggcttttgcctttgcttcggcttctgctctggctttctcttcagcttctctttttaatcgttcttcatgctctcgcttttcctgctccgctttgagtcttgcctcttctctttggcggtcaaattcgcgatccatcaaaatcgctatttcatggtcagactcaatttgctttgcgagagcttcagctgctgccttagcttcttcttcggctttaatccgcgcctgattcttcctcataatcagtaagaggctggcgcgccttggctttcagttcatcaaggcgatcgcgcactgtcttgcggttggcatcaattagctttggaatttccttcagttcagcaacaaggtctttgccaagaccatcgagatatgttttcgtctgcgcaactttatacgccagagaagcgatctcctttctgccctttgccgttgtgatatcaggcacaaatgacataacttcacgttcaaccttttggagaatttcttcaatctggtcggcagactgaaatacagtcattgcatttgctttttcaataacaactaaatctgttacttcactcatatatcctccatcaaaaaaaattgccctcacactggagggcaaagaagatttccaacaatcagaacaagtcggctcctgtttagttacgagcgacattgctccgtgtattcactcgttggaatgaatacacagtgcagtgtttattctgttgtttatgccaaaaataaaggccgactatgcggcctgaaattacttaaccaatgatgctgcatattcaattaggaataacttaggtgcaagccaaatcttcaaccattcgaaattgaaggcaataattaaaacgccaataattgagccaaatataggagcaaatacagtgcatatatcgtaataaaacgaagatataaaatatctatcgtttggacatccatctaaagacgtccatctctcgccattatttcttgccgttcttgcaaaactaggaagtttcattgctgcaattaaaagcaacaacccagccacttggaaaagtgcgctatggacaaaactccatgttagcaactgacgaacaacatcaggaatctgtgcctggctaaatgaaacagccgcgtctattccattactggctttttgcagaagttctacgagaatcttgtttgcttgttcttccatatatcaccttgattgtaataagcatgaaattatttacggacaaaaataaaggccaccatcaggcagccttgttattctgtttactaagttctctggcaatcattgccgtcgttcgtattgcccatttatcgacatatttcccatcttccattacaggaaacatttcttcaggcttaaccatgcattccgattgcagcttgcatccattgcatcgcttgaattgtccacaccattgattcttatcaatagtcgtagtcataaggatagtcctggtattgttccatcacatcctgcggatgctcttcgaactcttcaaattcttcttccatatatcacctcaaataagtggtttgcttcctaatttcattttctggcgaccaacacaagtcacccccatttcactgcgtggcttgcggtagtaaatacgattctgtttactctcgacttcttctgccttcttgcagcgaaggcttccgagtgatgctgctttgtctgctctgacgcaaccagagagctttagcgcaatctttcgcgccagtcgctgttcttgcattgcctgttcacgttgagcctgtctgcgtgctctgcggcgatttctggcgttatcgtcagccagatatgtaatgactactgtcatgttgacctccgatgaaacaactttggaatttttttattacaaagtggtttccttccccgccaattagacggggatggaagagcatttatgagcctttatggactctgctcgatcagttctatttaattaatctctcaattgaatgtaagtattcacataaatcctcctacctcttgtgcagctttcttgaatatggtggcggctgcataacgcctatggaattgactttggcggtgacgcgccgggtgcttatcttcccggttgccgtcgtgcagctgcacttcacgtcaccccaaagccaactactctttggttcccgcatttcggcgggacaatcccatcaatgttaaagagcctgccaatcttttccgtttggcttccagcgtcstgctgatggcttaaatttaagatctctttaattaatggtcaagagtatttttgaagaaaacttaaattttctttcgtaacttaagtttagctttgatttttaaaggaaataaaaaaaaaggggcgaatgcccccttatggaaggtttgctagttttgcatcgacaactacgccgatgattttgcagtttccgttgatctcgatcatcggatattgtgggttaagtggttttagaaacttcctgcctgcatcaataactaacttcttgaaagttgcctcgttttctccttcgagctttgcaactaccagtttcccgttacgcggctctacttcaggatcgacgagtattatcattccttcagggatactgagaccggccggagccgtcattgagtctcccttcacgtccaaccaaaacgaatcttctgaacagtctacggttgtatcgtaccagttatctattgcacgcttatgatatggttctacagcttccatccagcatcctgcgctcacccagctaatcagagggtatgaccctcttggatcatgcctactgtgataggcaatgtttgaaagactttcctctcctttcatcagatagtcaggggaacacttcaacgcattagccagggcgagaagattctctccatttggctctgtctcagagcgttcccactgagatatggcaacattagacacgccgaccatctttccaagtgcggcctgcctgatcttgagttcttttctccgagcgcgaatgcgctctcccatcaattgagttttcatagttaagacatcttaaataaacttgacttaagattcctttagtggataatttaagtgttctttaatttcggagcgagtctatgtacaagaaagatgttatcgaccacttcggaacccagcgtgctgtagctaaagcgttaggcattagcgacgcagcagtctctcagtggaaggaagtcatcccagagaaagacgcctatcgactggaagtcgttacagctggcgccctgaagtatcaagaaagcgcttaccgcaaagcggcataagcaaattgctctttaacagtcatggtcctcattcccgccgaaatgcgggaatacaacgcgcataagttgatgcgcataacttcttatttgttaaggaaatacttacatatggttcgtgcaaacaaacgcaacgaggctctaagaatcgagagtgcgttgcttaacaaaatcgcaatgcttggaactgagaagacagcggaagctgtgggcgttgataagtcgcagatcagcaggtggaagagggactggattccaaagttctcaatgctgcttgctgttcttgaatggggtgttgtcgacgacgacatggctcgattggcacgacaagttgcttcgattctcaccaataaaaaacgcccggcggcaaccgagcgttctgatcaaatacaaatagaattttaacaacatccaacgaggtaattatatgcgaaacaaaggctttaatccacctgatacacacaaagaagctaagcgtttgcgcttccttcgttccattgatgaaagaactcaaatctcttttgtgaaagttgccagaactgagcttctgaaggctgaggcgagggcgttgctcccgtctctaccaaaagaggagggatatacgttcattccaaacgcatttctggaaaagcttctcaaagaagacatatccgtaagtcagtttaacgatgttcttaaggtctttcgtcaaggcaggtagttatgagcaatacagcaaaaatctacgatttcagcgccgcacacgagcgcaggagcaacaggatggagaaccagaaaactggttacattccgttgtaccggagcattctgaaacagtcatgggcgaaagatgtttatcttcgcaccctgtgggaaaaccttctcctgaatgccgccagaaagccatacaaagcgaatttcaaaggtcatgaatggcatctgcaacccggtcaactggttgtgacagcagctgatttaggtcttcagttatgcgacagacatggcaagccagcaagccgtgatcaggttgagcggatgcttcaggtttttgtgaaagaggggatgatctccattgatggagagaagcaaaaaggccgtgtgataaccatcacaaattaccatgaatatgctcaaaaaatggacaatttacccgcacatgaagccgcacaaacaaccgcacatgatgccgcacatgatgaagccagcaatagcgcggctttcagcgtacatgccgcacatgaaagcgcacatgaagccgcacaaacaaccgcacatcatgaacaagaaggtattaacaagaatataaataatacccccctaccccccaatgggggaggcgatgggcaggttaaacctgaacgtcgcaaggcagaacgaatcgactacgaatccttcctgaacgcctacaacaccgaagtcggtgacagactgccacacgctgttgcggtcaacgagaaacgaaaacgccgcctgaagaaaatcatcccgcaactgaaaacgccaaacgtggacggtttcagagcgtatgtcagggcgtttgtgcatcaggccaagccgttttacttcggagacaacgacacgggctggacggctgattttgattacctgctgagagaagactcgttaacgggagttcgggaagggaagtttgcagacagggggattgcatgagacaggatatcgaagcgagcgttatcggtggcctgctgattggtggattaactccaaccgccagtgacgttcttgcaacgctggagccggaagcgttttcaattccgctctaccggaaagccttcgaggttattcgcaagcaggcgagaaacagaaacctaatcgacgcgctgatggttgccgaggcgtgcggagaggagcatttcaccgcaatcctgatgaccagcaaaaactgcccgagtgccgcaaacctgaagggatatgccggaatggtcgcggataactatcaccgccgtctggtgctggaaatcatggatgaaatgcgtgaaccaattcagagcggaaccatcgacgcatcgagtcaggcgatggatgagcttgtaaagcgtctttcagccatcagaaagccccgtgacgaggttaaacctgtacggttaggggaaatcattactgactacactgacacgcttgacaggcgtctgaggaacggagaagagtccgataccctgaagaccggaatcgaagaacttgatgccatcaccggagggatgaacgcagaagacctggtgataatcgctgctcgtcctggtatggggaaaaccgagctggcgctgaagattgccgaaggcgttgcaagccgcgttattcctggttctgacgtccggcgcggggtattgattttctcaatggaaatgagcgcattgcagattgcagagcgaagcattgccaacgccgggaggatgtcggttagcgtactgcgaaatcctgcatcgatggatgacgaaggctgggcgcgtgttgctaacggcatgagtcagcttgcagatttggatgtatgggtagtcgatgcctcgcggttatcggtcgaagaaatacgctcaatcgcagaacgacacaaacaggaaaatccaaacctgtcactcatcatggcggattatcttggcctgattgagaagccgaaagcagatcgcaacgacctcgcaattgcccacatctcaggaagccttaaggcgatggcgaaagacctgaaaacgcctgttatctccctaagtcagctttcacgcgatgttgagaagcgaccaaacaaacgcccgacaaacgcagatttgcgtgattcaggaagcattgaacaggacgcagactcaatcatcatgctctatcgggaagcggtatatgacgagaacagtagcgccgcgccatttgctgaaatcattgtgacgaaaaaccgttttggctcacttggtacggtttaccagcggttctgcaacggacactttgttgcatgtgaccaggatgaagccagacagatttgcacagcatcaaatgcgcctgctgcgcgtggcagacgatatgcacaaggggcggacgtatgaccatctacgtcactgagctaataacaggggctatttacacagtagcccttttttattggattaagaacgatggtgatcctgatggacaccgttaacggaatgtgttcagacgcaccgcgtgccaaaaaatgtaaatgcggaaaatcaccgacaatattcgacatggagaacgggtgccaaatctactgcgctaaccacgctgctgtggtggccgcgaattatcgcagtgcggtaacggagtggaataacctgaaatctgttagagagggaagtcatgaaaaaactaacctttgaaattcgatctccagcacatcagcaaaacgctattcacgcagtacagcaaatccttccagacccaaccaaaccaatcgtagtaaccattcaggaacgcaaccgcagcttagaccagaatcgaaagctttgggcttgccttggtgacgtctctcgtcaggttgaatggcatggtcgctggctggatgcagaaagctggaagtgtgtgtttaccgcagcattaaagcagcaggatgttgttcctaaccttgccgggaatggctttgtggtaataggccagtcaaccagcaggatgcgtgtaaacgaatttgcggagctattagagcttatacaggcattcggtacagagcgtggcgttaagtggtcagacgaagcgcgactggctctcgaatggaaagcgcgatggggagacagggcggcatgagacgacagcgacgaagtatcaccgacatcatctgcgaaaactgcaaataccttccaacgaaacgctccagaaataaacgcaagccaatcccaaaagaatctgacgtaaaaaccttcaactacacggctcacctgtgggatatccggtggctaagacatcgcgcgaggaaatgacaatggattattcacagttaagtgattttgaaattaacaagcgagtatttaaagcgatagtgggggcaataccattaggttatccgcacaacgcagatggacggtctgtcggcaatgaatcaaatggtaattatcgatggtacgactactgcaataatcctgaagacgcagagccgattatcgtagagaacagaattggcattattccagcgccagaaaatggattatggaaggcagcgcatagaaaagttggcagtgatagcaccccatatcatatgactcaagatgaaaaccaactccgcgccgccatgattgtctttctcatgatgcaggacgccaataatgcttagcccatcccaatcccttcaatgccagaaagaaagcgtcgagcgagctttaacgtgcgctaactgcggtcagaagctgcatgtgctggaagttcacatgtgtgagcactgctgcgcagaactgatgagcgatccgaatagctcaatgtacgaggaagaagacgatgaatgagttaatgaatggcaatgccatcaaaatgacaagcattgaaattgctgagttggttggtaagcgtcatgacaatgtgaaacgtaccatcgaaacgctggctaaaaatggtgttatccggcttcctcaaattgaggtttccgaaagaatcaataacttagggttcaatgttcagtacgagcattacgtcttcgagggcgaacaaggtaagcgagacagtattgtcgttgttgcccagttgtcgccagagttcaccgctcgccttgttgaccgctggcgagagcttgaagaagctgcggttaatatccccaaaacgctaccggaagcgttgcgccttgctgccgatcttgctgagcagaaaatgcaactggaaaaccagctcgcaattgtcgcacctaaagttgagtttgccgatcgcgttggcgaggccagcggaattttgattggaaactttgcaaaggttgttggtattggtcaaaacaaactgtttgcgtggatgcgtgatcacaaaatccttattgcttcaggttcccggcgcaatgtgccaatgcaggaatatatggatcgcggctatttcacagtgaaagaaacagcggtcaacacaaatcacggaatacagatatcgttcaccacaaaaatcaccgggcgtggtcaacagtggctgaccagaaagctgctcgataacggaatgctgaaagtaacaggggaggctgcttaatggctaacctacgcaaagaagcgcgcggaagagaatgtcaggtacgtatttacggcgtatgcaatggcaaccctgaaactacagttctggcacattaccggatggctggaatttgcggaacgggaatgaagcctgacgacctgatcggtgcatgggcttgtagtgcgtgtcacgatgaaatcgaccgacgcacccataatctcgacaacaaagacgccagactttaccacctcgaaggcgtgatcagaacgcaggcgatactgctgagggaggggaagattaagtcatgaacgaatatcagtttgtgcttccatacccgccgtcggtgaatacctactggcgaagacggggaagccaatattacataagcgataaaggccagaaataccgaaaagacgttcagcaaatcatccgccaactcaagttagacattttcaccaaatcacgactccgtatcaaagtcatcgcagacgttccagactcccgccgccgcgacctcgacaacatcctgaaaggtttactcgactcccttatccacgccggatttgcggaagacgacgagcaattcgatgacattcgcgtaattcgtggtgtgaaagtaccaggcggacggcttggaataaaaatcaccgaactggagaacgcatgaacgccacaattcaaacgataccagagcttcttatccagacacgaggcaatcagaccgaagtggcgaggatgctttcctgcgcaagaggaacagtgctcaagtacaaccgagacagcaaaggcgagcgtcacgtaatagttaacggcgtcctgatggtcaaacaaggcaagaggggaagacgatgagcataagagaactaaacctcaccaaagagcagcacgagtggctgaatggctggcttgaactgtggggcgcatgggtttattcaggtcgtctggaaaagcgcatgagcagcgtaatagcgaagttcatgkagagcgtagagccgggaagaattatgaccaagsccaatgtgtawtgatgatgatggaatgttgatttmtcaggtcgttgattccgtcatgtacattgacaagaaagcctttggcatcctcctcagctactacgctcatggttcatctaagcgagcaatttgcatcctactatcacgcgactgcaaagccacgcaagatgtgtggacgtggtggcgagggatggagaaaaccttcactggcaacctgtagaaacgaaattgacgacatcctgaaagcgtcattatttgttttataccagccaatgcaaaatgctttcaaaatgcgtaaacgtgttgagaaagttaagcatgttgctgttaaaaaccttgacatgcaattatccatttagccataattagaaggtaagctgccgttagtgactcttaagttgcaacggtggcttttttgtttgcacaacaggtaagagcattgaacccgcagacctcgcggaattggtgaaaggtgccgcgcagtactcttatcgttgtggtgaatacgcaggctgatgcgttaatcaggtgaacgagacacccgccggtccgtgatatggcacaccgtgccggtcatatctgccgcggttaggtttacgaggatttcgtaaagctggtctagggtgaagccgtgaaagcggaggaagtaaaacgaggcgtcggtacacgcctatcgtcattaagtcggagttcagcaccgaccgccacaacccaacctgagccgtagccactggctatcctgaattcatcagtgatagttatgctgcggccttctacacatgaccttcgtgaaagcgggtggcatgaggttgcgctaacaacctcatgccgttttgcccgtgcatatcggtcacgaacaaatctgattactaaacacagtagcctggatttgttctatcagtaatcgaccttattcctaattaaatagagcaaatccccttattgggggtaagacatgaagatgccagaaaaacatgacctgttagccgccattctcgcggcaaaggaacaaggcatcggggcaatccttgcgtttgcaatggcgtaccttcgcggcagatataatggcggtgcgtttacaaaaacagtaatcgacgcaacgatgtgcgccattatcgcctggttcattcgtgaccttctcgacttcgccggactaagtagcaatctcgcttatataacgagcgtgttcatcggctacatcggtactgactcgattggttcgcttatcaaacgcttcgctgctaaaaaagccggagtagaagatggtggaaatcaataatcaacgtaaggcgttcctcgatatgctggcgtggtcagagggaactgataacggacggcagaaaaccagaaatcatggttatgacgtcattgtaggcggagagctatttactgattactccgatcaccctcgcaagcttgtcacgctaaacccaaaactcaaatcaacag

SEQ ID NO: 10002 - DNA, 48960 bp, Escherichia coli
cctcagtttgcgattgaaggtctgctcaattacgcgatggcaatggataacccgacattgaacaaattgagtgaagaaacccggttacagatcatcccttaccttgtgagttttgcctttgctgattattccaggtctgcggcaagtaaggctcgctgtgagcattgtgctggtactggatttcatagtgtattgcgcgaagtggtgaaacactccagaagcggggaatctgttatcaaggaagagtgggtgaaggaattatgtcagcattgccatggtaagggagaagtcagcacggcttgcagagggtgtaagggtaaaggcattgtcctggatgaaaaaagaacccggcttcatggcgcgcctgtttataagatttgtgggcgttgcaatggaaaccggtttagtcgtttaccgaccacactggcacgacgtcatgtccagaagctggtaccagacctgactgattatcagtggtacaaaggatatgcagacgtcattgataaactggtaacaaagtgctggcaggaagaagcattcgctgaagcacaattgagaaaggtgacgagataagtgattttcaccgaagatggcgacatgatgcttgcatttctcaaaaaatatggataagattttcccaacgatgggctttgtatgtctaccgttgatgagtccaagaacccgccgccgagcgggttaaattattttttcttacacggggatatggatgttataccgagatcttttgcctattttctcagaaagacccatatttaaagctcctgaggctgaaagaatacttcgtgagcaatattctatcgccgcccccactcctgtaattcaggagatttattatggattggcaggttatgacagatttcaggagctttatggggatcttaatattgaccaaatcgaatggaaattgattgaacttcccactaaaaattttttaactatcggggataatgctacttaccctgattttttgcatgaggtcgttgaagatttcacaacccgtaaaggcgatgtatttatggatgatgaaataaaagcgcattggtgtaattttggcacatggtgtgaacctccattttttatagatcgagctttgctgaaaagtaatacaacagggcttcatttaatggaagggcatacaagagttggaaccctgttaggggcagttaagtataacttcgttaagcttgctaatactcataaaatttattatgcgcaagcaaaagaatgtattaaataagttgagtgaaattactgttttttttttaacaatacttaccgcgttctcgcggtttttttataaattaaacattggtgcagtacggtaaacacgctggtggtcgtgaatactgactttttatcttgctggctttttagacaagagttattggtatgtcatgttaaccatgaaggtaaaaagacatgctaaaacagcaagatatgacagaaacggcgaaagttgtttttaatgaattaaacggcaaaccggcaacagtcggggagatagcacaaaacacatacctttcacgcgaacgctgtcagttaatactgacccagctggttatggcggggctggcagattaccagttcggctgttacagacgccttcagcaatgaagggcttttaatttgtgaaaatgggcggctggtgggtgttggtagcacctgccagccattcgctcatgcttactggtcacaagcgaaccatggcccactgctttagcgcaaaagcagagtgagcctaccagagttacgcttactgatccatgaaaaacactgtaaaaataaacagtattgatttaatcaacgctgattgcctgcattttattcagtccctgcctgatgattccattgacctgattgttaccgatccgccttacttcaaggtgaaacccaacggttgggacaatcagtggaaaggggacgaagattaccttaagtggctggaccactgtctggcccagttctggcgggtgttgaaacctgccggaagcctttacctgttctgtgggcatcgcctggcatctgatattgagatcatgatgcgtgaacgtttcaacgtgcttaaccatatcatctgggcgaagccgtccggacgttggaatgggtgtaataaagaaagtctgcgcgcatattttcctgccacagagcgcgttctgtttgctgaacattaccgggggccatatcgcggcaaaagtgacggctatgtggcaaaagaaagggaactcaaacagcacataatggcaccgctgatatcgtatttcagggatgctcgtgccgaactgggtataacggcaaaacaaattgccgaagccacaggtaagaaaaatatggtttcccactggtttggtgccagtcagtggcagttgccgaatgaggctgactaccggaagttacaggcactgttttcccgtatagcggcagagaagtttcaggaacaacaactggaacaaccacaccaccagttggtggcatcttatgattcactgaatcgcaaatattctgaattgctggatgagtttaaatctctccggcgctatttctccgtatcagtctccgtgccttataccgatgtctggatgcataaacccgttcagttctacccgggtaaacatccgtgtgagaaaccggcggatatgctcaggcaaataatcaatgccagtagtcgacccggcgatctggttgctgatttctttatgggatccggttccacaataaaagcagcaatggcgctggggcgtcgggcgttaggtgttgagcttgagacagagcggtttaatcagaccatccaggaaatcagtatgttatcagcaaatacaattttgtgaattaattcaattattggtgggatgtctgtgccgtataatgattacagatacagtgtatcctgcaatgcagcagggctgatgtggtgggttgtacatagcctgcaaaggattggcttcattaattcatcgttgatacaagcgagtcacggttgaccacgccaacggctcatcggtaaaaatccgacaccgtgtcttcttaactcacttattgtttccacccatgtttttggatacctgctgtagctgtcagattagcgcgataatctgacagctttttttttacaacgaatccttctgatctgcttttgcggggcttttttgtatccgctccatgcccggcgtataagcggaggttggtcagttttctaaaaattgaaatacctcacaattcagccagttaatggttgtttgtctggcgaagagtttgtaaataaaaaaacgcatggtgaatccccctaagcggcggggcgaatcagcagtcagttctgggataatcgcgggttcgtatgctgatgccggactcaccgggaggcacccggcaccatgcatcatggtcatccccttgtatgatacccctctccggaggggtattttttggataaaaaagcccgcgctgggaggcacgggcggcaaggaataaaacgtgaagaaattttcacaggcgcataataatccgatgttgccagattttgcaactgcatcatctggttattatgtgagctggaaaatcagattctgtatggactgaagccatgctgttatttagggccaaagagctggctttttcccgccttctctccagtaacgattaatgagaaaagaatgaaatgcttttcctggggaggagggcagtagaaaaaagaacccgccagcaaaaatatgggggatgaacagcttttgctactcaggttgctggcgggtatggttcttcatgaaataagaatgttacgcggtatttttaatgaaaatgataattattgtcaattggttgtgcgtattttttcatacatgactggtaaaggtgattcaggccatcagagttttgctgatggccttttttctttccggtagcacaggtctgttggggcgggatatgtatcagatggaaaaaatatcaacaggcattgcctacggcacctccgcaggcagtgctggctactggtttttacaatggcttgatcaggttagtccgtctcagtgggctgcgattggtgtactgggaagtctggttctgggctttctgacttatctgacgaatctgtacttcaaaatcagagaagacagaagaaaggctgcgagaggagagtaatataatggtccaaaactatgaaatgattgtgaaagggatccgcaattttgagaataaagttacggtaactttagcattacaggacaaagaacgctttgacggtgaaatttttgacctggacatctcgctggaccgtgttgaaggtgccgcgctggagttttatgaggcagcagccagaaggagcatcagacaggtcttcctggatgttgctgccgggttatgtggaggggatgagcagtcgccggaaaagcgccccataattttagaggcgcagagtgtgtggataacctacaaaggaaaactgccgggaagaattactggttcactgaagactccgccgaaatggtaatttcaccagcatatttttcctccagtaataccgccagccacttgaaagaattttgttgttgctgggaccatttgggattgattgattcaagctggagcgatgccagtgttggttgcatttgttccttgggaattgagaatgccagatatgaaaatgcgacagcaagggcatttacatcatcccgaagcctggaaatgcagtcgagcaactcctgtagagaaatggtgctattgtccataaacaatcctctctattgtatttaactattccttgcctgattcaacaggccgggacagataaacatatccagggttcagaaaccgataaatcctgataaatatccatgaacgcaaaaatcagatacagcctgtcggctactgtactagtgctgattggtgcaggcgcgtctgctcctcaaatacttgaccagtttctggacgaaaaagaaggtaaccacacaacggcataccgtgatggttccggcatctggaccatctgtcggggtgccacgatggtggatggaaaacccgtttttcccggtatgaaactgtcgaaggaaaaatgcgaccaggttaacgccatcgaacgtgataaggcgctggcatgggtggaacgtaatattaaagtaccactgaccgaaccacaaaaagcgggtatcgcgtcattttgcccctataacattggccccggtaagtgtttcccgtcgacgttttataagcggcttaatgccggtgatcgtaaaggtgcctgtgagtcgattcgctggtggattaaggacggtgggcgtgattgccgcacacgttcaaataactgctacggacaggttattcgtcgtgaccaggaaagcgcattagcctgttgggggatagatcagtgagaagagtagccgcgattatctccgctctggttatctgcatcatcgtctgcctgtcttgggctgttaatcattaccgtgataacgccattacctacaaagccctgcgcgacaaaaatgccagagaactgaagctggcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatagagttgctcatatcgatgggcaactcatgcaattattttgagcaatacacccgcgcttccagcggagtataaatgccaaaagtgatgaaaccgagcaatccatttacgaatgtttgctgggtttctgttttaaccacattttctgcaccaccacaaatttttgctgcatcgacagttttcttctgcccaattcccgaaacgaagaaatgatgggtgatggtttcctttggtgttactgctgtcggtttgtttccaacagtaaacgtctgttgagcacatcctgtaataagcattgccagagcggcagaaaacaacatttttttcatcttattatcctgcattgttaaaaacggcagaatcctatgtgacaacaattaaacgatagttaaatggattgatgaaaattaaaactacacaggtgggctcagactattggaggaagttggggacactcagaatcctgtggaatgaaataaaccggtctatccgtccattacccttttagctgcgctgtatcgtcgccgtattcccgcattaaccatgaccgtagcccgacggggaattccttctgcgtgagtgtgcgggaataattaaaaacgatgcacaccgggtttttaccgcgttaatgattcgcgggtttatcccggtgcgatggtggaagaaacaggaagctgtattacagaaagtgctactactgtatcccgatgcgatgtatgtaatgtgagtcagataatggcacaggatgtggtgatgtggcagtctggaacacaggatatattgtcagaataagacccgtaggaataaaaatgaaaagacgccttttactactttttctgttatctgtcctggcagtgggatgctcgcagcaaaaagctgatgagccccggcaattagtgacggtgtatccacgatatccggaatatgctgcagcaaattatatcaaggggctggttgaggttaagttcgatattggtgctgatgggactgtgacacggatcgtttttctccgctcagagcctcataatttgtttcgtgatgaagtggtgaaggccatggcgaaatggcgatttgaaaagaatcgcccctgtcagggagtgaagcgacaatttatctttacgccgtcacgtccctgatgcttccaggtagagaggggctggaagcaggagaaaaatgaaagagccagcggttatatttttgtcatggctgacgaggaatgatggaagaaggcgttgtatgccacacaacgcctcactgttcatttcttctttttctctagtggaacccgatgaataagagttgcactggtttccgatgagatggcgatatactcgggcaaagtatgctggcagttttccaactggtcaaaaatacctgctctcgtctgttgcaatgcctgcagcatgcggcggcaatgcgccttgcttttgctaaccatctttccttcctctatcagtcgctgcgtgaactcatcatggaataccaggtaaatgcggatgttatcggttttggctacgcagcatagtacaaaacggacaggtgcatcccgggacgggggaggcgtcacatgtccctgtgatggttgttccgggtaatgcactgtgtggggcataaaaatgtccgataattttactttctaccgcagttagttgattcgttggtcctggtagcacattgggcgaggatttaaatgccaggcaactgaaggatgatgttgcaagggagatagcgagaatatttctgattttcatttgatgatgcctctgtgtgaaatgacggtaaacgacgcacttgtgccggcacataatagcaagcaccataatagatcagattcgattcttgctgtaagtgataattattctcgtttttcgggtcctttccggcgatccaacaggctacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaagttgaagaactgcggcaggccagcgagacagatctccagccagggactattgagtacgaacgccaccgacttacgcgtgcgcaggccgacgcacaggagctgaaaaatgccagagactccgctgaagtggtggaaaccgcattctgtactttcgtgctgtcgcggatcgcaggtgaaattgccagtattctcgacgggatccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgccagttactatctcccgaaagaatccgcataccaggaagggcgctgggaaacactgccctttcagcgggccatcatgaatgcgatgggcagcgactacatccgcgaggtgaatgtggtgaagtctgcccgtgttggttattccaaaatgctgttgggtgtttatgcctacttcatagagcataagcagcgcaacacacttatctggttgccgacggatggtgatgccgagaactttatgaaaacccacgttgagccgaccatccgtgatattccttcgctgctggcgctggccccgtggtatggcaaaaagcaccgggataacacgctcaccatgaagcgtttcaccaatgggcgtggcttctggtgcctgggcggtaaagcggcaaaaaactaccgtgaaaagtcagtggatgtggcgggttatgatgaacttgctgcctttgatgaggatattgaacaggaaggctctccgacgttcctgggcgataagcgtattgaaggctcggtctggccaaagtccatccgtggctccacgcccaaagtgagaggcacctgccagattgagcgtgcagccagtgaatccccgcattttatgcgttttcatgttgcctgcccgcactgcggggaggagcagtaccttaaatttggcgataaagagacgccgtttggcctcaaatggatgccggatgatccctccagcgtgttttatctctgtgagcataatgcctgcgtcatccgtcagcaggagctggactttactgatgcccgttatatctgcgaaaagaccgggatctggacccgtgatggcattctctggttttcgtcatccggtgaagagattgagccaccggacagtgtgacctttcacatctggacggcgtacagcccgttcaccacctgggttcagattgtcaaagactggatgaagacgaaaggggatacgggaaaacgtaaaactttcgtaaacaccacgctcggtgagacgtgggaggcgaaaatcggcgaacgtccggatgctgaagtgatggcagagcggaaagagcattattcagcgcccgttcctgaccgtgtggcttacctgaccgccggtatcgactcccagctggaccgctacgaaatgcgagtatggggatgggggccgggtgaggaaagctggctgattgaccggcagattattatgggccgccacgatgatgaacagacgctgctgcgtgtggatgaggccatcaataaaacctatacccgccggaatggtgcagaaatgtcggtatcccgtatctgctgggatactggcgggattgacccgaccattgtgtatgaacgctcgaaaaagcatgggctgttccgggtgatccccattaaaggggcatccgtctacggaaagccggtggccagcatgccacgtaagcgaaacaaaaacggggtttaccttaccgaaatcggtacggataccgcgaaagagcagatttataaccgcttcacactgacgccggaaggggatgaaccgcttcccggtgccgttcacttcccgaataacccggatatttttgatctgaccgaagcgcagcagctgactgctgaagagcaggtcgaaaaatggggggatggcaggaaaaaaatactgtgggacagcaaaaagcgacgcaatgaggcgctcgactgcttcgtttatgcgctggcggcgctgcgcatcagtatttcccgctggcagctggatctcagtgccctgctggtgagcctgcaggaagaggatagtgcaacaaccaacaagaaaacactggcagattacgcccgtgccttatccggagaggatgaatgacgcgacaggaagaacttgccgctgcccgtgcggcactgcatgacctgatgacaggaaaacgggtggcaacggtacagaaagacggacggcgagtggagtttacgaccacttccgtgtctgacctgaaaaaatacattgctgagctggaagtgcagaccggcatgacacagcgacgcaggggacctgcaggattttatgtatgaaaatgtccaccattcccacccttctggggccggacggcatgacatcgctgcgtgaatatgccggttatcacggcggtggcagcggatttggtgggcagttgcgggcgtggaacccatcgagtgaaagtgtggatgcagccctgctgcccaactttacccgtggcaatgcccgcgcagacgatctggtacgcaataacggctatgccgccaacgccatccagttgcatcaggatcatatcgtcgggtcttttttccgactcagtcatcgcccaagctggcgctatctgggcatcggggaggaagaagcccgtgccttttcccgcgaggttgaatcggcatggaaagagtttgccgaggatgactgctgctgcattgacgttgagcgaaaacgcacgtttaccatgatgattcgggaaggtgtggccatgcacgcctttaacggtgaactgttcgttcaggccacctgggataccagtccgtcgcggcttttccggacacagttccggatggtaagcccgaagcgcatcagcaacccgaacaataccggcgacagccggaactgccgtgccggtgtgcagattaatgacagcggtgcggcgctgggatattacgtcagcgaggacggctatcctggctggatgccgcagaaatggacatggataccccgtgagttacccggcgggcgcgcctcgttcattcacgtttttgaacccgtggaggacgggcagacccgcggtgcaaatgtgttttacagcgtgatggagcagatgaagatgctcgacacgctgcagaacacgcagctgcagagcgccattgtgaaggcgatgtatgccgccaccattgagagtgagctggatacgcagtcagcgatggattttattctgggcgcgaacagtcaggagcagcgggaaaggctgaccggctggattggtgaaattgccgcgtattacgccgcagcaccggtccggctgggaggcgcaaaagtgcctcacctgatgccgggggactcactgaacctgcagacggctcaggacacggataacggctactccgtgtttgagcagtcactgttgcggtatatcgctgccgggctgggtgtctcgtatgagcagctttcccggaattacgcccagatgagctactccacggcacgggccagtgcgaacgagtcgtgggcgtactttatggggcggcgaaaattcgtcgcatcccgtcaggcgagccagatgtttctgtgctggctggaagaggccatcgttcgccgcgtggtgacgttaccttcaaaagcgcgcttcagttttcaggaagcccgcagtgcctgggggaactgcgactggataggctccggtcgtatggccatcgatggtctgaaagaagttcaggaagcggtgatgctgatagaagccggactgagtacctacgagaaagagtgcgcaaaacgcggtgacgactatcaggaaatttttgcccagcaggtccgtgaaacgatggagcgccgtgcagccggtcttaaaccgcccgcctgggcggctgcggcatttgaatccgggctgcgacaatcaacagaggaggagaagagtgacagcagagctgcgtaatctcccgcatattgccagcatggcttttaatgagccgctgatgcttgaacccgcctatgcgcgggttttcttttgtgcgcttgcaggccagcttgggatcagccgcctgacagatgcggtgtccggtgacagcctgactgccccggaggcacccgcgacgctggcgttatccggtgatgatgacggaccacgacaggcccgcagttatcaggtcatgaacggcatcgccgtgctgccggtgtccggcacgctggtcagccggacgcgggcgctgcagccgtattcggggatgaccggttacaacggcattatcgcccgtctgcaacaggctgccagcgacccgatggtggacggcattctgctcgatatggatacgccaggcgggatggtggcaggggcatttgactgcgctgacatcatcgcccgtgtgcgtgacataaagccggtatgggcgctggccaatgacatgaactgcagtgcagggcagctgcttgccagcgccgcctcccggcgtctggtcacgcagaccgcccggacaggctccatcggcgtcatgatggctcacagtaattacggtgctgcgctggagaaacagggcgtggaaatcacgctgatttacagcggcagccataaggtggatggcaacccctacagccatcttccggatgacgtccgggagacactgcagtcccggatggatgcaacccgccggatgtttgcgcagaaggtgtcggcatataccggcctgtccgtgcaggctgtgctggataccgaggctgcagtgtacagcggtcaggaggccattgatgccggactggctgatgaacttgtcaacagcaccgatgcgatcaccgttatgcgtgatgcactggatgcacgtaaatcccgtctctcaggagggcgaatgaccaaagagactcaatcaacaactgtttcagccactgcttcgcaggctgacgttactgacgtggtgccagcgacggagggcgaaaacgccagcgcggcgcagccggacgtgaacgcgcagatcaccgctgcggttgcggcagaaaacagccgcattatggggatcctcaactgtgaggaggctcacggacgcgaagaacaggctcgcgtgctggccgaaacccccggtatgaccgtggaaacggcccgccgcattctggccgcagcaccacagagtgcacaggcgcgcagtgacactgcgctggatcgtctgatgcagggggcaccggcaccgctggctgcaggtaacccggcatctgatgccgttaacgatttgctgaacacaccagtgtaagggatgtttatgacgagcaaagaaacctttacccattaccagccgctgggcaacagtgacccggctcataccgcaaccgcgcctggcggattgagtgcgaaagcgcctgcaatgaccccgctgatgcttgacaccgccacccgtaagctggttgcgtgggatggcaccaccgacggtgctgccgttggcattcttgcggttgctgctgaccagaccagcaccacactgacgttctacaagtccggcacgttccgttatgaggatgtgctctggccggaggctgccagcgacgagacgaaaaaacggaccgcgtttgccggaacggcaatcagcatcgtttaacctgacccttcatcactaaaggccgcatgtgcggctttttttacgggatttttttatgtcgatgtacacaaccgcccagctgctggcggcaaatgagcagaaatttaagtttgatccgctgtttctgcgtctctttttccgtgagagctatcccttcaccacggagaaagtctatctctcacaaattccgggactggtaaacatggcgctgtacgtttcgccgattgtttccggtgaggttatccgttcccgtggcggctccacctctgaatttacgccgggatatgtcaagccgaagcatgaagtgaatccgcagatgaccctgcgtcgcctgccggatgaagatccgcagaatctggcggacccggcttaccgccgccgtcgcatcatcatgcagaacatgcgtgacgaagagctggccattgctcaggtcgaagagatgcaggccgtttctgccgtgcttaagggcaaatacaccatgaccggtgaagccttcgatccggttgaggtggatatgggccgcagtgcggcgaataacatcacgcagtccggcggcacggagtggagcaagcgtgacaagtccacgtatgacccgaccgacgatatcgaagcctacgcgctgaacgccagcggtgtggtgaatatcatcgtgtttgatccgaaaggctgggcgctgttccgttccttcaaagccgtcagggagaagctggatacccgtcgcggctctcattccgaactggagacagcggtaaaagacctgggtaaagcggtgtcctataaggggatgtatggcgatgtggccatcgtcgtgtattccggacagtacgtggaaaacggcgtcaaaaagaacttcctgccggacaacacgatggtgctgggtaacactcatgcacgcggtctgcgcacctatggctgcattcaggatgcggacgcacagcgcgaaggcattaacgcctctgcccgctacccgaaaaactgggtgaccaccggcgatccggcgcgtgagttcaccatgattcagtcagcaccgctgatgctgctggctgaccctgatgagttcgtgtccgtacaactggcgtaatcatggcccttcggggccattgtttctctgtggaggagtccatgacgaaagatgagctgattgcccgtctccgctcgctgggtgagcaactgaaccgtgatgtcagcctgacggggacgaaagaagaactggcactccgtgtggcagagctggaagaggagcttgatgacacggatgacgctgccggtcaggacacatctgtcaacccggaaaatgcgctgaccgggtatgaaaataacgtggtatcagcgcagccggataccgtgactgatacggctgctctggtcacggtcgtggcactggtgacgctgcatactgatgcacttcacgccacgcgggatgaacctgtggcatttgtgctgccgggaacggcgtttcgtgtctctgccggtgtggcagccgaaatgacagagcgcggcctggccagaatgcaataacgggaggcgctgtggctgatttcgataacctgttcgatgctgccattgcccgcgccgatgaaacgatacgcgggtacatgggaacgtcagccaccatgacatccggtgagcagtccggtgctgtgatacgtggtgtttttgatgaccctgaaaatatcagctatgccggacagggcgtgcgcgttgaaggctccagcccgtccctgtttgtccggactgatgaggtgcggcagctgcggcgtggagacacgctgaccatcggtgaggaaaatttctgggtagaccgggtttcgccggatgatggcggaagctgtcatctctggcttgggcgtggcgtgccgcctgccgttaaccgtcgccgctgaaagggggatgtatggccataaaaggtcttgagcaggccgttgaaaacctcagccgtatcagcaaaacggcggtgcccggtgccgccgcaatggccattaaccgcgttgcttcatccgcgatatcgcagtctgcgtcacaggttgctcgtgagacaaaggtacgccggaaactggtaaaggaaagggccaggctgaaaagggccacggtcaaaaatccgcaggccagaatcaaagttaaccggggggatttgcccgtaatcaagctgggtaatgcgcgggttgtcctgtcccgccgcaggcgtcgtaaaaaggggcagcgttcatccctgaaaggtggcggcagcgtgcttgtggtgggtaaccgtcgtattcccggcgcgtttattcagcaactgaaaaacggccggtggcatgttatgcagcgtgtggccgggaaaaaccgttaccccattgatgtggtgaaaatcccgatggcggtgccgctgaccacggcgtttaaacagaatattgaacggatacggcgtgaacgtcttccgaaagagctgggctatgcgctgcagcatcaactgagaatggtaataaagcgatgaaacatactgaactccgtgcagccgtactggatgcactggagaagcatgacaccggggcgacgctttttgatggtcgccccgctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagcggctatgactaccggcgcgacgatgatgcgggcctgtggagttcagccgatctgacttatgtcattacctatgaaatgtgaggacgctatgcctgtaccaaatcctgtaatgccggtgaaaggtgccgggaccaccctgtgggtttataaggggagcggtgacccttatgcgaacccgctttcagacgttgactggtcgcgtctggcaaaagttaaagacctgacgcccggcgaactgaccgctgagtcctatgacgacagctatctcgatgatgaagatgcagactggactgcgaccgggcaggggcagaaatctgccggagataccagcttcacgctggcgtggatgcccggagagcaggggcagcaggcgctgctggcgtggtttaatgaaggtgatacccgtgcctataaaatccgcttcccgaacggcacggtcgatgtgttccgtggctgggtcagcagtatcggtaaggcggtgacggcgaaggaagcgattacccgcacggtgaaggtcaccaatgtgggacgtccgtcgatggcagaagatcgcagcacggtgacggcgacgaccggcatgacggtgacacccgccagtgcttccgtagtgaaagggcagagcaccacgctgaccgtggcattccagccggatggcgcaaccgacaagagcttccgtgcggtgtctgcggataaaacaaaagccaccgtgtcggtcagtggtatgaccatcaccgtgaaaggtgttgctgcaggcaaggtcaacattccggtcgtatccggtaatggtgagtttgctgcggttgcagaaatcaacgtcaccgccagttaatccggagagtcagcgatgttcctgaaaaccgaatcatttgaacataacggygtgaccgtcacgctttctgaactgtcagccctgcagcgtattgagcatctcgmcctgatgaaacrgcaggcagaacaggcggagtcagacagcaaccggmagkttactgtggaagacgccatcagaaccggygcktttstggtggcgatgtccctgtggcataaccatccgmagaagacaaagcwgccttccatgaatgaagccgttaaacagattgagcaggaagtgcttaccacctggcccrcggaggcaattkctcatgctgaaaacgtggtgtaccggctgtccggtatgtatgrgtttgtggtgaatgatgcycctgamcaggcagaggackccgggcctgcagagcctgtttctgcgggaaagtgttcgacggtgagctgagttttgccctgaaactggcgcgagagatggggcgacctgactggcgcgccatgcttgccgggatgtcatccacggagtatgccgactggcaccgcttttacagtacccattattttcatgatgttctgctggatatgcacttttccgggctgacgtacacygtgctcagcctgtttttcagcgatccggatatgcatccgctggatttcagtytgctgaaccggcgygaggmtgacgaagagcctgaagatgatgtgctgatgcagaaagcggcagggcttrccggaggygtccgctttgrcccggacggraatgaagttatccccgcttccccggatrtggcggrcatgacggaggatgacgtaatgctgatgacagtatcagaagggatcgcaggaggagtccggtatggctgaaccggtaggcgatctggtcgttgatttaagtctggatacggccagatttgacgagcagatggccagagtcaggcgtcatttttccggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagtccgtggctgatcctgctgcaacagggtggtcaggttaaggactccttcggcgggatgatccccatgttcagggggcttgccggtgcgatcaccctgccgatggtgggggccacctcgctggcggtggcgaccggtgcgctggcgtatgcctggtatcagggcaactcaaccctgtccgatttcaacaaaacgctggtcctttccggcaatcagtcgggactgacggcagatcgtattctggccctgtccagagccgggcaggcggcagggctgacgtttaaccagaccagcgagtcactgacggcgctggtgaatgccggtgtgcgtggtggtgagcagtttgaggcgatcagccagagtgtggcgcgtttctcctctgcatccggcgtggaggtggacaaggtcgctgaagccttcgggaagctgaccacagacccgacgtcgggactgacagcgatggcacgtcagttccataacgtgacggcggagcagattgcgtatgttgctcagttgcagcgttccggagatgaagccggggcattgcaggcggcgaacgaggccgcaacgaaagggtttgatgaccagacccgccgcctgaaagagaacatgggcacgctggagacctgggcagacaggacagcacgggcattcaaatccatgtgggattcggtgctggatattggtcgcccggacactgcccagggaatgctggagaaagcagaaaaggcttttgatgaggcggacaaaaaatggcagtggtatcagagccggagccaccggcgcggtaaaacctcagcatttcttgccaatctccggggagcatgggaggacagagcgaatgcgcaacttggactttcagccgccacgttgcaggccgatcttgaaaaggccagagagatggcagcaaaggactgggccgagtctgaggcatcacggctgaaatataccgaagaggcgcagaaggcttacgaacgcctgcagacgccgctggagaaatataccgcccgtcaggaagaactgaataaggcactgaaagacgggaaaatcctgcaggcagattacaacacgctgatggcggcggcgaaaaaggattatgaagcgacgctgaaaaagctgaagcagtccggtgtgaaggtgtctgcgggcgatcgtcaggaagacagtgctcatgctgccctgctgacgcttcaggcagaactccggacgctggagaagcatgccggagcgaatgagaaaatcagccagcagcgccgggatttgtggaaggcagaaagtcagttcgcggtacttggaggaggcggcgcaacgtcgccagctgtctgcacaggagaaatccctgctggcgcataaagatgagacgctggagtacaaacgccagctggctgtacttggcgacaaggttacgtatcaggagcacctgaacgcgctggcgcagcaggcggataaattcgcacagcagcaacgggcaaaacgggccgctattgatgcgaaaaaccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggagctggatggcaggcctcaggtccggctggagcgagtgggaagagagcgccacggacagtatgtcgcaggttaaaagtgctgccacgcagacctttgatggtattgcgcagaatatggcggcgatgctgaccggcagtgaacagaactggcgcagcttcacccgttccgtgctgtccatgatgacagaaattctgcttaagcaggcaatggtggggattgtcgggagtatcggcagcgccattggcggggctgttggtggcggcgcatccgcgtcaggcggtacagccattcaggcagctgcggcgaaattccattttgcgaccgggggatttacgggaaccggcggcaaatatgagccagcggggattgttcaccgtggtgaatttgtcttcacgaaggaggcaaccagccggattggtgtcggcaacctgtaccgcctgatgcggggctatgcggaaggtggttatgtgggcggtgccggaagtccggcgcagatgcggcgggctgaaggcattaattttaatcagaacaatcacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcaggtcagtatgttgcgtgttgggttcagcgcagagtttaaacaggtggtgaactgatgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtgcggttatcacggtccggcagtcgcggatgaatatgaccagccgacgtccgatatcacgaaggataaatgcagcaaatgcctgagcggctgtaagtttcgcaataacgtcggcaactttggcggcttcctttccattaacaaactttcgcagtaatcccatgacagagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctggcggggattgagatgccggattttcatcgcggggatgactggtggcgtaacggtcagaatctctatcttgacaatatggaggcgactggtttttaccgtgtcgcactgacagaggcgcagccgggcgatgtgctgctgtgctgttttggttcatcggtgccgaatcacgccgccatttactgtggcgacggtgagctgctgcaccatattcctgaacaactgagtaaacgagagaggtataccgacaaatggcagcgacgcacacactccctctggcgtcaccgggcatggcacgcatctgcctttacggggatttacaacgatttggccgccgcatcgaccttcgtgtgaaaacgggggctgaagccatccgggcgctggccacgcagcttccgtcgtttcgccagaaactgaatgagggctggtatcaggtgcgcattgccgggcgtgatgcaggcgaaaatgaattatctgcccgtcttaatgaaccgctggcaaatggtgccgtgattcacatcgtgccgcgtctggcgggagctaaaagtggcggtgtgtttcaggtggtgctgggggcggcgctgattgcggtggcatggtggaaccctgtgggctggctgggtgctgcggctgtatcgggcatgtatgcggcaggggccagtatgattctgggtggtgtggcccagatgctggcaccgaaagccaggacgcccacggcagccagtacagataacggcaaacagaacacctatttctcctcactggataacatggttgctcagggcaatgttctgcctgttctgtacggtgaaatgcgcgtggggtcgcgcgtggtttctcaggagatcagcacggcagacgaaggtgacggtggtcaggttgtggtgattggtcgctgatgcaaaatgttttatgtgaaaccgcctgcgggcggttttgtcgtttatggagcatgacgaatgggtaaaggcagcagtaaggggcataccccgcgcgaagcgaaggacaacctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggagggatttgaatcctccggctccgagacggtgctgggtacggaagtgaaatatgacacgccgatcacccgcaccattacgtcggcaaacatcgaccgtctgcgctttaccttcggtgtgcaggcactggtggaaaccacctcaaagggtgaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggagacgcagaccgtggayttcagcgtgggtgctgaagggcttcgccatgtaccgggcgatgtcattgaaatctgygatgatgactatgcsggkakcagcaccggyggkcgygtgctggcggtgaacagccagacccggacgctgacgctcgaccgtgaaatcacgctgccatcctccggtaccacgctgataagyctggttgacggtmagtggyaatccggtcagcgtggaggtycagtccgtcaccgacggcgtgaaggtgaaagtgagccgtgttcctgacggcgttgcmgratacagcgtgtgggggctgaagctgccgacgctgcgccagcgcctgttccgctgcgtgagtatccgtgagaacgaygacggcacgtatgccatcacygccgtgcagcatgtrccggaraaagargccatcgtggataacggggcgcactttgacggygaccagagcggcacggtgaatggtgtcacgccgccagcagtgcagcayctgaccgccgaagtcactgcagacagcggggaatatcaggtgctggcgcgatgggacacaccgaaggtggtgaagggcgtgagcttcctgctccgtctgaccgtracagcggaygacggcagtgagcgrctgrtcagcacrgccmggacgacggaaaccacataccgcttcacrcaactggcgytggggaactacaggctgacagtccgggcggtaaatgcmyggggrcagcagggcgatccggcrtcggtatcgttccggattgccgcaccggcagcrccgtckmggattgagctgacrccgggctattttcagataaccgccacgccgcatcttgcggtttatgatccgacggtacagtttgagttctggttctcggaaaagcggattgcggatatcaggcaggttgaaaccacagcccgctatcttggtacggcgctgtactggatagccgccagtatcaatatcaaaccgggccatgattattacttttatatccgcagtgtgaacaccgtaggcaaatcggcatttgtggaggccgtcggtcgggcgagcgatgatgcatccggctatctggattttttcaaaggcgagatagggaaaacccatctggctcaggagctgtggacgcagattgataacggtcagcttgcgcctgacctggctgaaatcaggacgtccattacggatgtcagcaatgaaatcacgcagaccgtcaataagaaactggaagaccagagtgcggcaattcagcagatacagaaggttcaggttgatacaaataataacctgaacagcatgtgggctgtgaagctgcagcagatgcaggacggacgcctttatatcgcgggtattggtgccggtattgagaacacccctgacggcatgcagagtcaggtgctgctggcggcggacaggattgcgatggttaatcctgcgaatggcaacacaaaaccgatgtttgttggtcagggcgatcagatattcatgaacgacgtgttcctgaaacgcctgacggctcccaccattaccagcggtggaaatccaccggcattttccctgacaccggacgggcgactgacggcgaaaaatgcggatatcagtggcagtgtgaatgcgaacgccgggacgctcaacaatgtcacgattaatgaaaactgtcgggttctgggaaaactgtctgcgaaccagattgaaggcgatctcgttaaaacagtgggcaaagctttcccccgggactcccgtgcaccggagcggtggccatcagggaccattaccgtcagggtttatgacgatcagccgtttgaccggcagattgttattcccgcggtggcgtttcgtggcgctaaacatgagcgggagaataacgatatttattcgtcatgccgcctgatagtgaagaaaaacggtgctgaaatttataaccgtaccgcgctggataatacgctggtttatacaggtgttattgatatgcctgctggtcgcggtcacatgacgctggagttttcggtatcagcgtggctggtaaatgactggtatcccacagccagtatcagtgatttgctggttgtggtgatgaagaaatccacagcaggtatcacgattagctgaattttcataacccatatgcgggcgccatttctggcgccttttttattgcagaaaagcgagaggtaattatgcgtaaagtttgtgcagccattttgtccgcagccatctgtctggccgtatccggtgcgcctgcatgggcgtctgagcagcaggccacactgagcgcagggtatcttcatgcccgtacgaacgctcccggcagcgataatctgaacgggattaacgtgaaataccgttatgagtttacggacacgctggggctgattacgtcattcagttatgccaacgctgaagatgagcaaaaaacgcattacagcgatacccgctggcatgaggattccgtgcgtaaccgctggttcagcgtgatggcggggccgtctgtacgcgtgaatgaatggttcagcgcgtatgcgatggcaggcgtggcttacagccgtgtgtcgactttttccggggattatctccgcgtaactgacaacaagggaaaaacgcacgacgtgctgaccggaagtgatgacgctcgccacagtaacacctctctggcgtggggagctggcgtgcagtttaacccgaccgaatccgtggccgttgatgtcgcttatgaaggctccggcagtggcaactggcgcactgacgggttcatcgtgggtgtcggttataagttctgattagccaggtaacacagtgttatgacagcccgccggttcaggcgggcttttttgtggggtgaatatggcagtaaagatttcaggtgtactgaaagacggtgcaggtaaaccggtacagaactgcacaatccagctgaaagcaaaacgtaacagcaccacggtggtggtgaacacggtggcctcagaaaatccggatgaagccgggcgttacagcatggatgttgagtatggccagtacagcgtcaccctgctggttgaaggttttccaccttcacatgccgggaccattaccgtctatgaaggttccagaccaggtacgctgaatgattttctcggtgccatgacggaggatgatgcccgtccggaggcactgcgccgttttgagctgatggtgaatgaagtggcacgtcatgccggagcgtcatcacagagtgcagcggcggcaaagaaatccgaaacggcagcagcctcatcgaagaatgcggcgaaaacctcagaaacgaatgcagctaacagcgcacaggcggcagcggcctcgcagactgcatcggcaaactccgcgacagcagccaaaaaatcagaaaccagcgcgaaaaatagcgagacagccacaaaggccagcgaaaaaaacgcaaaatccagccagacggcagcgaaaaccagtgagacgaatgccaaagacagtgaagccaacgcaaaggtgagcgaaacagcggcggcgaactcggcgaaagcatcggcagcaagccagacggcagcaaaagcaagtgaagatgctgccagagaatacgcaaaccagacagcagagccgtacagatatgttttacagccgctgccggatgtgtggataccctttaatgattcgctggatatgattacgggctattctccgggttataaaaaagtgaagattggtgataatgtggttcaggttgccagtgataaacaggttaatttcagtcgcgcatcaacggcaacatatatcaacaaatctggcgaactgaaaacggcggaaattaatgagccacgatttgaaaaagaaggtttattgattgaaggtcagcgaaccaactacatgttgaattcaacaactccagcttcttggggtaaatctgcaaatatgaatgtcgctgaggttggaactgatagttttggttttacttatggaaagtttgtttgtaatgaatcattaattgggcaaagtacaacccttaatatggcagtagtttcaacctcgggggctgtcgatgtatcaggcgataataagtgtgtgacgacatcgtgcagatttaaaacggatttggaactcctgttaaggatcaggtttgaagccttcgatggcagcgcttcatctaatcttggatatgccattgttaatacgcggtctttattggttgaaatcaccggtgtagctgccgacaggctcaccgcacgagttaacaaagatgaagctacgggctggatttttgtagaggcaacgattcaagcaagtaaagaaacttacataacctctgcaatacaatacgcaccaaaaaaaggtggtgtcgttgaatctggtgactatatttatctggccacccctcaggttgaggatggttcgtgtgtatcatcttttattatatcaggaacgacggcggcgacgcgcgcaagcgatatggttacagttccgattaagaataatctttataatcttccttttacggttctttgtgaggtacataagaactggtataaaacgccaaatgcagcgccacgtgtttttgataccggcggtcatcaaaccggagcggctattattcttggcttcggatcttcggcagatgggccagacggatttccttattgcgatattggtggatcaaataggcgtgttaacgaaaacgcatcgttgaaaaaaatggttatggggatgcgtgtaaagtcagatcagtctacatgtgcagtaagtaacgggcgtatatccagcgaaacaaaaaccacatgggaatatatccggagtacagcaaccattcgcattggtggacaaactacagcaggattacgccatttatttgggcatgtgaggaattttcgtctctggcataaagagctaacagatgcgcagcttggggaggttgtggcgtgagagatttcacgttgcgtttcagtgataaagcagatttcagggcatttctcaggaaacttaactgggaagaggacgaagagctgcagaatgccgttctggttgatgagattggttttacgttcagggagacagatgtttctgatgacggagaaccagaatacacgcgaaacgaagggtactttgttaatatccgtcttcttgacgatggatttgatgattccgtgttccgtgagtgggtggttacaccagagcgcccgctcagggagtggttttaaggatagcagatggatatcacgtcgatacttcatgcgctttgtgccgtggcggtgcaggtactggctggtctttttaccggaaactgggcttacggggcgatagccggttgtacgttcttcattgcgcgtgaacacacccaggcagaatatcgctggattgaaatgttcgggcatggcaagcggattaacatgccgtggtggggcggttttgatccacgtgcatgggatgtggcaagcctgatggattttgctgtgccggtggtggcgtgtctgctggtctggctgttggttaatcgtgggtgaaaaaggtgagcagtatatgcaacgaaggaggaaacatcattgctggcggcatggaaggcatgcagggtgttgctgaaccgtgttgatacatcaactgcacctgatattgagtggcctacgaaccctgtcagggagtaatcattgggattatgccgcagcacgtcttaagcaagaacgtgctgcggttggatgctattttttccctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaacgccgtcaccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggatcaaaaacatcatggctaattttatgtttaatttttgattccccagcccttgtcgatgccgcgttcaggctagcttcgttcaaatccattaaagatatcagactactctcaggtacgtgagtaaggtaaaacccagttccaacgccaatatccagatggttgttacctaaatgttccagaaagtgtggaagaaggtgttcctttgtaggacatccccatgcaagccgatttgatactcccaaaacccaccagtcataaagctttagggtaagtggtgtgtaaattttagccccatcatctgtgttttttttcattagtttcaccgtattatagttttatttgtgaattaaatcaattatggcgatgaattacaaggggttaaatgctgccgcagcatagcgatattgaaatagcctggtatgcttcgatacagcaggagccgaatggctggaagaccgtcactacacagttctacatccaggaattcagtgagtatattgcgccactgcaggatgctgtagatctggaaatcgcaacggaggaagaaagatcgttgctggaggcatggaataaatatcgggtattgttgaatcgtgttgatacatcagtagctctgggtatgaagctgtttgtaactcatgttacagtaacagccattactatctcgaaggtgcaaaatgtatattgatttgatattttataaatttacttcgaatctggcacgtcaacttttgattaaagtaatatcagttttcggcgaaaaaaggaccgtgtacatgagacgatttcatacaagaataacaaaaatatgaatatgctcccaatgcaatatatgttttgcattgggagcaaatagcggaatattttgaaattattgtatttctgcttcagaatttcctgggcagtatatattttctggtttttgtggagtgatcaggtgatgtacaactgctttatctacacataaattaactccggtgagagctaatgtatgcccatcaccatttattgttagtaacgggctggaaaatttctctgccatcttacgggcattaatccagggcgttgttgggtcgtatttgtgtgctacaaacagtaaaccagagggcagaacagtatttttcaggcgagttttgttcaggtcgctatgtattggccataattcacaaaaatcaggtgaatcggaacgtccattgtcaaagttaatagccgggaaggcattcgcaagagcgtcttttcgggattttcgctcttctggtgttaattgctcatccccctgatctacacagaggattacccccgaagcattgcttgactcttctgaggctatcggagcactgagcgcagtttcaatttcattactgacaatcccctgagagaactggcgtatggcagttgcaagggttggccatgatgaacgccatagcagaaggtctgttgttaatgatatgagttcatctgaagatatattttctcccttactgtctaataaaggtttgtgatgtaattttgataatagctcatggaactgagttattgccttatctctgtctgaagaaagcgggcaactttttgtacgcgcacaccaggatgcaaagcgatcaaacgtttcctgataactctgtgcctgtttgagttgccatgtgaagttgtcctccaggtcatcgatatcgacgactccatcaagaacgatagatcttacgttgtagggaaaacgttctgcatataaggctgcaatttgagttccatacgaatacgccacggctgtcagttgtttatcccccaaggcttgcctaatacgatcaatatcgtatacagcctcgttagagccgatatggcgaatgacttcggctccggtattatggatacaggcattaattttatttaatacttgttgcttttcggttatgttttcctgagtctctgtatctgattgccggcagtttattgtcggagtggactgtccgacgcctcgaggatcaaatccaataatatcccatgactcacgaagatttgtgactggccagtcaaagttaatataaggatttatgcctggtaacccgggaccaccacttattatcaggatacttcctttatgcttgctttttgccggcaattttgtcaacgctagtttgacttgtgattttttttcataagaagcatctccgcctgtgtctgtatattttaatggaacagacaaataaccacatagtaagtcaggagacggtttttcctcaccaaaccagtggttgaattgactggccatacaggattgccactgtatctgctgggcagatacggttactggtagaagtaacgttaaaacaactttgaaatgagtaattatttttcgcattgtgtctctgaatatcggaataaagataagatttgaatatattgaggtcttgtgttgcggtaagagattacacgttatgacataggttaaatgcttacaaaattagtggatattgcctacttgtaactgtaaacaaattccccggggttatacaataccaccggggagaaaatctggttaacttcgttaaaaggtgtacttaagaccagcagtagtgatgaagttatagttttctatgcctgcaccatttttgctgtagtctgaagtgttatcattgtgatcataaagtgaagtattaccttttttattcgtaacccgattccatgcgccttcaacataaacctttgcgttaggtgttacgtaataacctgcattgactgcaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgcctactttcatctgtccaggttccggggttactggaatccatccagtcctgatcgaccatattgccacctcggctgtcgagagtagtccagcccgcagccccaatagatatctggggcatcaaatcccaattaattgcacctttaataattgcagcgttattgaatttccagtcgagttgactgacttttcggcctccttcttcagctagataaacgcgctcttttgtttttccgctcagagttccaagactaatgtccgcatttatgttgtcaggagtaaacgatatagtctcggtagaagcaaaagagctgatcgcaataggggttgtcagaactattcccagaagttttgcccgcataaaagttctccattcaatcgttttaatgattgaatatgtattttttatatctaacttaatgagtcaatcacatattgctccactgtttatattttgtttagtattgaatgattatcacaatgcgctatctgtttttggtttaattatctgttattgttttatgttgcggttttactgtgtggttttttatgcttttgtggtgtttttatctatttaagcgccatgcctttaaaggcatataagcgaaaatagcatgaggtttatcctcaattgctatgttttttagtacaaaaaagagggacaaaactgagacacataaggcctcacaatggcttgcaaggctttacatgttttgaggtagtgggacgtgtgagcgcagagatggcgcggtaatttgttgacttaaaatgtcgttctaggaacttctaagtcgtgggccgcaggttcgaatcctgcagggcgcgccattaaaattcaatcagttacgccttctttatttcttctataattccagagtgggacattatcaccaaaaatgtcgtctattttcctcgcgtgctcagtcaaatgattaggcgcaaggtgagcatatctacgaaccatttctctggactcccatccgcccatttcctgaagcactgataatgggacgcctgacggaatcaacctgcttgcccgggtatgccagaggtcatggaaacggaaattttcaactcctgcacgacgacaagctgatagccatgctgtcttgctgtcaatgcgcatcttcctgagcgcaggcattgatgttccatctgctcgcttagccgccctggtatgtacacccacatttgtgatgcttgcctgtttgatcatgcagcactttagaggcggtatcgttcagcgccacaccaatggcgcgatttgatttgctatcttctggattcaccctggcaacttgtcgctgcatgtcaatctgttgccactccagatttatgatgttcgactttctcagaacagttaccagcgcaaacttgacgacagatttcagtggcttggggctctcatcaatcaggcgtttttcctgattcttttgtaagtctcttgtgccattccacctcatacaggtttgcctgcaaacagtactgatattgcaccgccagatattccggctggcttcgtggttgttttcaacagtgatgaggcatcgtggcatctcgttgaagaccatcggggtaaaacggtttatgacgtggcatcaggggacgcgttatttatttctgagctcggtccgttaccggaaaatgttacctggttatccccggcaggggagtttcagaagtggaacggcacatcatggataaaggatacggaggaagaaacctcgttgctggaagcctgtaagatgtatcgggtgttgctgaaccgagttgatacatcaactgcccctgatattgagtggcctgtgaaccctgtcagagagtaatcattgggattatgccgcagcacgtcgtgcgcaagaacgtgctgcggctggatgctattttttccctgaagcggaaaacattactacagtacctttaaccttggttttaacattctcgaaatgctctgagagtatatgtgttaagccttcttcggaatcttttgtgtttgaaaagatgcctttttgattgtaaatgcgcatcagtttttgaccgaagctattgtgcacaacgccgtcaccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggatcaaaaacatcatggctaattttatgtttaatttttgattccccagcccttgtcgatgccgcgttcaggctagcttcgttcaaatccattaaagatatcagactactctcaggtacgtgagtaaggtaaaacccagttccaacaccaatatccagatggttgttacctaaatgttccagaaagtgtggaagaaggtgttcctttgtaggacatccccatgcaagccgatttgatacacccaaaacccaccagtcataaagctttagggtaagtggtgtgtaaattttagccccatcatctgtgttttttttcattagtttcactatgttatagttttatttgtgaattaaatcaattatagcgatgaattacaaggggttaaatgatgccacggcataacgaatttgaatatattgagtcttgtgttgcggtaagaggttacacgccaggacgcaggttaaatgcttacaagattaggggatattgtttgcttttaacggtaaacaaattccccggggctatacaataccaccggggagaaaatctatttaacgttgttaaaaggtgtacttaagaccagcagtagtgatgaagttatagttttctatgcctgcaccatttttgctgtagtcagaagtgttatcattgtgatcataaagtgaagtattaccttttttattcgtaacccgattccatgcgccttcaacataaacttttgcgttaggtgttacgtaataacctgcattgactgcaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggaattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcctgatcgaccatattgccacctcggctgccgagtgttgtccagccagcagccccgatagatatctggggcatcaaatcccaattaattgcacctttaataattgcagcgttattgaatttccagtcaagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaatagggggtgtcaggactattcccagaagtttcgcccgcataaaaggtctccattcaatcgttttaatgattgagtatgtattttttatatctaacttaatgagtcaattgtatattgccccactgtttatattttgtttaacattggatttttgtcacaatgcgctgtcagttttttagtttaattgtctgtttgtgttttgtattgtggttttatgggctaattatttttttctttgtggagtttttatctattcaagtgccatgcctttagatgcatattagcgataatagcatgaggtttatcctcaattgctgtgttttttagtataaaaaagaggaacaaaactgagacacataaggcctcgcaatggcttgcaaggttttacatattttgaggtggtggaacgtgtgaacgcagagatggcgcggtaatttgttgatttaaaatgtcgttcctggagtttctaagtcgtggctacaggttcgaatcctgcagggcgagccatttcctcgccatttatttgttcccttttacaaattacaccatcactttgttgtcgcggttttgctaaataattggaacacgtcagacgaataaaatgaaaacagaaattctgctaaacaattcatcttgccaggattttgattaggaaagtgaaaaggaaaggagcaaactaagttgctccctttaatcattaatactcaaggatactctgcgcgacgggcaaatagcgcagagagaaatagagcgtgtctttaccgcaagaggaacgtttcgctaacagcgaggcgatctctgcatccggtttcggtttcgctgtaaacgttttacctttaccagcgacaaacagttcataaacaatgccgcttgctggggcggaactttggcaatcggcgctggcctgtagataacgttcacgctgttcagcggtcagtttatccacgccgctgccatcctgtacccagacattaacaccggttgctttaacttgttccagcagttggcgatagccatctggcgacatgtttccggcgaaaaaactactgatataaaccggttttgctgaaacatcgctaatcaaccgctgcgcgttgtttaaccatgttagcaaaggctgacgggcggcttcgctgcaccagttcaggtcgtcaatttccgcgctgatgtaccagccatccggcgttacgccaggcacggcgctccataatctggcttgctggagatcggcagccagcaggcgattaagatagctttccagcgctgcggacgactgtttctggtgcataaaaaattccggatcggcgttcagcccgacaatcagcttcaggccagcctgttgcgcagctgcggcacgcttaaacaataacgcgcgctgttctggctgggtgaatgcatcgccgtaacgggtccattgcaaaaccagggtatcgaagccttgcaaacgtaactgactcatcagcccctgccactgggtatcggtaacctgactatcacggttttgtggttgccagataatacctttcatcgcaaaggaaaaagggctgaccaaaagcagtgtcagcaatacgaaaatgaacttacgcatttaccagtgcactccaatggtgagaaacgcgttgttgcgctctccgttacgttgattaatcgccttaaaggtatgttgatattcgacgccgagactgactttgtgcggccaggcgtcgtagtgcgtctcgccggtccagatattccagcggaccccgacaccgccaagctgcgcgccctgagtgcctttatcacgataaccgttgtcctgaaggtgagcataaggctcaatagtctgtccgttcgccaccttctgatgccagcttacgcgataatctgccgtccacgcctgaatatcctggcggacatattgcgccgcatcgaggtacaggttttgggcaaaccagcctgaaccgttcgggtgccattcgtcgctgtatttgccgccattaaagaatgaggcgctggcgcgcagcatggtatcggatgcgccattttgcccgttcagcggcaactgctgttcgacggcgaggaaaaagatctgatcgcgcagcggcttccagcgcagaccggtgccggacatcggatttttcaccggcatcatcaccccgttttctccggtatcggcaaagacgcggctataaactgagagcaggtcgccttccagcagcatattgcgtccgaggcggtactcggcttccagttgcccgtagctacgatagcttttccctggcgctgcgccgccgacattattgttagcggtactcattgcgccggaacgcaagccgatagaagaatcgaaactgaacgtccagcggcgaccgacctcctcatgcagacggcggaaattgaagcgttgctgattttgctctggggtcagtggggttatcagcgcctgattatcaatgtcatcaatcaccagccgggcgtagtgctgcgtcgcaggcatgtcatccagacgctggttcacgtaggccagttgtcggataagtgccggatcgtccggtagccctttatgcgcctgttcgagcatttcccgcgactgtgcgatatcaccgctatcccacaaggcgtaaccgagcgctgcctgggtgttgctattattcggttccagttccagcgcggcgcgcaaatcactcaccgccgccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgtttcccagcccacgttgttctgcctgctgaagccagcgatcgcgagccgcaccatttcctgccgcctgggcggtattggcagcagcaagcagatcctcattgctcatgtcgtgaagactgattttctgccaggccgccagtgcggtggcgtagtcctcaacctgatacgcctgataggctaccgcacgatgttgccaggcgtccggttgtcgttgttcggcctgaagccatgcatacaacgccacaccgggtagcgtgtcccgataacactttgccagacggttccaggcggcggcatcgtaggaaggcgacatatcgcccagcaagcgaactattgccgggcaattatctgcaatacccggcaactgactttgccactgacgttgctccgccagcggtaagggtttcgataaaatcgccaccttcgccggcgttgccaggtaaggatgactttccagcagagacgccagtcgcgccattaacgtctggctgacacgcgcatcgccctggaaaggatagcgttgcagcaataaatcggcagcttcgcgtgactgttcgttctgcatcagttgccaggtcagttgatccaggcgggtaagatttgccggttcttgctgatacagcaatcgtgccagacgcagagcttcagccttgttacgggtcgctacgctaacggcataacgctcctcaagcatttcattggcggggagggtggcgagcagtttttgcgctgcgccgtactgaccttcttttaacagcaccggtagcgtcgcgccaacaacatactggcggttgtcggcaaactgtaccgtataattcgccaacgcctgaacggggttgccgctgtatttagataacagatagagccaacttttctcttgtgcgtccgtggtaaatagcggcgtattttcaatgagataatgctggaggcgtgctttttcgccacgataagccagcgcggtcgcgtaagtaatatatgactgaggatcggtgaagatcccctgtgattgcagcgccaggatccgatcatccagctgcgcggcaagaagcacgtcaaaccactgacggcgttctgccgcacttaatgtgttctgctggcgtgcttcattatatagcgtatctgcctgggaccattgtttcaggtagattgcccgttgcagcagatcggttcgcaacgtttttccttccggcgatgcagcaaacgtcgcatcgtttagttgcgctctggcgacaggtaattgtgccagccgcagggcattctgcccgacttcactgcgacaacgcagggtcggcgcagcatcgcacgctttttgctgggcaagcagttcttcaacagtcgtaacgcttttcacttcaactggaatagccaccagactgcgctcaagccggtcatctccagggtgacgtttcagttgatcctcaagcaacagccgcgcccggtcatcatgaccaaaatggcgataggcttccgcaaggtataaagtcagcggaatattatccggcacctgctggtgtatatattcaaattcgcggatggcggttgcttcgtcgttatttttctgtgccttcagcgccttatcgagacggggataaataacaaaatggcgataatcgctcagccccagctcttctgcgctggtgccgatattgtctgcgagtgcgctggtactcaataaagatgtcagcagtaaaccagaccatccgatgacgcgattaaggttattctccttcattttcggactccagttgtgcaacctgttcagtgtttaaacctgctttgagtaatagtgattgcatcgaaacttgtaattcgcgttgaattgtcaggacgcgatccaacgtttcctggctgataacgccttcggtgaccaaaaacttgccgagcggcagagaactgcgttcatggcgcaataacaacacgttaattgctgaacgattaatatgaccgagcgtggtcagtatttctgcgaacaggaactgatgcggcacatattgccgccagatttcaccggcctgctgttccgtgagccactgatgctgaactgcattgtacaacattgcccgcggatcgtgaccgcgtcggcgtgcataccagtggcgtaatccggtgacaatttgtccccgcagaacaatgacgtaacgcactttgcgtccgactttacgcgtcagggccgccagcgaaaccgggtcaataccatcttcactgccgacaattaactcatcattgtccagacgcagcggcagtaccgcataatgcaacgccacggaggccggcatttcggcaatcagcgaggaagggatctgccaggcatcgatggattcccacgccacgccgttttgctctgccagcgcctgtgccagttgctcggcgctaatcagcccctgcatcagcattgaaccgcccaggcgtagaccttcgacgcgattacgcagtgctgcatcgagttgttcttcagtgatgacctgattttccagcaggatttgacctaacggacgcaacgagcgggtatcgccagtcacgctggggaagtcatgcgttgttttatcccacgcgacgcgacgtggatcgccgtgttgaagtacctgttttaacgcgcgccagttggccatgaagttaatcaggttgccccagaaaagacgcaggacagatagcagcccctgcgtcaggccgtagtagccagtaacgaaaatcacccgctgcacgatgcggttaatcatcaagccaaagtttagccacagcagagtcattaaccatgcgctgccgctgaaaatagaaaggaaatgccaggcatcgggccacaaactttcatacgccagcaacagcaaaagctggatcatcaccagcatcgcgaggaagctgacaaagttactgattgcccctttgcggtcgcgccagagaaagtagttcagcgtcaggctggaggtccatttgtgggttttaaagccctggaaaacaatgccgatgatccagcgagatttttgccgaaccgcagtcgaaaaggtatcggggaaatattcgcgcacgcagatcatgtttgacgtccgtgcatgctgtaaaaatttacgctgctcgcgttctttggcttcgtccaccaccggaaaacggacaaaaatttccgtcatacctttctctttcaggcggaagccaatgtcgtaatcttcagtcagactctgcacgtcgaaagcaataccgtcaccgtcagctaacagtgcggtcacggcgcggcggctgaaacaggtgccgacgcctgcgctgggcacctgtccggcgagggcttcacgcaccggaacatctttgccatgcagttctgaaaactcatcaatgtaggtcatgctggtgaagtgcgtccattcgcgttcgaacggatacactgggatctgaatcagatctttacgctcgaccagatagttgaacagacgcaattccatcggtgaaatcacatcttcggcgtcatgcagaataaaaccagcaaaagcgaaattggcgctacgttcaaactgggtgatggcgtccagcacgttgttcagacagtcggctttgctggtggggccaggacgcgcgcagactaccttatgcacgttcgggaagcgagcgcacacttcgtcaacatcacgctgagtatcggggtcgttggggtaggtgccaacaaagatatgatagttttcgtagtcgagcgtggtcgccgccagctcggccatattgccgatgacgcccgtttcattccacgccggaaccataatcgctaacggtttttcatctggtttatacagttcgcggtaactcattcgcgggtagcggcgataaacactcaacttgcgtttaatgcggcgtacccagtagacgacatcaataaaaaaatcgtccagcccgctgatgaacataatgaccgctaacgttatcgcgattacttttaagccgtagagccaggtagcaaaaacatcaagaagccagtccacacaaaaaccttacattaacgctggttatgtttagggtggcgtatattaaggttttttatgaattgtgacagctttttatcattaataggtattactattgcggcatgttatttttacactggttataaaagttgccgtttgctgaaggattaagcgggtaatatgataacaaaccttgtcccccgcacatctgacgttactgcaactgtgcctttatgcgcgacaacaatcgatttcactatcgccaggccaatgccgctaccttcgccttttcgctggcgggaaggatcaacgcggtagaaacggtcaaacaatcgcggtaagtgttcgggcgcaatgggcgtaccggggttttcgacggtaacttgcaccaggtgatcgaccgtctggcagcgcacgacaattgtctctccggttggcgtataacgaagggcattagaaagcagattgcttaacgcccgacgcagcatcagcggatcgcccgcaacctgacactcgtcgccaacaaaccgcagctccacgccgcgatcttctgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgcgactggctgagggcgatttccgtttgcgtaatgagattagtaataggtgtgcgaatttcgtgggcgatatccgctgagaaattggactggcgggtaaagacatcctcaatacgctcgatcatatggttgaacgacagtaccagctgttccagctcaatgggcacggtctgcgggtcaaggcgaacgtcgagatctttcgaggtgatattctggatttgacggctgacgctgcggatcggcgcgtgacctttatgtaccgccaacagcacgataaagacgatcaggatgctgattaccgatgcggtcataataagtttattcatcaaatcattgatgtaatgaagatgaaaatcgatcgaaagcgcgatgtagagcgtataaatcggtttgccgtcaaccagcgggccaaccggcaagttaatcatccgccagttgctgtgttccatatgcccgtgaccgtgccctggcatcatcatcgttgggccggaaaggagatacacctcgccgccctgcgcgtctttatcgggtatggcgtcacgcgtaaactcgcggatatccggcgcaccgggggagtgatacaccgttttaccgtggctatctgccagagagatcaacacattggaataaccactgacgatatcttccagcgtcattaagcgtcgggcttgcgtttcgtcagggtgattaagtacccgttcaagggtggcgctaatctcttttaaatcattaatatcctgctcggcaaaatgcacttttaccgagtggatcatgatccatgcaaaggcgaaaaacgccgcgatggtggcgaggctgataaaaaaggtcaggcgagttgccagcgaaaacgggcgctgaaatggtttactgaccatccggcacctctagcatgtaacccacgccgcgcacggtctgaatcaactttggctcaaagtcgttgtcgattttgccgcgcagccgcttcaccgccacatcaatggcgttggtatcgctgtcaaaattcatgtcccatacctgcgaggcgataagcgagcggggcagcacttcgccctgatggcggaggaaaaactccagcagagtaaattctttactggtcagagtgatgcgcgtgccgctgcgggtgactttgcggctgacgagatcgaccatcagatcggcaacctgaaactgactttcgataatcaccgccgccccgcgccgcagtagagtgcgcacccgcgccagcagttcagcaaaagcgaacggcttcaccagatagtcatccgcccccaactccagccccttgacgcgatgttcaatggtgccaagcgcggtaagcaacagaatcggcatccccttattggcggaacgcaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcattttcctgtcaccggaaaatcagagcctggcgagtaaagttggcagcataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactatcagaacgcgggctggcgcaccttttttgttgataatcaggtgaagacgctgattagcgaggcgttggtgaataaccgggatttgcgcatggcggcgctgaaagtgcaggaagcgcgggcgcaatatcgtctgaccgatgccgaccgctacccacagctcaatggcgaggacagcggcagctggagcggcaatcttaaaggcgattcagccacgacgcgggagttctcgactggccttaacgccagctttgatctcgattttttcgggcgcttaaagaacatgagcgaagccgagcgccaaaattatttagccactgaggaagctcagcgcgcggtgcatattttgctggtttctaatgtcgcgcaaagctatttcaatcagcaactggcgtatgcgcaattgcaaatagccgaagaaacgctgcgtaattatcagcagtcatatgcgtttgtcgaaaaacaactgttgaccggtagcagcaatgttctggcgctggaacaggctcgcggggtgatagaaagtacccgcagcgacatcgctaaacgtcagggggaactggcgcaggcgaataatgcattgcaactgttattgggaagctacggcaagctgccgcaagcgcagacagtaaacagcgacagcctgcaaagcgttaaattaccggcgggcttgccgtcgcaaatcttattgcagcgccctgatattatggaagctgaacacgcgttaatggcggctaatgccaatattggtgctgcgcgtgcggcatttttcccgtctatcagcctgaccagcggaatatcaaccgccagcagcgatctgtcgtcattatttaatgccagcagcgggatgtggaattttattcctaaaattgagatccccatttttaatgctggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaatcagcgcccagcagcgttatcttgcgtcgctgcaaattactttgcaacgggcgcgggcattatatcagcacggcgcggtaagttatctggaagtgctggatgccgagcgttctttatttgcaacccgacaaactttacttgacctgaattatgcccgtcaggttaacgaaatttctttatataccgccttaggcggcggttggcagcaataatttttaactccaggagagaataaatgaaaaaagcactgcaagtcgcaatgtttagtctgtttaccgttattggctttaatgcccaggctaacgaacatcatcatgaaaccatgagcgaagcacaaccacaggttattagcgccactggtgtggtaaaaggtgttgatctggaaagcaaaaaaatcaccatccatcacgatccgattgctgccgtgaactggccggagatgaccatgcgctttaccatcaccccgcagacgaaaatgagcgaaattaaaaccggcgacaaagtggcgtttaattttgtccagcagggcagcctttctttattacaggatattaaagtcagccagtaacccaggtttaatgagatgaaaaaaatcgcgcttattatcggcagcatgatcgcgggcggtattatttctgcggcaggttttacctggtttgcaaaggctgaactgcccgcagaaaaaacgtcgaccgcagaacgtaaagtcttattctggtacgacccgatgtatcccaatacgcggttcgataaaccagggaaatcgccgtttatggatatggatctggtgccgaaatatgccgatgaagagagttctgcatctggtgtgcgcattgacccgactcagacgcagaatctgggggtgaaaacggcgaccgtcacgcgtgggccgctgacttttgcccagagtttcccggcaaatgtcagttacaacgagtatcagtatgccattgtgcaggcccgcgccgccgggtttatcgacaaggtgtatccgcttaccgtgggcgataaagtgcaaaagggcgcgccgcttctcgacctgaccattcccgactgggtggaagcgcagagtgagtatttactgctgcgcgaaaccggcggtacggcgacccagactgaaggcattcttgagcgact

SEQ ID NO: 10003 - DNA, 46538 bp, Escherichia coli
gtggactggcaacaagactaccgacgatctgattatggcgaagcgtatcgctgactttgaagaccagtatcaggctgacgcggtgttcatcgacttcggttacggaaccggtttgaagtcaatcggtgacggctggggtcgtacatggcaacttgttccgttcggtggcgcgtctactgacccgcagatgctcaacaagcgtggggagatgttcaactcatgcaagacatggctgaggctcggcggcatgctggatgaccaggaaacagcggacgacctgtcgacggcagagtacaaagttcgcgtggacggtaaaatcgttatcgaaccgaaggaagatatcaaagagcgacttgggcgttctcctggtaaaggcgatgcgctactgctgacgtttgcgttccctgtgtcgaagcgtctgcgaattcccgggcagcagaaccagcaaggcaaagccatcacagactatgatccttttgcataaaaaagcccgcgaatcggcgggctgattgtgacatgtcacggcgttagaaggttattttatcgaatgcggcgttgattgccttggcgtcctgctcagcaccaaccacatcaagtaaagatcttttactaagcacttcagccaggcattgtaacttcatgttgtataagttttcgcgcatgtaatcatcatcacttttttctttggcgtatacagcgcgagaaatatcaaacacattgcctttttccatttcagttttctgcgctgaaatccagtcatggcaagtaactcctattccatggtcatcgctaagcgttaacccggccagtccctcactctgaattacttcgtaatgcatttcattaccagcaaaaacgccataaaaaacgcagtcttcagcctgaacgatacgagaatattttaatggccattcatttagatacttagccaacatatcaattgttttcatgatctcaccttaaaaaaatgcccggcgaaccgggcgaactggaagcaatgagttatgccttccgtggctgtacgggtttacagcatgaagtcatcgcaatggcgtcctgctgtaaaaagggcggtgatagtccttcaagggaaaccatcaccgccaagcacctggaacttctggcatcacggtccttaggcgtgattctggcgtggcatgcaggattcgaacctgcgaccaaccgcttagaaggcggttgctctgtccaactgagctaatgccacaacgctgagagcacttagcctgttaaggcgccacactttgtcgcggctccataaatgctctcatcgttgtaccctcgtctcttccgaggcgtcacaccgaatcgccgggatggtgaatccccgtgcgcggaataaaaccgctcgacttgcacattccggctacctggttcgtttgcccgagcaagggagggtgccccttaaacgtatccagaccgctatcggcgcatgtgccatacgccgtactgctcaaaataaaagctcactccacctgtttaatttaacgacaagccagtcaggttagtaaccagaatgagccctttggttacctgaaaggtaataattaacgcgttaaatgtcaaccttctacgataaataaatcatatgtggttaaattggtaataatttaattgcgtacggagtcattgatatgtgcatgggtagctcaccatcagtgcctgcaacaccagaagttcaggcagcaccacaggagcaggatgccgccgttgttgatgcccgcgacgaagaaacacgtcgccgtcgcgctgctgctggtcgtagttctacgctgcttaccggttctcagggcgacacatcaaccgctaataccagcggtaaaacgctgcttggtcagtaaccggagtcattgaaatggcggaaacaactaaagagcgattgaacaaacagttcgcacaacttgaaagcgagcgtcagtcgttcgagccgcactggcgcgagttgagtgattacatcaacccgcgtggttcccgctttctgacttctgaagtcaaccgtaacgatcgacgcaatacacgcattattgattcgaccgggactatggcggcgcgcactctcgccagcggcatgatgtcaggcatcacaagccctgcgcgtccgtggtttcgcctggctacgccagatcctgaaatgatggattatggtcctgttaagttgtggctcgaggcggtgcagaaccgcatgaacgatatgttcaataagtcgaatctctaccagtctcttccgcagttatacggaagcctcggcacatacagcactggtgcaatggcggtgctggaggatgacgaggacatcattcgcacaatgccattcccgataggcagttactacctggctaactcacctcgtggcagtgtggacacctgttttcgcaagttctctatgactgttcgtcagcttgttcaggagttcgggctaaataacgtcagcgaatccgtaaaaagcatgtgggaaagcggcacctacgagaagtggattgaagtgatgcattcggtttacccgaacattgaccgcgatacatcgaagctggatagcaagaacaagccattcaaatcggtttattacgaggttggtggcgataacgacaagttgttgcgtgagtccggattcgatgagtttccaattatggctccgcgctgggaagttaacggcgaagatgtttatggatcatcatgcccgggtatgctggcgcttggacctgttaaggcattgcagcttctccagaagcgcaagtcgcagttgattgataaagccaccaatccgccgatggttgctccgacttccctcaagaatcagcgtgcctcccttcttcctggcgacatcacgtatatcgatcagattactggtcaggatggtttcaggcctgcttatctggttaaccccagtacagcagatttggtggcagacattcaggacactcgtcaaatcattaacagcgcctactttgtcgatctgttcatgatgttgcagaacatcaatacccgctcgatgcctgttgaagcggtgatcgaaatgaaagaagaaaaacttctgatgttggggccggttctggagcgtctgaacgacgaatgtcttaatcctctcattgaccgctctttctcgatgatggtgcgtaaaaacatgctgccgccaccgccagacgtgatggaaggtatgcccctgaaggtcgaatacatttccgtcatggctcaggcgcagaagtctatcggcctgtccagtctggcgtccacggttaacttcattggtcaacttgcgcaagcgaaaccagaagctctcgacaaactcaacgttgatcaggcgatcgatgcattcgctgatatgtccggagtgtctccaaccgtcattgttccgcaggaacaggttgagcaggctcgccagcaacgggcacagcagcaacagcagcaacaaatgatggcgatggggatggcggcggcacagggtgccaagacgctaagcgaagctaaaacttcggatccgagtgttttgtcagctatggcgaatgcagttagtggtcagggtgggcaatcacaatgacagattacgaagacgatcaactgaaagaagaaaacgcccgtaagcaacgtgacatggcacagcgtgaaattgatgacattcgctttgtcatgagcagtgaacaggggcgtcgcgttgtctggtcggtgctggagaaaggccgtgtgttttccgctatctcaccgatggacgctatggcaatggcatttaatgaggggcaacgcaatctggcgctggaactgtttcagcgcgttatggcgcattgtcctgaacagtatttgaagatggccaaagaggccagtgaacaggagtgatcatgaatttatttgagcgtttgctgtatagccgtctttgcaatgagcaaccagtcgatggtggagcagctccggctgcgtcagaaccgtcagcgcctgcaggtgataaccctgctccagttggtgatccatcacaacaggaaggtgataagccacaacctgttgctgatggcgataaacctgctgatgacaaaaagcctgaaaacgataagcaggatgaaaaaaaggacggcgataaaccagagggtgcgcctgagaagtacgagtttcaggctgccgaaggcgtagagctggatacagaagcgttgaaggaattcgagccggtggcgcgagaacttaacctgaccaacgagcaagcgcaaaagctggttgatgcttatccgaagattctggcaggtgttcagcagcgccaggcagaagcctggcagaaaacaaccgagcagtgggctgcggatgtaaaagctgacaaagaaatcggtggcgacaagttgatttctaaccttagcgccgcacagcgtgcgcttgaccagttcgggacacctgaactcaaagaatatctgaacaccaccgggctgggtaatcaccctgatctggtcaaaacgttcgtgaaaatcggaaaggcgatgtctgaagatggcatggtcaccggtggtaatgaaggccagcgtagtgcggccgaagtgctctatggcaaataagagaggaaatgacaatggctgttaaaggcttaactgcgctaacgctggctgactggggtaagcgcgtcgataaaaacgggaaagtcgataagattatcgagcttctcggtcaaactaacccgatccttcaggatatgccttttgtcgaagggaaccttcctaccggacaccgaaccaccattcgttctggtttaccttcagccacctggcgtttgctgaactatggcgtacagccaagcaaatcaaccacagtgcaggtcaccgattccgttggaatgctggaaacctatgctgaagtcgataagtcactggctgatctgaacggtaataccgccgaattccgcctgtctgaagaccgcgcatttattgaagcgatgaatcagcagatggcgcagacgctgttttatggtgattccagcgttaaccctcagcagtttatgggactgtcctcccgctattccagcctgtctgcaggtaatgctcagaacatcattgatgctggtggcacgggtacagataacacctcaatctggttagtggtgtggggcgaaaacacagtgcatggcatcttcccgaaagggcagaaggctggcattcagatggaagataaaggccaggtgacactggaagatgctaatggcggcaagtacgaaggctaccgtacccattacaaatgggacaacggacttgctctgcgtgactggcgttatgttgttcgcattgcaaacatcgatgtcagcaatctttcagaaccttcctctgccgcaaatattgcgaagttgatggttaaagcactgcatcgcattccaaatcgtggcatgggtcgcccggtgttctacatgaaccgcactgtaggccaggctcttgatctgcaatctctggagaaaacatctctggcgatcagcgtaaaagagacagaaggcgagtggtggacttcattccgtggtgtaccaatccgtgaaactgatgcgcttctggaaacagaagcccgcgtggtgtaacgcctgttattaacctgtgggtcgtaacagacccactaatggagaaagaagatgatcaccgacaaactgttgatgttctccgaagctcaggcggttacgaataccgcggcttctactgacgtaatcgatctcggtccaattgacggaaaacgtcgtgatatcggcgtgggttacccgcttgagttttgggcgctggttaacacagccgccgcggcaagcggtgatgcaactgtaaacatccagttgcagacgagtgagaataacagctcatggaccactatttatgatagtggcgcactggcaaagaccgccctgacagcaggtaaacgagttgtttctgcaaaggtgcctgccggtgttcagcgatatctgcgtgttaactactccgtcgcaactggcccactaacggctggcgaattcactgctggtatcagtcttgatgttgatgccaatacgccgtatccgatcctctcaaaagtaactggttaaggtgatatcgatgtcaggtgagaaaccaagataccgcgttctgcgcctctctcatatccataacactctgtggccggagggggcagaaatcgaatacgaaggtgagcctggtagcgcactggaacctgttaacgatgcagccagacaggcaaaagcaaaggtagcaggaaaggtgtctatggcagcaaccagcaccaaaatcatcaacgatgtgtcagatgatggtgaactggataagctccgtgaagagtacgaattgctctttaacgagaagccacaccataacgccaaagccgaaacgctccgcgagaagatcgcagataagcgtaaagaactgggcgtgtaagcctcgcggatcagacaaggggcttcggcccctttattgcaggagtgtatatggaactcgtaaacctcaaaaccggcactgacagctaccaggatgagagcggagaaaccagaactcgcgatgaatacccgtgggggctgtgcatcactcttaataacgacacattgaataagctgaaggcgcaacctaagggcgtcggaacggaagtgatgataactgcaaaggctgttattcgaggcctgtctgccagagaaactaacgatggcgttaatcgcagcgccgatctgcagatcactgatatggcgatcgctcctgtttccggggatgtagaaaaatcagcggctgaaactctgtacggtaacggaggtgagtgatggcctctgtagtagagatctgtaatcgtgcgctgtccaatattggcaacagccgcagcattaacagcctgacggaagccagcaaggaagcgggggaatgttcgctgcactttgaggcctgtcgtgatgctgtgctttctgattttgactggaactttgctaccaaacgcgtggcgcttgcagatacgagcaatccaccgcctgactgggaatatgcgtaccagtacccgtcagattgtctgcgcattactgaaattatgcttcctggtgtacgcaatccaacagcagcaatgcgcgttcagtacgaagttggtgcagacaccaacggaacaggaaagttgatctacacagaccagcctcaggcatggctcaagtatgtctctcgcgttacagatgtgaacatgtttgatgccatttttatggaggcgttggcctggcgtcttgcggcagctattaacatggcgctgactgggaatgcagacctcggtacgtttgccctcaatatgtacaatcgcgtgattcttagtgctggctcgcatagccagaatgaatcacaggaaccacagccaccggttgatgagtttaccattgcgaggttgtcctgatggctatcagttggatccagcccagctttgccggtggtgagattggaccgtcgttgtacgggcgtattgacatggcgaagtaccaggtagcattgcgcaagtgcgataactttatcgtgcggcagtatggcggcgttgagaatcgacctggtacgcgttttgtcggtgccgccaaatacccaaatcggaaatgccgcctgatcccgttccaattctcgacggttcagacttatgctctggagttcggacaccagtacatgcgcgttatcaaagatggtgcgttggtgctgaacagcagcaatgttatttatgaaattgccacgccatatactgaagccgatctgttccgaattaaattcacgcaaagcgccgacgtgcttacgctggttcacccggcatacccgccgaaagagctgcgccgctatgcgcatgacaactggcaactggttgatgtggtaacgaagaacgggccatttgaagatatcaatattgatgagtcagtgacggtttatgccagcgccagcaccgggacaattacgttaacggcaagcgcctctatttttggcgcggagcaggtaggcaaattgttctatctggaacagcctgcagtggattctgtgccggtatgggaaaccagtaagagtacgtcgattggcgatattcgccgtgcagacagtaactactatcgcgccgttacagcaggcaaaacaggcactttgcgcccttcgcatacagaaggcacatcatgggatggctggggcggatccggtgatgatgatactggcattgagtgggagtatctgcacagtggttttggcattgcccgtataactgctgtaaatggcactactgcaactgctgaggtgatttcctatatcccttcgcaggtcgttggcgaggataatgccagctataaatgggctaaatatgcctggaacagtgttaacggttatcctggcacggttgtttattatcaacaacgtctttacttcgccgcatcgacagcgttccctcagactatctgggccagccgtactggggattataaggattttggcaaaagcaatcctacgcaggatgacgacagaattatctacacctatgccgggcgtcaggttaatgagatccgccacctgattgatgtcggttcgctggtggcactgacttccggaggtgagtacgtcatcaccggcgaccagaacaaagtattaactccatcatcatttgcattcagctctcagggatcaaatggttcgagcaatgtcccaccaattgccgtggcgaatattgctctgttcgtccaggagaaaggcagtgttgtccgtgatctggcctactcattcgatgttgacggctatcaggggaacgaccttactatccttgccaatcatctttttcagaagcacagcattgttgactggtgcttctctattgtcccttactccagcgccttctgcattcgtgatgacggtaaattactggtgatgacctatttgcgtgatcaacaggtttttgcatgggcaccacagtccagtaccggaaaatatgaaagcacatgcagtatcagcgaaggcaatgaagatgcggtgtatttcgtcattaaccgaaccgttaacgggcaaacagtgagatacatcgagcgactgtccagccgtttatttaccagcgatgaagatgctttctttgttgattctggccttagctatgatggaagaaatacgtctgacagaacgatgaccatcactggtggttctggtgaatgggattaccgtgcggaatatacaatcagtgtttctggtggtgcgtacttcaccagtagtgatgtcggcgcgcaactacagttcccttataccggaactgatcctgatactggcgatgaagtgtcaaaagaattacgttgcgacattatttctgtaaccagcaataccgctgtagtggttcgtgctaacaggaacgtcccgccatccctcaggaatgtggccaccacgaactggcagatggcgcgccggacatttggaggcctgtctcatcttgaaggccagaccgtaaacattctctctgatgcgaacgtggaaccacagaaagtggtttccggaggtgccgtcacgctggaatctccgggggctgtagtgcacatcggcctgccaataactgctgaattcgaaacactggatatcaacattaacggacaggaaacgctgctggacaaaaaacaggtgatcccctccgttactctggttgtgaatgccagtcgcggcatctgggcgactacgcccggcggtaaatggtacgaatatccacagcgtgaattcgagttctacgatgatcctgttgatgatgctaccggaaaagtagaagtgaaactggacagtaactggggcaaaaacggacgtgtaaaaatccgtcagcttgatccgttgccgctgtctgttcttgccgttattcctcgccttactgttgggggattctgatgatcgatgttcaaattattcccgcaaccgaagagcatcttcagatgattttgccggatgttcgtcaggctgatattgacgaactgtatgcggtatcactgatgactaccgaagatgcgctgcgtgttggtctgcgtactgcgactatggcctggtcagggttcgcgaacggagaactggtaaccatgtttggcgtatctccggcgtcaatgatcggtggcaatggtacgccctggctggtcgggaccagccgtattgaaaaatatcagaagacatttctgcgccactgccgccctgtattgcagcagatgctggcagtttatccgcgcctggaaaactacgtcgacgagcgaaaccatgttgccaaagcatggctgcactggcttggattcaggcttgaagaagccgcgccttatggtgctattggtcttaatttccacagatttcacatggagagaaaataatgtgtaacccagccatcgctttggttgccgtcacagtggcatccacagccgcgtcaatgtacagccagagcaagcaggcaaaataccagtcagccatagctgatcggaatgctgaaattgctgaagctcaggcacaggattcaatcaatcgtgggaatattgaagcagatcagcgtcgtcgtgaaatgcgtcaacgctcaggcactgcggcggccactatgggggctaccggtgcggaattaagtagcggaacagctcttgacgtttttgcggataatgctcagttcggcactcttgatgcgttaacgacagtgaataatgctcagcgtgaggcatatgggtatcaggttcagggaatgaatgctcaggcacagggggctgctgctcagtcggctgctaaatcatcgatgaccagcactttgttaacagcaccactaaaagcatacggtgcatataagttgggcggcggaacgtggagtccgttctctaaaggaagtacatctagtggtgggacgccaatgttatctaactcaggttttatgaattctgactcccgattcaaaataggaggttactgatgccagttgttcctactacatccggacgccaggtgcaaagtcgtggtgtgcaaaccggtggttttcagaccttcgatgttcctcaagcaggtcaggtgctggcgaatgtcgcagatcagtatgcggtggcatatggtgaagccaggcagaaagcgaatgttgctatggctcaggaggcgttactgcaatttaaccaatttgcagatgaccagattaacaaccctgaaaatgggctgatttctaaacagggtaaaaacgctcttggtcagagtgacgctgttatgaaaaatatgcaggaaagggctcaggcattattaggctcaattcctgaaagtgaggaaaggaataaattatcctttcaactccagcagtctatgcagtcttattacaatcaggcacgtcgatatgaagttgggcagtttcagcaattccaagatcaaacgtatttgtcaggaaatgcattggctgtcactcagtctgcggggctatatagcgataaccaagcatttgtcgatttagccaagcagcgatttgaatctattgatcaatacgctgatgcacatgggcttcctgatgggtggcgtgttcagcagaaaactcagctcaaggaacaaatggggcagcaagcatggataggaaatatcgctcaaaaatacaacgagtttcttcaggttaatggagagccaggggatcttgatggtgtgagtcgtgcaatatcacatggtaattcattggatgctcgtggtttacgtaataataaccctggtaatattgaagcgagcaaatctaacccgtgggaaggtcagatcggtagcgatggacgttttgcaacgtttgctacccctgagcatggaatccgcgcgttgggtaaaaatatgttgtcttaccagcgtcaaggctatgacaccgttagcgagattgttaatcgctatgctccggctagtgatggtaataatactgatgcttatattagggcattgtgtagtgagcttggtgttggggagaatgatcagcttgatatctctaacccaaagacactagctgctttatgtgctgggattattaaacacgaaaatggcagtatgccttatagcaccgaacagcttgaaactggtatctcggcatcccttggtctaactaaccttgattcacctaagcgttatacgggcaatgcggcatttgacgctatgagccctcaaatgcaaatacaggcattgaggcaggctaatgagctgagaaatcagtaccgccagcagtatgcggaccagcttagcaccgtagttaaagatgcatattcagcccttgatgaaggattgaaacctgagaagttaccttctgaggacgattttatccgggccaatggtccgcgcattggcgctatgaagtggaaggatatgcaggcgcagatacaatatggaggtgtcattggtgccgctaaagacctcactccagaaggacgacaagacattcttgaacgtttacgtccacaggatccaaacgctcctggatttgcagctaaccagcaacgctgggagaaaatgcaggccaaatttaaagagatggatagggagtgggagattcagcagggaagaaacaggttcgtgtcttcaatgcaaaataacttcccgctggacccgaacgacaaaaacaatcaggcagcggtagaccgttatttcgcgcaggatatcgcgccttcgttttccatatctgatccgcagagcatcaatacactggtcaccgtcacaactaaaagcggcatgataccaactcaggttaaaacaatgcttaacagtggagcaacatcaagagatcctgcgctggttgtcccgatggcaaaattctacggtcagttatttgataataatccggcggcagcggcaacacttgataaaagtacgatggcattttacggcaaggtttacgattattcccgcgctggcgtgccggaggataaggctgttgatatggcttacagccaggtgttccaacaggatgaccgaatgaaacagatgctttccactgccatgcgagacaaaaaatatgtcgcggcgagggcaactgctgcacaaaataacgccagcagtctgacttcctttggttcgtggtctccggatattaccgatccaggaaaatcaaatgcggcctatcagcgagattaccagacaatttacgatgctaactttgtacagacaggtggcgatgcagaacaggctgagaaaatgaccaatgccatgatcagaaccacctggggagtttctacagttaatggcaaagcagaggttatgaagtatgcacctgaggcattgtacggagtaaataatggtgctggtaactggatacaggggcagtgggagcaggaaaaacgcgagcttaaatcaaaatcctttggcggtcctcgcagtgatacggacttaatacttgtttctgatggccttacggcaagggataggagttatgctgttatggttttacagcctgacgcaaacggagcgatagaaccgagaaattatattggagaaaatggtctccctgttcgtttcaagccggatcagctgacatctccaatgtacaggcaaaccattcagttccagcaacagcgtgttgatgaggctagagtgcggagagaaggcaatccgctgccgcagttcagcaataaagatggatatactcctccagatctgaccaaaccattcggttatggttcagccaattaccttccgagcaatatatacgcagggggcaaataatgccgatatatgaacaggatcctaaagagttgcttggcgaggatattcagcaaatagcagcacctgatgacagtaatttctatatggaaacaccttctttgctttctgctgtgaacccatttaccagtgatcaacgcgttcaaaggtctagacaagcagcatttcgtatagataacacgctgggtagctttattgccagtgctcctttcagtcagtttgacagggttgaaggatataacccatttgataacgatgcagcagatattaaaggctatgaagattttgcagattcgtttatcaactccggttcgcctgaagaaacaatggcaattaaacatcgaatcgatcagcagagagctgacatggaatacaattcaggcttgggatttgctggtacagtctcttctgtagcaatgagattagcagatccattcaatgcgatttctatgtttattccgttcggcgctgtcgttcgtggcggtcgtattgcagaaacagccgggcgttttgccctggcgaatgctgctggcagtgttgcttcagaggccgcattacaggccactcaggaagctcgctcaccgatggagagcgtatcgaacgttgttgttgatgctctcgttggtgggatccttggtgctggtgcacagctacttgctggacctggcgcgcgcgaggcagtggttaactcagtaggtaatcatttgcgaggtatggattctcctcaaagcattggtgcagctcaggttttcaataccacactcgatcaggaacagctcgctggacttggacttgctaacaaaacgttgagtgtcactcctgctggccgcttggcgcaatcaccatctcttgtctcccgtcagattaaccagcagcttgccgaaaataactatttcttcgccaaaaatgatgaggggttggctacgtttacggcagtcgagactaagattaagcaatacgacgccatgctttataagcagatggaagccactcgtgatgcttaccagcagtacagcaaatctgttagcgcccgcggcgtgaagaggatgaactttattgatttcaatgaagctgttggcatggctatgcgccgtggtgatcagagtgatattcctgaggtttcacaagcagctgccagaatccgccccattttcgagaccacaaaagcccgtatgcaggaactggggatccttcctgaggatatcgatgtcgtgacggcgaaaagttatcttccccgcatttataagttcgataagatactttccgaccgcactgaattcagagggcgaattgccaactggatacaagggattagtgccaaaggtgctgacaaggcaggtcagcgaattgaaaggataaattcattgctaaaaactgcagaggaatcggcaccgcgcgctgatgctctcgctagtgaaatcgctgaagcggagaaatggtctggtaaaaaaattctactcatggaagaactggataaacgaaataagcttatatctcaggagactgacacacaggcgcgtcttacaagaatagaaaaagagttggccgagacttcatcagaaaaacttcaggcaagaatgatgaaagaaagctctgaccttaaaacacgccttgatgatatagcgcaggcaaagagtgagcttcctgtctatcagcgccatatggagttgctggataatccacggaaatatcgttctgagcttcgccgactgcaaaaacgggcaaattcaaccacaaggctgaatgcaagccgcgaacgagcactgaagcagatggagcctctatcccgagaggaagcagaggacgctgctgacgagatcgtgaataaaataataggtgcaccttccgggcttgtaccagccgatattatcccagagagactcgttggtcgggctggtttcactaaaagcagaacgctgcttattcctgatgagcgtatagaagattttcttgaatcagatgttaactacatcatggaaagttatctccggcaggtggcaccagaaattgagctgactgcgcagtttggccgtaaagatatgggggagcaaatccgtcaggttagtgaggaatatacccggctaataaaagaggctaaaacgcctaaacgacgtgcagttcttgagaagcaacgggaggctgatattagggatattacggctatgcgtgatcgactgcttggtacttacggtgcacctcaagatccacgcagtttctttgttcgtgccgggcgagttgctaggaatattaacttcctccgtttgcttggtggaatgactgtctccgctgcaactgatctgatgcgaccgatgatgcagcatggcctgagaaaatctctcggaccaatggtaagcatgcttaaaaatatggactcagtgaaaattgcaaccagggatttgcgagaaatggccgttgggcttgattatgtcctgtctacgcgtacaaaggctatagcggatcttactgacccatatagccggagaagcgccgctgagcgaggcctgaactggatgacgcagaaattcggtaactggacgctgatgaatcagtggaacagcgcacttaaatcatggtccgggatgatagtgcagtcgaggatacttgacgcggctcgccaagtttctgctggtggcacgctctccaaaagtgaaatgcggaagatggcacaggtcggcatcaatgaagatgttctgcgccgaatcggggagcaattcgggaagcacggagaggatatggacgggctgttaaccgggcatagtcatctgtgggatgaccgtttcgctagagagattttccagtctgcagtgctgaaagatgtagactcagtgattgtaacgcctggcgtaggtgatacaccgctgttttttagtaaagaaggctggaagatgatcacgcagttcaaaacgtttatcttcgcacagcataacagggtgctggtatctggtatccagcagggcgatgctgcattctatcttggtgcgcttggcacgattgcgcttggctcaatggtctatatgatgaaacagaagttaagcggtcgcgatattgactacagctggaataaccttgtgaaagaggggatcgaccggggcggaatgcttggctggctctctgagccgctgaataccgttgagaacataagcggcggtaggtttggtcttggcgcgatgtttggtgcgcctccggtatcaaggtttcagagtcgtaatgctattggtgctttacttggtcctacctttgatcttggcggtgatgccgcgacggttgcgaatggtgtacttaacggagaatttgacagccagcaaacccacgcggtccgtaaaatgctaccttttcagaacctgtgggcaatatcaccgttactaaataaagttgaagagcagatgaaataggatgaaaaaaataaatttgttttttggcatagtgctttcaatagtctctgtaaatcctacagctgccagttcattgcaatgcaataaggataactttgatgcatgcaaaacgtgtgaacaattatcaaaggctatcgacttaaaagaacctaatcgtggcgattactatagaggggctttatggaatgggctttacgcctcttatgtaattaattgccctgtggttgctgagaagttactgagccatggtgctataccatcatatggcggatatatggggtctatgggggcggttctgacaggaaaatggcctcataacaatgaatcaataaatctttcatgggcagatttgcttataaaacatggatttgatgttaataggcatacggggaattataaatcagctactgaagtatgggctatagataaaaaacagattgaatataagtcagtttttgacaagttaattcaatccagcgaagtaaaaccactcgatccttcaagaaatttagaatggtgtgcgtctgaagggtatcgctcagttgtcgtttattcccttaactcatgtatagaaaatgctataaaacgtttggatgatggtgtttcttcagcgtctgatatttcatcagcagccgtaaattcctgtactagcgatgtagaaaatttcaataagcatttggcatgcaaagcagctgttaaagaaaactctgataaagagagaagcaacgtttaccagttattaaccagtgatagtcaaatgaataaaaatgttattgatatgctgaaggaaagaaatattgaaacggttcttgaatttagagctgaaaatcgatcagcgaaaactgcacagtgatcaaacaggccgctttcgcggccttgtttttaacgaatgccaccgccacccgggcgggaatccgcagaacgcccaccgcagcgggagccgtcagcagcagtatcgctgtcgtgctgacaacgaccggcaaaggcctgagttgaagctaccagagacaacaaaacgaacagtgcagcaaatgcttttttcattgtgaaatttccatctataagccacctcaatgtggcgtcaatgagtgtagcactgacttttgtttcgtccacaaaaaagcccgcgctgcgggcttctattaatgcagtttatctttgcttataaccagtagtctgtgggtatgcacatctttatcactgccccaacagaaatcagcccactggctatagaaatcatcccatgatgtcatgaagctaagaggtctatcttcttcagagccatctgaaacgtatacattatatcccggggtgtttatagcccaagaaatcattctttcccagaatcttctcccatcgattgtttgttgctcatcagatacaacgatcgcatattgctctaggaagaactgaaaaaaaatctgaggcaaaccatgaacagcacggtcatgaataacattaggcgtacgccataccatgatctgcgtacatgttcttttagcttcgacgatatcttcccgaaagattaacttaaccgcatacaccgtttctggagtatcgctggtagtaatcattctgtaatgatcgccattacaagattttacaaggcgataaccataaggtgttgtgaatcccggaagaacgaaatcaaccacacctttcgctaagtagctttcggtgtgactagtgttcttctcagacatgttcagttttctgtcgaaatctgcttctgggataatgtatggcatcgcttttcttgttgtatttgttttcatttcgtcctcccatgtttggctacaggacgcgttttgaagggaagattaaaaacgctttcttacccgtaaggtaatattacgcgaatctacatcacatcgccaatgattattttaaaggcacatccatgtgccgccgcccgtcagaagaacccagccttgtcgttgatgtactccgcgtgcgtctggatatcacgcaggcacttgctcacaccgacgatgtagcagaacatggtggtcagctccgccgccgcgcccgatacgtcgtgcccgtcttcctgtaactggttcagcagattcatcagcagtgagttctccgtcaggccgagaacaccagacggcgaatgaatcaggctgcggtagccgggcttcagtggggcactgtaggttttgttctctatcttcattgcctgcatcactgctgatgctgtggcgttggctacctggtcggcaaccatctttatgcgttcttcctgcgggagcgagtttttaatgtaacttccggtgcggcggatctgaggaagaacctcacctgtaacccatttacgaaagcggtaggggatagtgcctggtgtcactgcgtcgcggcagcggaggatcagtgtgtagaggcctgactcggagatgatgatcgattcttgctcaccgccaggggtgtcggttgaagcgacgcccttctcatcatcatcaagttttcgaacagcatctcgatgatttgctatgcctatagcccgacaaacatctgaagcgataaaccatggctcaccattaatgacgattacccgtatatcggcttgggattcgaaagaaaaaatggacgtgctttttgtagctgtcatagtggttaccttttagtctggttaatcaccactaccgacgccaatcggttggtggtgaactgtgcagggttggcgtaaccggctaaaaggacccggcgcacctttcggtgcccccacacagcccaccataatacgaatgtggccgtgctatacgcataaaaaaaccgcttgcgcggtgaatgcgccttttagtaatccgggacgccaatcccggcactggatttttccagtgcccgattactatggcacaagaggagtgcgatgtaaatttaccgcaaaggtaataataaatgcataactcacgttatttcaaccctatgtggtttgattgatcccatttcagaaaatacctgcctatttttttgccagtatgcgtatactttcgatagaatgtttaccctagaggtagttgggggtgcccgtgaacacgaagagagctacagtaatgcagcatttgaggaaatcagaaaaaaataaagaccatgaaatattgagtaaggccattgttcgggcttccaataatactgttatacctcatgctgaagagtctggacagaaatttcttattcggtatttcactgaaaatagtgcagttgaggagattttaaaacatcagggaggggaatttaaatgtggaaaactggcagattatgttcgtcgtgaaacgtctgaacaagaagtatattatgctgatattaatcataagtcaggtgtgaaaattgtaataggctattacacaactcccaaaaatgttatgcatgaggtcccaaagatgtccgtcgagaaatctcatgcaatctcgcgcaggatgtttgcacgcactgccgaagatatggctcaggagctctacgacgatgctgaataaattccaggggttggttcaccctggaatttttgggaaggaccctgagctaatacctatcaaaaacgcgttcatagatcactggcgctacggtcatcataaggatttcggaaaggacactctgtttcgggatccaccgaaagagatgctggaatatcacatacgccacgttcacgtaaacatcggaaactatactgacaagtttggtgagagcggtacggaacaatgctggaaaaactgggcatccgggaagaaagacaagaccaccaacaagcataaaaaaataccaaccagtgatgtgtatgtgatttatcttgtaacgtctgagcgacatgcgtttcttctggattactgggatgagccagcacacaaaaaagtagaaattgacgaacaaaaacaaaaacttcttgtcgagtgtgacagaattttgcggctgaaaaatttagaatccatgccgcgcgatgcaagtttgtgggacccggaattttacgactgttaatggccgctcttgcggcctttaaatttaccgggtttgttttcgtaattgttcggcacaatagtcgagatgtgtttgcagatcctgcatagacatctgtgagctggtgacgtagttaatcagtgcagtcagttcggcaagtgggccatcgacattaaatccatccttatcgagatcccggagtaatttcatcaagtgcgatccctccaccagtgacctgacgcctcccggcgtgtgaatcctttcggtaaatccgtcttccagtggatagtgatactgctgcatcttatcttctccatgcaataactgtatatttatacagtagcaaataatttgtttgctatccagcacgttttgcaaattacctgaaaggtaatatctattcgtatttacagcctttctatccatatgtggttttccaggtaatagaataaccagatatgcggcgcaacgggtgctgcgactatctggagatttaacatgacggtctcaaccgaagttgaccacaacgaatacaccggtaacggcgttacgacatcgtttccgtatacttttcgagttttcagaaaatcagacctggttgttcaggtgtctgacctgaacggaaacgtaacagaattggttctggataccggttatacggtaactggggcgggcacttatagtggcggttctgtggttcttccgtctccgcttgctactggatggcgaattacgatagatcgtgtgcttgatgtagtgcaggagacagaccttcgcaatcagggaaaatttttccccgaagtgcatgaagatgcctttgactacctgacgatgctgatccagcaatgttttgggtggttcagacgtgcattgatgaaaccatctttgcttgcaaaatattacgatgcaaagcaaaacaaaatttctaaccttgcagatccatcatttgagcaggacgctgtaaataatcgctcaatgcgtaattatgtcgatgctgcaatctccggggttgttggtggttttggttggtttattcagtatggttctggggctgtgtaccgaacgttccaggataaaatgcgtgatgctattagccccaaagattttggagctgttggtgatggtataaatgacgattccactgcaataagcgcgtgccttgaagcctcatctccaggttataaaattgacggattagggcttacttttaaagtatcaactcttccggatgtcagtcgatttaaaaatgctcgttttttatttgagagaataccgggccagcctcttttttatgcttctgaagattttatccagggagagttatttaaaattacagatacaccgtggtacaacgcctggacgcaggataaaacgtttgtatatgacaatgtcatctatgcgccttttatggctggagaccgccatggtgtaaataacctccatgttgcatgggttcgctcaggagatgacgggaagacctggacaacgccggaatggcttacagatttacatgaaaactatcccacagttaactatcactgcatgagtatgggggttgtcagaaatcgcctttttgctgtaattgagacgcggaccgtgagcggaaataaactgcaggttgcagagttgtgggatcgcccaatgagtcgcagccttcgcgtttatggtggtataacgaaagcagcaaatcagcaagtcgcttatattcgcattactgatcacggattatttgctggtgattttgtcaacttctcaaactctggtgttacaggtgttaccgggaatatgacggtgactactgttattgataaaaatacttttacagttacgacgcaaaatacccaggatgtggatcagaataacgagggtagatactggagttttggtacatcatttcactcgtcaccatggagaaaaaccagtcttggaactattccttcttttgttgacggaagcactcctgttactgagattcacagttttgcgacgattagcgataacagttttgctgttggctaccataatggtgatattggtccacgcgagcttgggatactctatttctctgatgctttcggttctcctggtagctttgttcgcagacgcatacctgcagaatatgaggcgaatgcatctgagccatgtgtaaaatattatgatggcattctgtatctgacgaccagggggacattaagtactcaacccggtagttcattgcacagaagctctgatttaggtacatcatggaattctcttcgcttcccaaataatgttcatcactcaaaccttccttttgccaaagttggcgatgagctgattatttttggcagtgagcgcgcatttggtgagtgggaaggaggagaacctgataaccgttatgcaggaaattatccaagaacatttatgaccagagttaacgtcaatgagtggagtctggataatgtagagtgggttaatgttactgatcagatttatcagggcggaatagttaactctgcggttggtgttggttcagtttgtatcaaagacaactggctgtactacattttcggtggggaagactttctaaacccatggagcataggggataacaacagaaaatatccttatgttcacgatggtcacccggctgatttgtattgtttcagggtgaaaattaaacaggaagaatttgtttcaagggattttgtctacggagccactcctaacagaacgcttcctacttttatgtcgacgtcaggcgtgaggacggttcctgtacccgttgatttcacagatgatgttgccgtccagtcactgactgtccatgcaggtacatcaggacaagttcgcgcggaagtcaaacttgagggtaattacgccattattgcgaagaaagtaccgtctgatgatgttaccgctcagagattaatcgttagcggcggtgaaacaacgtcttcagcagatggtgcaatgataacgttgcatggtccggaagcagtactccacgtcgcgcggtatataacgcactcgaacatctttttgagaacggagatgttaaaccttatcttgataatgtaaatgctcttggtggtccgggaaacaggttctcgacagtttatcttggctccaatcctgtggttaccagtgacggaacattaaagacagagccggtctctcctgacgaagcattgctggatgcctggggtgacgtcaggtatatcgcttataaatggctgaacgctgtcgctataaagggggaagaaggggcgaggatacatcatggtgtaatcgcgcagcaacttcgtgatgttcttatttctcacggactcatggaagaagaaagcacaacatgccgctatgcctttctttgctatgacgattatcccgcagtatatgatgacgtcattactggccaaagggaaatgccgctgactgataatgacgggagcatcattgttgatgaggatgataatccagtgatggtaatagaagacatcattgagcgcgttgaaataacgccagcaggatctagatggggggtcagacctgatctcttattctatatcgaggcagcatggcagcgcagagaaatggataagataaaagagcgggttcagtctctggaagaacgttaaaaaaaagcccgcaaaatattgcgggtatcaaaaacggagttggtgaaaagttatctttgaattctatcatgaatcagtacgtattttaaatacatgttcaggtttattacaccatagcattattaaatacaaaattaagtctatggttcctgtacaactgcccccactctgctggctcgttctgtaaaatcattagtacttttattgagatatatgatatggaacaataatgattcatatatggtttgctatgcgggtttagtcatcaataattgactggcttatagatagtaaacaggagaaagtatgtctgctcaagtaacaagtgagcaattaaatcagttgcttagttttggttctcttgctgcagttattgcaggtgtccctccggaggttgctttaggggctttggctggggcggtaatttttgttacctctgcagtagagtaccccatccgtcgccgggtgctcctgtcgatgctcagctttctttgcggccttctcttttacaaaccagcagcatcaattcttatcggcatagccagcctgatccctaccatcacgcaggactcttttgaaaaagggattgttttctctgcaggcgcattcgtgtcagcaattgtcgctgtgcgtattggtatatggctctatcaccgttccgataatccacgcgagttaattccggggagaaaagacgatggtaacgcatgagttttttttgcttatcactaatgcagttatttgcactggcatagcaattcgcgttgtcacattccggcgtaacggctctcaacatcgaaggtggggaggatggcttgcttatttcctgattgttgctgcggccagtattcctgttcgagtcgcctatgcaatctggttacgtacgccaatggctgtggatttatctgaggtcattatcaacgctgtcatgctggctgcggttattaaaacgcgcggtaacgtcgttcaaatttttaaagtatcgaggtctaaacatggagattaaacaattccagcgagctgctggtatcagcgaggcactggccgcacgctggttctcgcatataacttctgcgatgaaagagtttggtatcagcaaagcagaagatcaggcaatgtttattgctcaagtcgggcatgagtctgggggcttcaccaggttgcaggagaatttcaactacagtgtcagcggactggctaacttcgttcgggctgggcgtctcactcaggggcaggctaatgcactggggcgccgtgctggtgaaccaccattgccacttgagcgccagcgcgcgatcgcaaatctggtatacagcaaacgcatggggaacaatgcccctggtgatggctggaattaccgagggcgcggacttatccagattaccggtttgaataactatcgtgattgcggaaacggtctgaaggttgacctgctggagagccctgaactgctggcgcaggacgaatatgcggctcgtagcgcggcgtggttcttcgccagcaaaggatgcatgaagtataccggcgatattgcacgtgtaactctgattatcaatggtggccggaacggcatcgacgaccggcgagcgcggtacatcactgccagtaaggtgctggcggtatgatctgggcattcgtaaaagcatactggaaacagtttcttatcgtggcagtgcttgctgttctggtcatatcaggagtggttgcctggaatatacacggcagtcgccagtacgatgccgggtatgctcaggcggaagaagacagcaaagccgaagaagacaaagttcgtcagtactacgaacaggagaaagtgaccaatgaacgtgaagctcagcagaggatcgaccaggcgcgcaatgatgctcttgatgctgccgctagcgctggccggttgcagcaacaactctttgccatccgtgagcagctcaggcagtataacgccattgtcggcgctgggtcgtcagccgcagacaccggagttttgcttgccgacgtgctcagcaaatctctcgagagaaacagacaactggcagagtatgctgaccgggcagccgaagccggaagagtctgcgaaaaacagtacgacactttgaccagatagcatggcatttttcatggtactgatttccggtgacggtatataaaacggtacgggaaaaattgagatttggaaaaatgttatcactcaattggttatggttgtcgtaaataattgagtgggaatgatttgaccctgcactatgaatgaacaaaaccctctgttactacagagggtttttttatcctaaagaattataggtttgaagttactaacatcgtttagttaaaccagctatctgatttattctcttctgctttacccacgcttttcatcagatcgcgaccgccttcagtcatatttctgtttgcgtcagcttcagattgcaccacatcggtttgcgcagctttgtgcttcagttcctgatcgataaattcgttttcgcgcttgacgcgggcttcttctttcgccagcgccagtttttgtttctgaatctctaagctacgtagctcatcttcataactttgatcgcgttttttgtccgcagtggcttcggcgtccagtttatcctgacgagctttcttattcgctgctgccgttgccgctcttttattagccgcggcctgggcgtttgcgcgacgttgcttctcttgctggatttccctgttgcgctccgcgacccattcgtcatgctgcctttgctcttcatttttaccttgctgttccgcttctgcgacagccgagagttgatcctgcaatgatgaggcgatagccggatagcttaaggaggctaagatggcgcaaagaaaaactttcttcatgactcctcctgattattagctcttttcaggacatttggtatttggctgaatacgcgtttcgttatacgtcgtggtaataacaacggctaaacctgtcgtaaactggcactctttacccacctgggtggaggtatacactttggtgccttccttatatgttaaagaaacaccttccactaaggttttatcattcaccatagaacccgctgccgcgcctacagctccgccgccaactgcacctgccgtcgttccggaattgctgccagacccgacgttgtggccgataacaccgccagcgacagcgccaataagcgcgccgaaggcttgtgcgttccgtttattttgggcgttgtctacggcaacttttgcgggaagaatggaaataatattaacggttttagtttcttgtttggtattcagttgatcggtttgataaacatcggcggcatgatcatcagcatttgactggcatcctgccagagtgaatgacgctaacattgccacaggcagaagacattttttaaatttcatcactattccttgttatacacattacgaaaaatgagacatttaagatcatcaaaagaggaaagtaaatgtattgcgtataaaggaatagattaaatttattaaaattcatgctggaaataatttataaaaatacatcatcacaacatatgtattaatgatgtatttatttcgcagccgaacaggatgaacttcagtcagaacaaagacgtaaaatttaagatgaaagaatatctgccgctttgataatctcaaagagcaaaagcatccgacagcgaggtgccgttatgttctgtgagagtggagaaggtaaccgctaacgttgtaccggtgattcgacggagagtgtggattgctgagcttcttttttgctctgatggtgctgccaggcaccgacggacgagtagataaaacggccaaagaagaagataaagctgatgagcagtacgatacgggtcatgcgactgttaaatcggtgtcgttttcgcatactggttgcctgactcacaaaaggttccttgaagtatgtcccacgccgtggacggtacttacattaaggcacaacaggacaaaatggtcaattcttcgttatgtaaaaaagcgtcagtggatacatattttaatgttatggaagttaatttaattatttacaatgatgatgtaataatgatgagttaacatgataaacgtaataattcattaatcagggttattttgtttgatatatatcaattggaactttcatatgacacttagaatcattgctctctatagtgatgaataatcatcattcgaagtcaggtgggatgcctgtctgaatacacctccttcaggatgtgggggattctgctgagcatctatgaaactgaatgcaacttatataaaaatacgtgataaatggtgggggcttccgctgttcctgccttctttaatcttgcccattttcgcccacattaatactttcgcgcatatttcttccggtgaagtttttctcttttatctgccactggcattgatgatcagcatgatgatgtttttcagctgggcggcattgccagggatcgccttagggatttttgtccgcaaatatgcagagctgggtttttacgaaacgctctcattaacggctaattttattatcattatcattctctgttggggcggttacagggtttttaccccccggcgtaacaacgtttcacatggtgatagccgtttaatttcccagcgactattctggcagattgtgtttcctgcaacgctgtttctgatacttttccagtttgctgcgtttgtagggttactggcgagcagagaaaatctggtcggcgtcatgccctttaacctcgggaccttaatcaattatcaggccttgctggtgggtaatctgattggtgtcccgctgtgctacttcatcattcgggtggtgcgaaatccgttttatttacgtagctattattcgcaattaaaacagcaggttgatgccaaagttaccaaaaaagagttcgcaatctggctactggcattaggtgctttactattgctgttatgcatgccgttaaatgaaaaaagcacgatttttagcaccaattacaccttgtcattattgctgcccctgatgatgtggggagcgatgcgctatggttataagctgatttcattgctctgggcggtcgtgttgatgatcagcatccacagctatcaaaattacattcccatttatcctggctataccacgcagctgaccataacctcctccagttatctggtattctcttttattgtcaattatatggctgtactggcaacccgtcagcgagcggtagtcagacgcattcagcggcttgcgtatgtggacccggtggttcatctgccaaatgttcgcgccctgaatcgcgcgttacgtgatgccccctggtctgcgctttgttatttacgcatccctggcatggaaatgctggttaagaattatggcatcatgctgcggattcaatacaagcaaaaactttctcactggctgtcaccattgctggaaccgggtgaagatgtttatcagctttcgggtaacgatctcgcgctgcggctgaatacagaatcgcaccaggagcgcattaccgcactggatagccatctcaagcaatttcgtttcttttgggatggaatgccgatgcaaccgcagattggcgtcagttactgctatgtgcgctcgccagtgaatcatatctacctgctgctgggagagctaaatacagtggccgaactttccatcgtgaccaacgccccggaaaatatgcagcgtcgcggagcaatgtatttgcaacgcgaattgaaagataaagtcgcgatgatgaatcggctacagcgggcgctggaacacaaccattttttcctgatggcccagccgattaccggtatgcgtggtgatgtttaccatgaaattcttctgcgcatgaagggtgagaatgatgagctgatcagccccgatagcttcttaccggtcgcgcacgaatttggtttatcgtcgagtatcgacatgtgggtcattgagcatacgctgcaatttatggctgaaaacagagcgaagatgcccgctcaccgttttgctattaatctgtctccaacctcggtatgtcaggctcgttttcctgttgaagtcagtcagctgctggctaaatatcagattgaagcgtggcaacttatttttgaagtcaccgaaagtaatgctctgaccaatgttaagcaggcgcaaatcaccttgcagcatcttcaggaattaggctgccagattgcgattgatgatttcggcaccggctacgccagctatgcgcggcttaaaaatgtgaatgccgatctgcttaaaattgacggcagttttatccgcaatattgtatcaaatagtctggattatcagatagtggcgtcgatttgccacctggcgcgaatgaagaaaatgcgggtagtggcagagtacgttgaaaacgaagagatccgcgaggcggtgctctctttggggatcgattatatgcagggttatcttattggtaagccgcaaccgttaattgatacgctgaatgaaatcgaacccattcgcgaaagtgcctgaataatgcgggccgacatttctcgtcggcccgcaaagcattaagcggcgatttctggtgtactttcttcttcaattttcaaccgccagccagccacgccttcccagtattcttgctccttttccagatcaagcagtaccagcgcattctgactaaaccagtcatgcgggaaacgcagtgtccagtgactgtcatcagtaatcagcgtcaatgttggcggtgtggtagttgcctgacgttgattattgagtaatacgccaaggcgcaatagctgaatcagtggcaggaactgtttcttcttaaacaaggtaaagcgcggcagatcgtcgagtttaatcgctttacggtgatagcgcaccagtgtcgccatcatcagctgctgttcctgattaaaacccggcaagtcgctgttttgcagaatataagcggagtggcgatgcaaaccgctgtggttgatattcaacccgacctcatgcagcatggcggcccatcgcagtagcgcctccagttgtggatgcgccagcttcggttgctgttcccgccactgttcgtacatttgcatagtggtatccagcacccgtcgggcctgttcgctgtcgatgtgatactggttggcgaggctgctggcagtgcgactacgcacatcctgatgacggaaacgtccttccatttcatacagtacgccttcgcgtaacgccccgtcagaaaggcgcagttcacggatggctaaagcatcaaacacaccgcataaaatcgccagtccaggaacgaagactgttttccgctcttcggaaagacctggtaaactcagcgatgcgaaattacggtgccgtaaaacttcttttaccagtttttccagacgttccggggtaattatcccgtctttctcgcccatttccattaacacttcatgggcggcttttatggtaccggaagcgcccattgccacgttccagccctgaattcgaaattgccaggttaacgtttccagtttttgtgctgccgccatgcgagcgcgctgaaaattctctttattgatgaccccgccagggaaataaagctgggcaaagctgacacaacccatccggcggctttcaacgagaatcggttcgaaattttcaccaatcaccagttctgtagaaccgccgccaatatcaataaccagtttgcgacctttttccggttgggtatgttccacgcccataaaaatcagacgggcttcttcattaccggaaataatttcgatcgggtagggaatgactttttccgcgcgtttcagaaagtcagtggcgttcagcgcctgacgcagcgtatgggtaccaactatacagacgctagcaggagaaaacccctgtagcctttcggcaaatagcgacagacagttcaaaccgcgcgtcattgcctcttcactcaacatattatctggccccaggccgtccgccagatgcacccgctgtttcaggcggccaataatctgcatggcaccatctaccacacgggctatgaccatgtgaaaactgtttgaaccaagatcgaccgcagcaaactcctgcggacgaggggatttatcgtgtattggcatagggttattcagattgttcgagtgatttgatgtagtcgtaaatcgccaactgcgcccgtactttgcggcgattgccgcggggaacgtagcgattactgagttctttatcgatataacgtgctttgaccgtatcgctgaacaatatgtcgatgatgtccagcacccgctgcttcaggcgcggatcgagcagcggcgttgccacttcaatacgataatcaatattgcgcgtcatccagtcggcggaagaaaggtagacctttttatcgccgccattttcaaaaatataaacccggtcatgttcaaggtaacggtcaacaatactgatggcacgaatgttgtcgctaatgccttccagattggggatcagagaacacattccgcgcaccagcagattaaccggtacgccggaactggaggctgcatacagacgatcaaccaggcctttatcgacaaggttatttagcttcagggtgataccactgggcagcccttgctgcgcgttggcgatctcgcggtccaccatttcatacaacagacggcgagagttttgcggcgacaccattaaataatcaaatgtcaccggacggtatgggttttcaataaagttgaacacccgccgtacttcgttagtgatgcgcgcatcggcggtcagcaacgaatagtcagtataaagacgcgcggttttttcgttaaagttcccggtcccgatgtgtgcgtaacgcaccacttcaccgttttctttacgtgaaatcaggaacagtttggcgtgaattttcagccccggcgcagagaagataacgtgcacgcctgcttcggtcaggcgcttcgcccagtgaatgttggcttcttcgtcgaaacgcgcctgtaactcaaccaccacggtgactttcttaccgttgtgtgcggcgtggatcatcgagtcgatgatgcgtgaatctttcgctacgcggtagatattgatttttatcgccagcacgctcgggtcgaacgacgcctgacgtagcagttccagcacgtgctcaaaggtgtgataaggataatagagcaacacatcgcgttcgcgaatggcatcaaaaccattgcggaactgggctttatcaaaccaaatatggcgtaaacgcggcagtggtttgttcaccagattggctttgccgacattggggaaattaataaagtctttaaaattatgataacgaccgccggggacgatggagtcgtagcgggaaatagtcagtttttcgcgtaacacttcaaccagagcattgggcatatcgcgctgataaacaaaacgcaccggctctgcagttaaacgctgcttgagactggaagacatcaactccatcagactggcttccatctcatgcactaaatcgtattcggcatcgcgggtcatcttcattgaataggcattcagtgcgtcataatcaaagaagcctttgaaaatatcatcaaggcagtaacgcagaatgttatccagaagaatcatcggcttgcgtcgacgcggcgcttctggcggtaaattcacaaagcgcggcactttatctgatgggatctccagcagcgcgtaacggatggtatcgccacggataatttccaccgccagataggtgtaatcatctttcaggaactgcactaagtcagtgtcaggattgattaaaatcggcgtaatgtgctgacgcagatactgcttaaaataatgacgcagccagttttgttgattgacggagagctggcgttcattaatcaggaagatctggttgcgcgccatctccagcaacagctcgttgtagaggccgtcgaattcctgatcggctttcagcacccgggactgaattttgcccagtaaatggcgggaatgagagttggagccttgttcttcgctaataatgatgcgtcgcttcagttcagcgaagcggactttatagaactcatcaaggttattggaatagatccccaggaaacgcatcctttcaatcagcgggttagatttgtccgccgcttcctgaagcacgcgttcattgaacgataaccaactgagctctttttcgatgtatagcttttcctgacccattaccacttttactccgttttattcacgggacactgcctggatattatggcgagcaatattggcagatgtccaactatgccagaaaagggggaaaaaaactgctggagcttgcgatttacaggtgaattgaaaaacgccagcggcagagctggcgctttaactacgggggcattactcgtcggcagcgtagccctgcggcggcagacgttgaccatccagccacgcggcgttttcgtgcattttcagacgaccatcggcaaaccagctaatcaccagtggataaatagcgtgttcctgggtttgcacgcgggcggtgatgtcatcttccgtatcaccagcaaataccgggactttcgcctgtaaaataaccgggccaccgtccagttcatcggtgacgaaatgcaccgatgtaccgtgctcctcatcgccattttccagcgcctgacgatgggtgtgtaatccgggatatttcggcagcagagaagggtgaatgttcagcaaacgcccggcatagtgggagacaaacgccgggctgagaatgcgcataaaaccagccagcacgaccacatcgggtgcgtacatgtcgatttcatgaatcaactcccggtcataggcttcacgactgtcaaacgcgctggtgatgagcgtatgcgttgcaatacccgcctggcgggcgcgttcaaggccgaacgcgtcagccttattgctgaaaactgcccgtacggtgcctttaattttgttggttttgcaggcgtcaataattgcctgcaaattacttccgttgccggaaataagcaccacaatattcattattcgataaccacgcgttgttcggaatcagaggttttgatgataccgattttccacgcgttttcaccgttggcattgagcagggcgagagctttgtccacttccggagcaggcagggcaataatcataccgacgccgcagttgaaggtgcgatacatttcatggcgctcaacattacctgccgtttgcagccagttgaacacttccggccactgccaggaagattcatcaatcactgcctgggtattatctggcaatacgcgcggaatgttttcccagaagccgccgccggtcaggtgcgcaatggcatgcacatcgaccttttcaatcaactccagcactgacttcacgtaaatgcgggtcggtgccagcagatgatcggctaatggcttaccatcaagttcggtggtttgcggatcacaaccgctgacttcaagaattttgcgcaccagcgaatagccattcgagtgcgggccgctggagccgagtgcaatcagcacatcgccgtcgctgactttagatccgtcaatgatttctgatttttctaccacgccaacgcagaaaccagcgacatcgtaatcttcaccgtgatacatccccggcatttctgccgtttcgccacccaccagtgaacagcccgattgcagacaaccttccgcgatgccgctgatcaccgctgaagcggtattaacatccagttttccagttgcgtaatagtcgaggaaaaacagcggttccgcaccttgcaccaccaggtcattaacgcacatggcgaccagatcaataccaatggtgtcgtgacgttttaagtccatcgccagacgcagcttggtacctacgccgtcagtgccggaaaccagcacaggttcacgatatttttgcggcaatgcacacagcgcaccgaagccgcccagaccgcccatcacttccggacgacgcgttttcttcactacgcctttgattcttccaaccagagcattacccgcgtcaatatcaacaccggcatctttgtagctaagagaggttttatcggtcactgcttgggtccccacgcgttacttgcggtagaaaaataaaattcggcgcaattctaacagggaaagcaaacgtttgcgagactgctttacacaacctttttgcacgtcttttccccaggcgcgcggcgaaagaatacttgtaccagggcaaaggatcgttttcggatggaataatcttctttcataaccatttgaatataaaataactttatctaaaaccgttatcgttttgactaaagtcaacgaaaataatattgccgccttgaagaaaggaggtataatccgtcgatttttttgtggctgcccctcaaaggagaaagagtatgaagatcgtggaagtcaaacacccactcgtcaaacacaagctgggactgatgcgtgagcaagatatcagcaccaagcgctttcgcgaactcgcttccgaagtgggtagcctgctgacttacgaagcgaccgccgacctcgaaacggaaaaagtcactatcgaaggctggaacggcccggtagaaatcgaccagatcaaaggtaagaaaattaccgttgtgccaattctgcgtgcgggtcttgggatgatggacggtgtgctggaaaacgttccgagtgcgcgcatcagtgtcgtcggtatgtaccgtaatgaagaaacgctggagccggtaccgtacttccagaaactggtttctaacatcgatgagcgtatggcgctgatcgttgacccaatgctggcaaccggtggttccgttatcgcgaccatcgacctgctgaaaaaagcgggctgcagcagcatcaaagttctggtgctggtagctgcaccagaaggtatcgctgcgctggaaaaagcgcacccggacgtcgaactgtatactgcatcgattgaccagggactgaacgagcacggatacattattccgggcctcggcgatgccggtgacaaaatctttggtacgaaataaagaataaaaataattaaagccgactttaagagtcggcttttttttgagtaaagcgcctataacacataatacagaggataatactatgacgcgccgtgctatcggggtgagtgaaagaccgccacttttacagacaatcccgcttagtttgcaacatttgttcgccatgtttggtgcaaccgtcctggtgcccgtcttatttcatattaacccggcgactgtactgttatttaacggtataggaacactgctgtatctcttcatctgtaaagggaaaattccggcttatcttggttccagctttgcctttatttcaccggtattgttactgttgccgttggggtatgaagtcgcgctgggcggctttattatgtgcggcgtgctgttctgcctggtttcttttatcgtgaagaaagcggggaccggctggctggacgtgctgtttccacctgcggcaatgggcgcaatcgttgccgtcatcggtctggagctggcgggcgtagctgccggtatggcgggtttactcccggctgaagggcaaacgccagactccaaaaccatcatcatctctattaccaccctggcggtcacggttttaggttccgtgctgtttcgtggtttcctggcaattatcccgattttaattggcgtgctggtggggtacgcgctctctttcgcaatgggaattgtcgataccacgccgattattaatgctcactggtttgcgctgccgaccctctatacgccgcgcttcgagtggtttgccattctgactattctgccagcggcgttagtggttattgccgaacacgtagggcacctggtcgtaacggctaatatcgtcaaaaaagatctgctgcgcgatccaggtctgcaccgttcgatgtttgctaacggcttgtcgaccgtgatctccggtttctttggttccacaccaaacaccacttacggagaaaacattggcgtgatggcgatcacccgtgtttacagtacctgggttatcggcggtgcggcgattttcgctatcctgctttcctgcgtcggtaaactggctgctgctatccagatgattccattgccggtgatgggcggcgtttcgctgctgctttacggggtcatcggtgcttccggtattcgtgtgttgatcgaatcgaaagtggattacaacaaagcacagaacctgatcctgacttccgttattttgatcatcggcgtcagtggcgcgaaggtaaacattggcgcggcggagctgaaaggtatggcgctggcgaccatcgtcggtatcggcttaagtttgatcttcaaactgattagtatgctgcgccctgaagaagtggtgctggacgcagaagacgcggatataacagacaaataatgtaccgaccgggcagtgttgctgcccggttcaaacatcatgggattctgtggtaaacttctcgcgattttgtgaaatcctggttgaggtatctctgaacacaccggcacagctctctttgccactttatcttcctgacgacgaaacctttgcaagtttctggccgggggataactcctctttactggccgcgctgcaaaacgtgctgcgtcaggaacatagcggttacatctatctctgggcacgcgaaggcgcggggcgcagccatctgctgcacgcggcttgcgcggaattgtcacagcgtggcgatgcggtgggctatgtcccgctggataaacgcacctggtttgttccggaagtgctcgacggtatggagcatttgtcgctggtctgtattgacaacattgagtgtattgccggcgatgagttgtgggagatggcgattttcgatctctacaatcgaattctggaatcgggcaaaacacggttgttgatcaccggcgatcgtccaccgcggcagttgaatctgggattaccggatctcgcgtcgcgtctcgactgggggcagatctacaaattgcagccactttctgatgaagataagttgcaggcgctacagttacgcgcgcgtttgcgtggttttgaactgccggaagatgtggggcgtttcttgctgaagcggctcgacagagaaatgcgcacgttgtttatgacgctggatcagctggatcgtgcgtcgattaccgcgcaacgcaagctgaccattccgtttgtgaaagaaattctgaagttgtagataaggtgtttattgtcggatgcggcgcgaacgccttatccgacctacgcgaagttaatccatagtattcgtaggccggataagacgcggcaagcgtcgcatccggcaatgtgcttcaactagcgatggagcacatcttaacccacgatttccagtacctgctccggtggacgaccaatccgcgctttgccattcgcgaccacaatcgggcgttccattagcttcggattctctaccatcgcctgaatcagcacctcttcgctaagcgaactgtcagccaggttcagttctttataaagatcctctttttggcgcatcaattcacgagcgctattcatccccagcattttcagcaaatcacgcagcgttgccgcatcggcgggtgtctcaaggtagagcaccacttctggctccacgccgttttctttcagcaggttcagcgtttcccggctctttgaacagcgtgggttatggtagatttttacctgtttggtcattgttcttcctttaatgcgaattacatcttggtataaggcttaaagcgttcctgcagctggcgcaactggtcgatgcgcgcatcgtaacgcgcttgttgcaggctgcctaatttcacctgcgaactggcgctactcaacaaggaaatagcctgatcgagtcgcccggcgagcgcataaccttctgctcgcgcagccagttcctgatcgcggttatttagtgcggcttccgcctgtgccagtaaatcccagccgttgctgtcatctttattgttaaaagtgtagcgattcagaatattggccgcttcctgtggttgccccccttgcagataagcgttcgccaggttgagctgcaacaccggattggtgcgcaaatcgcgggcatttttcaggcgattgatagcgtcattggctttgttttgcccaagatcgatatcggtagccagatcgagataccatgcgttgccaggttctgccgccagtaacggttgcagcgttttacgcgcctcgtcgtatttattggcttccatcgcctgtaaagcacgaccatattgcgccgctcgttgctgacgaacgtttcctttcgcccattcatccagcaaatcactggtgagttggttacgccctgaattgtacatccccagtgtgcgcacttttgccagatagaaatcttctgacgattgcaccactatcgggcgcatctgattggcacggttacgggcatcagccagacggctttccggtagtgggtgagtgagcagaatttctggtgggcgcgaagagtaacgcgcctgatcgagtaatttttcgaggaaggtcggcatcgcctgcggatcgaatcccgagcgttgcagcacctgaataccaatgcggtccgcttcctgttcattttgctgggtgaaactgatcatcccctggcgcgttcccgccagtgtaccggtcagcgccgccatccccgcctgcggactggccatcgccagtaaaatagaacctaacgcgccgacccaggtcagcggcgcgctgcgctgctgatcttccatcgctcgcgccaggtgacgttgggtgacgtgggagatttcgtgcgccataactgaagccagttgactttcgttatcggaataacggaacagggcagagtgcagcaccacgttgccgccaaagaaagcaaaggcgttaatttcatcgttgttgatcagaaagaaatgaaacggtgtcttaaccgaattggcatgcgaaaccagacgcattcctagcgaattaatgtattgcgttaacagcggatcattaattaacggcgcgctgccgcgtaactggcggacataatagtcgcccatctgcatttcctgaccaatggaaagtgtgcttcctgcggaggttcccatatccggcaaggtgtctgcgctgtcggcaaacgccggggctacctgaccaatggtcatagcagcaatgagggttgcaaccaggttttttttcaactgcctgaacataacctctatcctgtatttctggagatagtcatttgaccgatactgtgaaatatcgttcccaccgcgccgcctttgagtgtaacggcgaagattagcccactcaaatgacttttcagtttcctgaatccgtcataaaaagcgaagtcttttttgtgacatttcgatacaattgcggatcgcaatcccgctcttgaggttcagggaaggtctgtatgctcgaaatgttgatgcaatggtatcgccgccgttttagcgacccggaagcgattgccttgctggttattttggttgctggttttggcattatctttttctttagcggcctactcgcgccgttgctggtggctattgtgctggcctatttactggaatggccgactgtccgcctgcagtctattggctgttcccgcccttgggcgacatctatcgtgctgatcctgtttgtgggcatcctgctactgatggcgttcgtggtactgcctatcgcttggcagcagggcatctacttaatccgcgatatgccggggatgctcaataagctttctgactttgccgccacgttgccgcgccgctatccggcgttaatggatgcgggcattattgatgcaatggctgaaaatatgcgcagtcggatgctgaccatgggcgattcggtggtgaaaatttccctcgcctcgttggttggtttgctgaccattgccgtctatctggtgctggtgccattgatggtcttcttcctgctgaaagacaaagagcagatgctgaacgccgttcgccgggtgctgccgcgcaaccgtggactggcaggacaggtgtggaaggagatgaatcaacaaatcaccaactatatccgcggcaaagtgctggagatgatcgtggtagggatcgccacctggctggggttcttgctctttgggctgaactattcgctgctgctggcggtgctggtcggcttctcggtacttattccgtacattggcgcatttgtggtgaccattccggtggttggcgtggcgctattccagtttggtgctggcacggaattctggagctgcttcgcggtgtatctgattattcaggcgctggacggcaacctgttagtaccggtgttgttctccgaagcggttaacctgcatcctctggtgattattttatcggtggtgatcttcggtggtttgtggggattctggggcgtattcttcgctattccattggcgacgctgatcaaagccgtgattcacgcctggcctgatgggcaaatcgcgcaagactgaccttcagcgaaaaaattttaaacgagtgttgcagggcagtgagaagatttgagatgtgctggccgcaagcgcagccagcacggaatggagcaaagtaatcaggcgtgttctttcagccagttcagcacaacgtcgtggtgattgctggttttgaaatcgtcaaagacatgttcgattttgccatcagcgtcaatcaggaagctgatgcgatgaataccatcgtaggttttgcccatgaaggacttttcaccccagacgccgaattgttcgcacacctggtggtcctcatcagacaggagcgtaaagttaagcagctctttttccgcaaaacgggagagtttttcgggtttatcggtgctgatacccagcacatcaacgcccgcttttttcaactcatccatgttatcgcgtaagccgcaggcctgtacggtacagccgggggtcatggctttcgggtagaaataaaccagaacacgctgtccctggaagtcggtcaaattaacttgttctccgtcttgatccggcaagctaaatttcggtgcgatatcaccggctttcagtggattcattacttaactccatcctgttcatcatgttgggaataattgacgacgttaatactgccttgtgcattgagttctgtacatagggctttgaacgcttgctcaatatttgctgcgtccgcagatgcggggctgtgggcagttatctgaatatgcaactgcgcagccctttcattttcagcaggttgcgtgcgcgacaccagctccgcaatgttcatatgatgcgcgtcgaaaagtgctgtgaagcgttcaattaaatgcggggagtctgccacatcgacctgaacccagacagatgctggcattggcggacgcggacgcgccgtcgtgcgcttcatcacgattaaaagatccagctcggcacctttcaacggtaacgttgattcaatcagagtaatggcattccatgaaccggaaagcagcatgataaacgtgaactcttctcccagcatcgccaggcgactgtcttcaatattacagccgcaactactgacatgacgggtgatggtgttcactattccagggcgatcggcacccaacgcagtgatcaccagataatgttgcgatgacagtgtcaaactggttattccttcaaggggtgagttgttcttaaggaaagcataaaaaaaacatgcatacaacaatcagaacggttctgtctgcttgcttttaatgccataccaaacgtaccattgagacacttgtttgcacagaggatggcccatgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggagctggctgacgggcgcattccggtgattgccgggaccggtgctaacgctactgcggaagccattagcctgacgcagcgcttcaatgacagcggtatcgtcggctgcctgacggtaaccccttactacaatcgtccgtcgcaagaaggtttgtatcagcatttcaaagccatcgctgaacatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattaggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctgtaaagtttagggagatttgatggcttactctgttcaaaagtcgcgcctggcaaaggttgcgggtgtttcgcttgttttattactcgctgcctgtagttctgactcacgctataagcgtcaggtcagtggtgatgaagcctacctggaagcggcaccgcttgcggagcttcatgccccggctggaatgatcttgccggtgacctccggcgattatgcaatcccggtgaccaacggtagtggtgccgtcggtaaggcgctggacattcgtccaccagcccagccgctggcactggtttctggcgcgcgtacccagttcacgggcgataccgcttcattgctggtggaaaatggtcgtggcaatactctgtggccgcaggtggttagcgtgctgcaggcgaaaaactacaccatcacccaacgtgatgatgctggtcagacactgaccaccgattgggtacaatggaaccgtctggatgaagacgagcagtatcgtggtcgttatcaaatctctgttaagccgcagggttatcagcaggcggttacggttaaactgctgaacctggaacaggcgggcaaaccggttgcagacgcggcgtccatgcagcgttacagcacggagatgatgaacgttatttccgccggtctggataaatctgccactgacgccgcgaacgctgcgcaaaatcgtgcctccaccactatggacgtacaaagtgcagctgatgacaccggtttaccaatgctggtcgtacgcgggccgttcaatgtggtttggcaacgtctgccagctgcgctggaaaaagtgggcatgaaagtgactgacagcacccgttcgcagggcaacatggccgtaacttataagccgctgtctgacagcgaatggcacgaactgggcgcgagcgatccaggtctggcatccggtgactataaactgcaggttggcgatttagataaccgcagcagcctacagttcatcgatccgaaaggtcatactctgactcagagtcagaacgacgcgctggtagctgtcttccaggctgcgtttagcaagtaaaaatacagggctggagtcatccggcccttttttctgatatgatacgcaaacgtgtgcgtcggcagaaaaacgcgattttagcggtaattcgcacgaaatttgtttgtcggacgtaggtcggataaggcgttcacgccgcatccgacaaaacatccggcacaccagacagcaaaagattttaaaacgttaattcacacccaggagtgataaagatgcaaaagcaagctgagttgtatcgtggtaaagcgaaaaccgtatacagcacggaaaacccggacctgttggtgctcgaattccgcaatgatacgtcagcaggggatggcgcgcgcattgagcagtttgatcgcaaaggtatggtgaacaacaagttcaactactt

SEQ ID NO: 10004 - DNA, 45864 bp, Escherichia coli
ttttttatatccatctgcaggccaaaattcggcctgcaaagtacaaatgtttattttgaagctggagtaaacagcgcagaatagtctgtattgcagatacgctgtactgcagggtgctgaatcatcctttcggcaaaaatcgcgtggtactcttccatcacgttctcaacacggcctatctccacaaccgagtcatcgttatagaaatcattagcgtaaagcgaaggtgcaacgaaaatagcgttatgcgtcgccccaaaggctttcatcaacgcagcatcatcaaactcacccaaaatttcgacgttcaagccctgggagttaaaccagtttaatagcttacgccccaacattgagcgacgccccggaataagtaaacgacgctcttcaagacaggcaggaaacggcttttctggtagtgggttagtgcaccagaaactgacaccacattcgccaattttcatggaaaacagcccttcctgctgagtggaatcgatcggacagtcagagatgatcatatccagtttatgctgactcaactgctctaaaagcatctcgtgcgtcgattcgaaacagcgtagatggatctgctcgtcttccacaactgcggcatccagaacactgctgaccagacgtttggaaagtgcatctgccacaccaacatcaaacaataagttggactctttgcgatagttgacgatatccagcatttcctggcttaaggtgaacattttatcggcatagcgatagaccagttcccccagttcgctgggttccagaccacgtcctttacgcttaaatagtttcccttgcaggcgctcttccagcgcccggatctgcccggtaatggtttgtggtgttaaataaagcgcctccgctgcgccaaccacagaaccttctttgtagacatgccagaagtaatacaagtggttgtaattgatatgagacatgctcatttctctccctgataacaatgaaaagggagccgtttatggctccccagtacatcgtcctgtcaaactgatggacgtaaacgaacgcgtaaccagctatatccaattaccgccgaagaaattgaaccgacaaggatacctaattttgcccagttaatcagttctggatctacgctaccaaatgccaggctggcaataaagatagacatagtaaaaccgataccgcacaggataccaaccgccataatttgctggtaagtcgttccctctggcagatgtgccaatttcaaacgcagcgccaaccagcagaacagactaatacccagtggcttgccaatcagcaaaccagcgatgatccctaatggcaggatggaggtcaaaccttccagcgtgacaccttgcagtgaaacgccagcattagcaaatgcaaacagcggcaaaatcagatacgccacccatggatgcaaaacatgctccagacgtttagccggagagcgcccatgcttctctttcaaaggaataaagaagccgacaatgacgccagccagggttgcgtgaacccccgatttcaacaccgctgtccacagcaccacgccaaccagaatataaacgcccgtgcggcgtacaccacacagattcaataccacgagtaccgcaattgctacagccgcgacgccaagagaggccatcgataagtcattagtgtagaacaatgcgatgataatgatggccccaagatcgtcgataatagccagagccatcaaaaagatcttcagcgctaacggaacacgacttcccaacagcgccaacacaccaagtgcaaaggcaatgtcagtcgccgccgggattgcccagccttcgcgggtaatcggatcggcatagttaaaagccagatagagcaatgccgggacaatcatcccgccgattgcggcaataacaggaaatgccgcctggcgcagactggccagcgaaccttgcatcagctcgcgtttaacttccagaccaaccaacaggaaaaataccgccatcagagcgtcattgatccatagcagcatgttcttgttgatctcaagtgtcccaacccggagctgaaccggcgtctcaagaaagtcgtgataccatccactggttgcaccgctgttggccataatcatcgctaatacagcggcaataatgagaataatgcctcccgaggcatcactgctaaagaatcgatgcagatgtttcactttttatttctcttcaggtgaatagatcgttttcacgattttaccccgcacgaatcatcgttaaaatcagattatagtgtaggaatagctcgctttttacgatctattaaaagaattgcgccatcagcgagagatgagtttttgatgcccgaaagcggcggctgatgaccttaaaccccattaatcatagtctaatgtcaagatttctgaagaaattattcggaaaagtaataattaaattgttccatgctctagttttttattccacagatgtttgaggatatctaatgtagaaacgacattcgcaggagacattcggttcaatgatataaggaaaggatggttctccacaaagtggataaaacgcgtcgcactgttcaatgttgcatgccgcatctcgcggactttcttactgccagtgagattgcatacagccattgaataattgcggttagaaaatgcacgccagacattatttcgtaccccaccactaaggaataatcgcggtggaaaatcaatggtggcgggtgccacaccgcgctctttgacaaaggaaatatggcagcgaccttgaggaatatgctgcaaattagccatcaggcagccgcccaatataaagcattcgtgatcaaggtaatgctgaacgttgttggaatgctcatcggtcagtattctgaccagttcaaaatgacgatatgccggaagaaccggttttaccaacattcccggatcgttttgatgtaaaactgccgggccgtaatcaatatcaaacaaggtatcccgccgcatagtaagtaactctttgcgctggacatgatgtgccagcgtccctggagacatacgctcttcatagttcgatgtgtattgataatgttgctctacggcagatggggagtaattggttgagatggcaaccaccctgccgctttgttcttctgcggtaacaagagcataaagagagttattgctaccattatacttgacgcgaaaagcgcgggtactcagggtaatatcagaagctgggaaacactgtcgactttctttatagtttgcttcacgcgctaattttaacagttcacggctaagtccagtgctgttaagaagtaatgactttctgatatccgcaagtgcctccccttgctcaatcatcaatgctaacagggctcctcgtggtgtggtaattacatgttccagagtgataaatgttttctcacaatgatggcaatacattcttctctggccttgtgcagaatatccatattttttgagggacgtgcctccgcaagttgaacattggcaaatcaaacctctccaggagtgattcacaatattacgataaatattaagcgactgttcagatatcactggaaacaagtaaccacattcacggcataaaatatttttaccctgtgcgacataatcctggctattcagcaaccccaggtttttacatcctggtgttttgcaacaatcaacatttacgttggtaaacatatccactccctgcgaatagccgtatcttgatattgttcaacgcgaaaagaacctgattcaatgcgtagcactgaatcaggcgggcatagccctaaatggcatacattacatttattatgattatcaggttagccccaggtcaccgcttctggtttatcacctctggctttcattagagaatcattatcaatatcagttttatattttaaaaacttaccatacatctgtttttcaatatctggttttttaccgatcagattaagtgtttcataacgatcagatttcagattgtagagatatttcggtttattattgcgatcgataatcatcttccagtcaccatcacggatcgcccattcatcggttggatcatcctggaatggcatatcaatcccgaaaattaatggcttttcgcgtttcaatgctttttgctcaagaacaggaaccagcgattcaccatcgaaagtacggtctgtaggtaatttgaagttcatcattttcgctaaagtaggcatccagtccagaccataaacgggtgtatctgaaaccattccctgtggtagatgtttaccatatttaataatggctggaacacgaattccgccttcccaaaggttatccttgcgaccgcgtaatccatccgtttcccctgccaaattcagctcatacactttgcgcgcttcacgcgttaccggaccgttatcactggtaaaaataacgattgtgttatcttcttcacccatcgctttgattttatccagcacttttccaacctgtgcatccagatagctgatattggcataatattcccccacaccacgccagggtttgtctgcccagtcgccataaaataaatcaggatgctgcttctgatacgcgctcatatattgtgagtacatgtcgaggtattttttgggcgaagccagggggctatgcacttcggtaaaagcaacatagaggaagaaaggcttgctgtcctttttgttatccagccagttgacgacttccgaactgacatactcaccgctcattttatcggctcgtggagtgggttgcccgttacgtagccagcctgtcgggtaaaccatgccataacgcgggcgttctttagcgttatccagcgtggcgtcggtaacaaaacccgccgtattaaccagtgagtaatcaaagcccatatcttttgcctgcggctgatcggtgcgatcgccgcctgcattcagatgcagcttacccatcatggccgtgtcatacccttgcgctttgagtagattagcaatcgtgagttcattacgccctaatgccacatcttttcccgttgggatccatgaacgtatgccggtacgaaatggcatccgccccgttaataaccccgcccgcgaaggagaacttaagggagctggtgcatagtagtcagtaaatttgacgccctcctgggcaagcctgtcaatattgggtgttttaacgatctgatgtccatatgttgctaaatcaccatagcctaaatcatccgccataatgatgactaaattgggttgtttagtctcggcagctacgactggattaaaagcattccctgtgcaaactgcaaggccgatcaaactggccattaatgttttctgcataattattccctgatgaaaattagaaatcataaccaagcatataaatcatttgatcgccaaaaccatcgtagcccaacttattatcgaaataacgccacgtcacactggctttccagcgaggatagaacttccaggctactgttaaaccgccatttagcccattccgaccaaattgttgttccgcataggcatcatttctgtccagttctatttcattccagttagataaaacaaatttttcgtcaaataacgtaaaaggtaatactgctgtccagccaacaacataaccattccagccatttgtttgtccatatttggctgagacgtagtctccagattgattatgtaatccaatatacggtttaaaaaacccccatgaaccattccagccgaggtagcccaaaccataaaacatatcaagatcgtcaccccatgagttatcccattgaccatagatcttgccaaagaaagtcatattggagtcaaagagtctgacatgtgtcatagcagaaacggtatgattacgccccgctacggcatggttaagcacattgctttcataaaatgagtaaaactcggcttctttaaaattcacaccaaagtctgcagtcactttccatacttcaccacgatgagtgttaatgaagccactattccagtcagcataacctgcatttattgagccaaaggaacctttatattctaatgaagaatatgcaggaaggtgatagaaaatcgttgtcagggcacacgcaataagaagccgtcttttggcagacatataatatgctctccattcattttttttatggttccatagaaatcaatacatcagataattcattttgattaagaacgactcagaaagtatatttaaaggtgaatggcaaagcgtgatggagatcgcagattacttttacccccgggtgtggaggtatcgtgtttcaaaaagtgtgtcgattttaaatatcactcattgatttataaacatttttcctcacaaaaagaaaattcaattctgtacaagaatattttgtatcttctattactttctccagtaataactcaccattcaggcataacttaaacctcttgttcataatctcaacttttgtaaatgaaaacgcacataagagttaaaataaacaatgtactaaagattgattacgcaaaaatgcgaggcgtcttcaggattagaatcgataaaacagaatgggttaaagagagcgatataatagcggcgggtgcttgaggctgtctgtctcaggcattagctgaacggcagatagagaaaagccccgagtgatattttaccatcaacccgaggccccctatatgcagaacacatgtagagtgcctcttactgaccgtaaggtcaaggagaagagagcaatgaagcagcataaggcgatgattgtcgccctgatcgtcatctgtatcaccgccgtagtggcggcgctggtaacgagaaaagacctctgtgaggttcacatccgaactggccagacggaggttgctgttttcacggcttacgaatccgagtaagagcaacggcggggagtgatccccgccactttacaggtgctcgcatatcttcaacgcaccctggtttttaccctggcctgcccacgggcaggcttttggggaggttagcgagtcaggtcgtcaaaaaacttcttcacgccatcaaagaagctctttgaacgcgggctgttgtgctcgccggttgggccaccaaagctttcttgcagctcttgcagcagctgtttctgcttctcgttcaaacctaccggtgtttcgacaacaacgcggcatagcaaatcaccctgtgcgccaccgcggacagacttgacgcctttaccgcgcatacggaacagcttaccggtctgggtttcgccaggcactttcagtttgacgcgaccatcaagggtcggtacttcgatttcaccacccagcgccgccatagcgaagttgatcgggacttcgcaatacaggttgttgccttcacgctcgaaaatcgggtgctgtttaacctgaacctgaacgtacagatcgcctgccggtgcgccgtgttcacccgcttcaccttcgcccgcaagacggatgcggtctccagtgtccacccctgccgggattttaacggacagcgttttgctgcgctcaacacgaccatgaccatgacatttgttgcacggatctttgatcagcgtaccgcggccctgacagtgtggacaggtctgctgcacggcaaagaaaccctggcgcatctgcacctggccagaaccatgacaggtcggacaggtctgcggctgtgtacctggttttgcaccgctaccgtggcaaacgtcacactcttccagagtcggaatgcggatctctttggtcacgccacgtacagcttcttcgagggtgagctccatgttatagcgtaaatcagcaccgcgcgccgcacgttgacgaccacgtccgccgccaaaaatatcgccgaaaacgtcaccaaaaatatcgctgaagtctgcgccgccgccaaaaccgccgccgcccatgccgccttgctcaaacgcagcatgaccatactgatcgtatgccgcacgtttttgcgagtcggtcagaacttcataagcttccttgatctctttaaatttcgcctcggcctctttgtcaccctggttacggtccgggtggtatttcatggccaggcgtttgtaggcctttttgatttcacgctcttccgctgttttggaaacgcctaaaatctcgtaataatcttgcttagccatcttttttgatttgcccctagatgaatgcacgggcggagaggaaattccccttcgcccgtgtcagtataattacccgtttatagggcgattattttttgtctttgacttcttcaaattcagcgtcgacaacatcgtcatctttcgcgttgtttgcagaagcatcagcaccggcagtctgctgctgggcatgttgctgctgggcgatttccatcagtttctgggaaacctgtgccagttcctgcattttcgcttcgatagcggctttgtcttcacctttcagagcagtttccagtgcagtcagcgcagactcgatagcagttttgtcgtcagccggcagtttgtcgcctgcttcttcaacctgcttacgggtgctgtgcagcagatggtcgccctggttgcgagtctgtaccagctcttcaaacttacggtcagcttcggcgttagcttctgcgtcgcgtaccattttctggatttcatcttcgttcagaccagaagaagccttgatagtgatcttctgctctttaccgctgtttttgtctttcgcggaaacgtgcaggataccgtcagcatcgatatcgaaggtaacttcgatctgcggcatgccgcgcggtgccgggttgataccatccaggttgaactgacccagagatttgttatcagccgcacgtttacgttcaccctgcagcacatggatggttaccgcagactggttgtcttcagcggtagagaacacctggctgtgcttggtcgggatagtggtgtttttcgcgatcagcgtggtcatcacaccgcccatggtttcgatacccagagacagcggggtaacgtccagcagcagtacgtcttttacgtcaccagtcagaacaccaccctgaacagcagcaccgatggctacagcttcgtccgggttaacatctttacgcggctctttaccaaagaattcagcaactttcttctgaaccattggcatacgagtctgaccaccaacgaggataacgtcgtcgatatcagatacggacaggccagcgtcctgcagtgcaactttcagcggctcaatggaacggtttaccagatcttcaaccaggctttccagtttcgcacgagtcactttgatgttcatgtgtttcggaccggtcgcgtctgcagtgatgtacggcaggttaacgtcggtctgctgagcggaagacagttcgattttcgctttttctgccgcttctttcaggcgctgcattgccagcggatcgttgcgcaggtcaatgccctgatctttcttgaattcttcaaccagatagttgatcagacgactgtcgaagtcttcaccacccaggtgggtatcaccgttggttgccagaacttcgaaggttttttcgccgtcaacttcgtcgatttcgataatggaaatatcgaaagtaccaccacccaggtcataaaccgcgatagtacggttgccagtacctttgtccagaccgtaagccagcgcagctgcggtcggttcgttgatgatacgttttacttccagaccagcgatacggcctgcgtctttggttgcctgacgctgagcatcgttaaagtatgccggtacggtaataacagcttcagttaccggttcacccaggtaatcttcagcggttttcttcatttttttcagcacttcagcagagatctgcggcggtgccattttctggcctttaacttcgacccatgcgtcgccgttatcagcagcaataattttgaacggcatgatggaaacatcacgctgtacttcttcgtcctggaagcggcggccaatcaggcgtttaatcgcaaacagggtgttttgcgggttcgtcactgcctgacgtttagccggctgaccaaccagagtttcaccatcctgggtataggcaatgatagaaggcgtggtgcgatcgccttcggcgttctccagtacacgaggagtggtgccatccataatcgctacacaagagttggtagtacccaggtcgataccaattattttacccatctaaacgtctccactatatattcggtcatcatgtggttgtgagtctgtaataggggcgaaacgtctggtttcaactgcccaatttcatttttttgcagactcactcactgcggttgactactaaatggggtcgtaacccacgtcatcaagggggagatgcaaaaattttttgtgcttttgcgcagaaatttcgcgatatggcaggacaagacgtgaaactgacaacaattttattcatataaagaatgaatcgcagccaaggcattcatcaaaaaattgtaataaaaagaaaatattacgtacctgaaacttctctttatcagcagtaaactagtttcatccccttacccctccccaccaagagaatccttatgaaatccgttattacgatttccgccagcctggcgattagcctgatgctgtgctgcacggcgcaggcaaacgaccataaaatcctcggcgtcattgcaatgccgcgaaacgaaaccaacgatctggcgctgaaacttcctgtttgtcgcattgttaaacgcatacaactctcagccgaccatggcgatttgcagttaagcggtgcatcgatttatttcaaagccacccgaagcgccagtcagaccctgaatattccttcagaaataaaagaagagcaaaccactgactggatcaacattaacagcgataacgacaacaaacgctgcgtctcaaaaatcaccttttccggtcatacagtgaactcatcggatatggccacgctgaaaattatcggcgacgactaacgccagaatatagaaaccacaaaaaatgaatgttaattacctgaatgattcagatctggattttctccagcattgtagtgaggaacagttggcaaatttcgcccggctgctcacccataatgaaaaaggcaaaactcgcctctccagcgtactgatgcgcaacgaactgtttaaatcgatggaaggacatcccgagcgacaccgccgcaactggcagctgattgccggagaattacagcattttggtggcgatagtatcgccaacaaactgcgcggacacggtaaattgtatcgcgccattttgctcgatgtttcaaagcgattgaagctgaaagccgacaaagagatgtctacgtttgaaattgagcaacagttactggaacaatttctgcgtaatacctggaagaaaatggacgaggaacataagcaggagtttctgcacgcggtcgatgccagggtgaatgagctggaagagctgctgccgctgctgatgaaagacaaattattggcaaaaggtgtgtcgcatttgctttccagccaattgacccgcattttacgcacccacgcagcaatgagcgtgcttgggcatggtttgctgcgcggcgcgggtctgggaggccctgtgggcgcagcattaaatggggttaaagcggtcagcggcagtgcctatcgcgtgacaattccagccgtactgcaaatcgcctgcctgcgccggatggttagcgccactcaggtctgataccggaaaccggggaaaattttcattttcccctcaaaagatcgtagacactgccccactggctgattattatgccgcgccctgaaaacactacagttattcagggaaattatttcaccattcattcgatgatgatttttgaggaattatgggcaacactaagttggctaatccggcaccgctgggcctgatgggcttcggcatgaccaccattctgcttaacctgcacaacgtgggttattttgctctggacggtattattcttgccatgggcattttctacggcggcatcgcgcaaatttttgccggtctgctggagtacaaaaaaggcaacactttcggtttaaccgcattcacctcttacggttctttctggctgacgctggttgcaattctgctgatgccgaaactggggctgaccgatgcgccaaatgcacagttccttggtgtctacctgggtctgtggggcatatttacgctgtttatgttcttcggcacgctgaaaggcgcacgcgttctgcaattcgttttctttagcctgaccgtgctgtttgccctgctggcgatcggtaacattgccggtaacgccgcgatcatccactttgccggctggattggtcttatctgcggtgccagtgcaatctatctggcgatgggtgaagtgctgaacgagcagtttggtcgcaccgttctgccgattggtgagtctcactaattgttaagctccccccgctcgaagggataagattgttaacaacgtgcgctttgtttatgccggatgcggcgtgaacgccttatccggcctacaaaatcgtgcaaattcaatatattgcaagaagatcgtaggcctgataagcgtagcgcatcaggcagttttgcgtttgtcatcagtctgatccccccgcttggggggatttttttattcgctaacttcgcgtcttgcactcttcggtctgaatgctgcaaccacttccggtgccgtttcaacgtatggcccttccagcaactgaatgcagtacggtacgctggcaaaaataccgtgcaccacaacgttaccctcagcgtccttcacaccttccagcgtctctttaatagacttcggttgaccgggtaagttaaggatcagcgcctgtttgcgaatcacccccacctgacgcgaaaggatcgcagttagtacaaaatgcaggctgatctggcgcatctgttcaccaaagcctggcatctcgcggtccgctactgccagcgtcgcatcgggcgttacgtcacgacgcgccgggccagttccgcccgtggtgagcaccagatggcaactcatttcatccaccagctcacacaacgtttgctcgatgatcgcctgctcatcggggattaagcgggtttccagttcaaacggcgtggttagcgccgatgtcagccattcttccagcgcagggatgcctttatcctgataaacgccgctggatgcgcgatcagagatggaaactaagccaatacgtaaagtattcatcaagatttttccgtttaaacagtctcgttaaacagaatgatacactgcgaagggagtgacagacaggtttcagaagaggtagcgtgaccgacttcccggtcacgctaagtatgattacagcagatcgccgatcattttttccagtttttcctggtcaacagcaaacttacggataccttccgccagtttatctactgccattggatcctggttgtgctgccacaggaactcggactcagtgatacgcgccggacgcgctttcacttcaccagtgtaagacagtttacgttcgatagccccttcgctctccgccagctctttcagcagtgccggtgcgatggtcagacggtcgcagcctgccagttccagaatttcgccgatgttacggaagcttgcgcccataaccacggtttcataaccatgctctttgtagtactggtagatttcagatacagaaaccacgcccggatcttctgccggagcgtactctttcttatcggtattcgctttgtaccagtcaagaatacggccaacaaacggcgagatcaggaacacgcccgcttccgcacaagcacgagcctgagcgaaggagaacagcagggtcaggttacagttgatgccttctttttccagctgttccgcagcacggataccctgccaggtagaagccagtttgatcagaatacgatcgttgctaatacctgcatcgttgtagagtttgatcaggcgttttgctttcgcaattgacgcttcggtgtcataggaaagacgcgcatcaacttcagttgagatacggcccggaaccagtttcaggatttccagaccaatatttacggccagtttgtcggtcgcgtccacgatctgctgcgcgcgatcgttgctctgctgtttcgcccaggcgacagcatcatcaatcaacttacggtattccggaatctgcgctgcgttaagaatgagagaagggttggttgtggcatcctgcggttgatacagcttcattgccgcgatgtccccagtgtcggccactacggtggtgtactgacgaagggaggtcaatttgtccgtcatgatagtatttctctttaaacagcttgttagggggatgtaaccggtctgccctgatgatatcacgacgcaacgtcagcgcaaccgccgacaagacggttatcgccaggcgagactgtttcggatttctgacactgcgttgatatcgcccgccatttttatacaaaacctcatgtatgctacgcagaagttatcaagtacctcgtagcgtatatacttcttaaacaattggtaacgtttacacaggaaagtcatcgcgaccggcaataagagggatatgcatgccagattttttctcctttattaacagcgtcctttggggatcggtaatgatttacctgctcttcggcgcaggttgttggttcacttttcgcaccggatttgtgcagtttcgctacatccgccagtttggcaaaagtcttaaaaatagcattcatccacagccaggcggtttaacctcatttcagtcattgtgtaccagtcttgcagcgcgcgtgggtagcggcaacctggccggcgttgcgctggcaattaccgccggtggacctggagccgtcttctggatgtgggttgccgcatttatcggcatggcgacctcgtttgccgaatgttccctcgcacagctttataaagaacgtgatgccaatgggcagtttcgtggcggaccggcatggtatatggcgcgcgggctggggatgcgctggatgggcgttctgttcgccgtctttttgctcatcgcctacgccataattttcagcggagttcaggcgaacgccgttgcgcgagctctgagtttttcttttgattttcccccgctggtaacaggtattattctcgctgtctttgctctgctggcgatcactcgcggtcttcatggcgtcgcccggctcatgcaggggtttgtcccgttgatggcgataatctgggtactgacctgcctggtgatttgcgtaatgaatatcgggcaacttccccacgtcatttggtctatttttgagagtgcttttggctggcaggaagctgcaggcggcgcggcgggatataccttaagccaggcgattactaacggttttcagcgcagtatgttttccaatgaggcgggaatggggtcgacgccaaacgcggcagcggcagctgcgtcctggcctccgcatccggcagcgcaaggaattgtccagatgattggcatttttatcgacaccctggtcatctgcacggcaagcgccatgctgatattactggcgggtaacggcacaacctacatgccgctggaaggtattcagcttatccagaaggcgatgcgggtgctaatgggttcctggggtgcggagtttgttaccctcgtggttattctgtttgccttcagctccatcgttaccaactacatttatgccgaaaacaatctcttctttttacgcctgaacaaccctaaagcgatctggtgtctgcggatctgcaccttcgcaacggtcatcggcggcaccttgctaagtcttccgctgatgtggcaactggcagatatcattatggcctgcatggctattaccaatttgaccgccatattactgctctcgcctgtggttcataccattgccagtgattatctacgccagcgtaaactcggcgtgcgtccggtgtttgatccgttgcgttatccggagatcggtcgccagctttctccagacgcgtgggatgatgtttcgcaggagtaatcacaactatcgatcaactcattctctttttttgctaaagtcggcataaatttcctgcaaggactggatatgctgattcttatttcacctgcgaaaacgcttgattaccaaagcccgttgaccaccacgcgctatacgctgccggagctgttagacaacgcccagcagctgatccatgaagcgcggaaactgacgcccccgcagattagctccctgatgcgcatcagcgacaaactggcgggtatcaacgccgctcgctttcatgactggcagccaaatttcacaccggagaatgcccgccaggcaattctggcgtttaaaggtgatgtctacactggcttgcaggccgaaaccttcagcgaagacgatttcgattttgcccaacagcatttgcgaatgctttccggcttgtatggcgtactgcgcccgctcgatttaatgcagccttatcgtctggaaatggggatacgtcttgagaatgcccgagggaaagatctgtatcaattctggggagatatcatcaccaacaagctgaacgaggcgctcgcagcacaaggcgataatgtggtgataaatctggcgtcagatgagtattttaaatcggtgaagccgaagaaattgaatgccgagattatcaagccagtgttcctcgatgagaagaacggcaaatttaagataatcagcttctacgctaagaaagcacgcggtctgatgagtcgtttcattattgaaaatcggctgaccaaaccagagcaactgactggttttaatagcgaaggttacttctttgatgaagcttcctccagcaatggcgaactggtgtttaaacgctacgagcagcgttaagtttgtagtcaatgccggatggtaatccggcattgatatttagcgatgatgtttgtccggctccggacgatgatcgccacgatgatcattgtgcttgttatggcgcggcgatggcggcggtccatatgggtgccagcgattgcctcgccattcataatgttgtttccaccagccgtggtcgcgccagtgaccgccatcccagtaatagccacgattatcacgatcgcctatctgtaattttactgacgggactagcgtaatttccgcagcctgcgctgccatgggagcgaccagaaccagggaaagtgcgagtacgatagattgcatctttttcacaggttactccttttatcattgcccgttatgggtcgatatccggagattacgcgatgagaacggcagttgttattctccgcaatcctaatctctaagttaccgcatttattgagaatttctcctttttccctgtcgtttttctccatattttcttcataaaaaagccgggctgcataaaagcaaacccggcctgattgagataatgaatagatgttactgatgattcatcatcaatttacgcaacgcagcaaaatcggcgggcaggttatgcgaaagcaagggtaaatcagcacgttctgccagctcttttggcagatccaacgtttcaccgagaatcgcttccacgctctctttaaatttcgccggatgcgcggtgccgaggaacaagccatattcgcctggattcaactggtcacgcagcgcacgataagctacggcagcgtgcggctccgaggtatagcccagttcttttaactcacgcattgtctgttgcgtggtttcatcatccacggctgcataccccagctctttcagttgccagattttgcggcggaacaactcttccacacgcggccagttgtttggctggctaacatccatcgcattggataacgtcgcctgagtcgctttgggtgaccactgaccgtcgtgcaggaaacgtggcacggtatcgttcacgttggtcgcagcaataaaacgtttcaccggcagaccgagtgacttcgccagcagacccgccgtcaaatcgccgaagtttccgcttggcaccgagacaaccagctggttgcgcgcttcctgcggcagctgcgcaacagcttcaaagtagtagcaaatctgcgccagcaaacggctgatgttaatggagttagcagagtttagccccagcgccactttcagttcttcatcatcaaacgcctgcttcaccagcgcctgacaggcatcgaaatcgccgtcgatggcaacagtttcgatattgccgcccaatgtacagaacagtttttcttgcagtggactgattttgcctcgtggatagaggataaccactttcacattcggtaaaccgtagaaagcatgagccactgccgctccagtatcaccggatgtcgcggtcagaatggtcactggcttatcgcccgcaatatgggtcagtatttgtgccataaagcgaccgccgaaatctttaaatgccagcgttggcccgtggaacaattccagacaaccgacatcgctttcaacattggcgaccggagccgggaaggcaaacgccgcgcgtacgcgctcttccaggatttcctgcgggatttcatcaccaataaacgccgagaggatcttcgcactgcgggtgacaaaatccagcttcagcatctcatcaatttcagtcaggctgaattccggcaggtcgtgcgggaaaaacagcccctgatttttgcccaacccctgggttacggcttgcgcaaagctgacctgctcattgtgatctttcagattgtagagtttcatttagttttccagtactcgtgcgcccgccgtatccagccggcaaatatgaacaaaaccttcctgattttgcaggtagtttttacccaaccagtcggcaacgcgctgggcggtatccggcttgtcacacagagcgaacaaagtcgggccggagccggagataccgctcgctaccgcgccgatttccgcaaccgcctgccgcgcctgccggaagcctggcagtaaccgttcacggtagggttcagcgataacatctttcatcagcttcgcggcaagctcaggctgacgggaatagcaggcgtgaatgaagcctgccagatgtcgcccgtgcgcaatgcaatcctggcggcgatactgcgccggtaaaatagccctggcttctgccgtcgagactttaatccccggatacgccagcacccacagccactcatcaaaccctggcacttgctgactgatgatgtcgttttcttcaatcatcaactgcataccaccaagaaaacacggtgccacgttgtcgtaatgaatgctgccggagatacgcccttccaactcgcccatcaaagccagcaaacgagtgtcattaagcggcttgccgcagtgttcattcatcgccatcagcgccgcgaccactgaacaggcgctggagcctaagcccgaaccgatcggcatattcttttccagagtcatcgccactggaatttgcttgccaagctcctggcaaaaacgctcccagcactgataaacgatattttcccgtggctctgacggcagcttatcggcaaagcgtccgaggttgttgagactgaatgtctctgccgcctcaaccgtgactacatctccgagcaatgcaccatcaacaggtgtcaccgccgccccgagcacatcaaacccgacgctcatattggcactggaagccggggcataaactttaaccatgtcagactcctaacttccatgagagggtacgtagcagatcagcaaagacaccggcagctgtaacgtcattgcccgcaccatatccgcgcagtaccaacggcagcggctgataatagtggctatagaaggccagggcgttttcgccatttttcactttgaacagcggatcattaccatccacttcggcaatcttcacgcggcagacgccatcttcatcaatattgccaacatagcgcaaaacttttccttcatcacgggccttcgccacacgcgcggcaaagagatcgtcgagctgtgacagattcgccataaaagcggcgacatcaccctcggcgttaaactctgcgggcagcacaggttcaatttcaatatccgccagctccagttcacgtcccgtttcacgagcgagaatcaatagcttacgcgccacatccataccagaaagatcatctcgcgggtccggttcggtataacccatttcccgcgccagtgtggtcgcctcggagaaactcatgccttcgtctaacttgccgaagatataagaaagcgaacctgaaagaatgccggagaacttcatcaattcatcaccagcattgagcagattttgcaggttctcgataaccggtaatccagccccaacgttggtgtcatagaggaatttacgccgcgatttttccgccgcataacgcaactgatggtagtaatccatcgacgaggtgttggcctttttgttcggcgtaacaacgtggaaaccttcgcgcaggaagtcggcatattgatccgccactgcctggctggaagtacagtcaacaatgaccgggttcagcagatgatattctttcacgaggcgaattaagcgcccgagattaaacggctctttggcttgcgccagttcttcctgccagttttccagattaaggccatgtacattggtgagcagtgccttcgagttagcaacaccgcagacacgtaagtcgatatgtttattcttcaaccagctttgctgacgcttcagttgctccagcagcgcaccgccaacgccaccgacgccaatcacaaacacttcgataacctgatcggtattgaacagcatctgatgagtaacgcgcacgccagtggtcgcatcatcgttattgaccacgacagagattgagcgttcagaagatccctgagcaatggcgacaatgttgatattggcgcgggccagcgcggcaaagaatttcgccgagatcccacgtaaggtgcgcataccatcacctaccaccgagataatggccagccgttccgtcaccgccaacggctccagtaagccttctttcagttccaggtagaactcttcctgcattgcccgttcagctcgcacacagtcgctttgcggaacgcagaaactgatactgtattcggaagatgattgcgtaatcagcaccacggaaatacgggcgcgtgacatcgctgcaaagacgcgcgccgccatgccaaccatccctttcatccccgggccggaaacgctgaacattgccatgttattcagattggaaatgcccttgaccggtaattcgtcttcatcacggctggcaccaatgagcgtacctggagcttgaggatttccggtatttttaatcaggcaagggatctgaaactgggcgatgggggtgatggtgcgggggtgaagaactttagcgccgaagtaagaaagctccatcgcttcctgataggacatcgacttcaacaacctcgcatcgggcacctgacgcggatcgcaggtataaacaccgtcaacatccgtccagatctcgcaacaatcggcgcgtaaacaggccgccagcaccgcagcggagtagtcggaaccgttgcgtcccagaaccaccagctcgcctttttcattaccggcagtgaaaccagccatcagcaccatgtggtcagccggaatgcggcttgccgcaatacggcgggtggactcagcaatatcaacggtagattcgaggtaatgccccactgcaagcagtttttcgaccggatcgataacggtaacgttgtgaccacgcgcttctaacacgccggccataatggcgatcgacattttctcgccacggcaaatcagcgcagcgttgatgctatccgggcactgccccaacaaactaatgccatgcaggacatgttttatttgggcaaattcctggtcgacgaaagttttcaattgtgccagcggaaatcccggctgggcggcggcgagtcccgtcagaagttcggcaaaaatacgttcggcatcgctgatattgggtaaagcatcttggccgctaatggttttttcaatcatcgctaccagatggttggtaattttggcgggggcagagaggacggtcgccacctgcccctgcctggcattgctttccagaatatcggcaacccgcagaaaacgttctgcatttgccactgatgtaccgccgaacttcaacactcgcatggttgttacctcgttacctttggtcgaaaaaaaagcccgcactgtcaggtgcgggcttttttctgtgtttcctgtacgcgtcagcccgcaccgttacctgtggtaatggtgatggtggtggtaatggtggtgctaatgcgtttcatggatgttgtgtactctgtaatttttatctgtctgtgcgctatgcctatattggttaaagtatttagtgacctaagtcaataaaattttaatttactcacggcaggtaaccagttcagaagctgctatcagacactctttttttaatccacacagagacatattgcccgttgcagtcagaatgaaaagctgaaaatcacttactaaggcgttttttatttggtgatatttttttcaatatcatgcagcaaacggtgcaacattgccgtgtctcgttgctctaaaagccccaggcgttgttgtaaccagtcgaccagttttatgtcatctgccactgccagagtcgtcagcaatgtcatggctcgttcgcgtaaagcttgcagttgatgttggtctgccgttgtgtcacttttcgccggttgttgtattaatgttgctaattgatagcaatagaccatcactgcctgccccagattgagcgaaggataatccgccaccatcggcacaccagtaagaacgtcagccaacgctaactcttcgttagtcagcccggaatcttcgcgaccaaacaccagagcggcatggctcatccatgaagatttttcctctaacagcggcaccagttctactggcgtagcgtagtaatgatatttcgcccgactgcgcgcagtggtggcaacagtgaaatcgacatcgtgtaacgattcagctagtgtcttgaaaactttaatattatcaataatatcaccagatccatgtgcgacccaacgggcgactggctccaagtgtgcctgactatcaacaatccgcagttcgctaaaacccatcgttttcattgcccgcgccgctgccccaatattttctgctctggcgggtgcaaccagaataatcgttatacgcatattgccactcttcttgaccaaataaccgcgaacagggtgatcattgtcaacttattacgcgttgcgaatttacaaattcttaacgtaagtcgcaggaaaagccctttgcttagcttaaaaaaagctaaactatttcctgactgtactaacgattgaattgttaaaaaatgctacatatccttctgtttacttaggataattttataaaaaataaatctcgataattggattcaccacgtttattagttgtatgaagcaactagttggattattaaaataatgtgacgaaagctagcatttagatacgatcatttcatcaaactgttaacgtgctacaattgaacttgatatatgtcaacgaagcgtagttttattgggtgtcctgcccctcttagcctgttatattgctgttaaaatggttaggatgacagccgtttttgacactgtcgggtcctgagggaaagtacccacgaccaagctaatgatgttgttgacgttgatggaaagtgcatcaagaacgcaattacgtactttagtcatgttacgccgatcatgttaatttgcagcatgcatcaggcaggtcagggacttttgtacttcctgtttcgatttagttggcaatttaggtagcaaacatgcagaccccgcacattcttatcgttgaagacgagttggtaacacgcaacacgttgaaaagtattttcgaagcggaaggctatgatgttttcgaagcgacagatggcgcggaaatgcatcagatcctctctgaatatgacatcaacctggtgatcatggatatcaatctgccgggtaagaacggtcttctgttagcgcgtgaactgcgcgagcaggcgaatgttgcgttgatgttcctgactggccgtgacaacgaagtcgataaaattctcggcctcgaaatcggtgcagatgactacatcaccaaaccgttcaacccgcgtgaactgactattcgtgcacgcaacctgctgtcccgtaccatgaatctgggtactgtcagcgaagaacgtcgtagcgttgaaagctacaagttcaatggttgggaactggacatcaacagccgttcgttgatcggccctgatggcgagcagtacaagctgccgcgcagcgagttccgcgccatgcttcacttctgtgaaaacccaggcaaaattcagtcccgtgctgaactgctgaagaaaatgaccggccgtgagctgaaaccgcacgaccgtactgtagatgtgacgatccgccgtattcgtaaacatttcgaatctacgccggatacgccggaaatcatcgccaccattcacggtgaaggttatcgcttctgcggtgatctggaagattaatcggctttaccaccgtcaataaaaacggcgctttttagcgccgtttttatttttctaccttatttccagatacgtaattcatcgtccatggtaacttctttactggctttcattttcggcagtgaaaacgcataccagtcgatattacgggtcacaaacatcatgccggccagcgccaccaccagcacactggttcccaacaacagcgcgctatcggcagagttgagcagtccccacatcacaccatccagcaacaacagcgcgagggtaaacaacatgctattacgccagcctttcaataccgcctgcaaataaataccgttcattaacgccccaatcagactggcgattatccatgccacggtaaaaccggtatgttcagaaagcgccagcaagagcaaataaaacatcaccaatgaaagccccaccagcaaatattgcattgggtgtaaacgttgcgcggtgagcgtttcaaaaacaaagaatgccataaaagtcagcgcaatcagcagaatggcgtacttagtcgcccggtccgttaattggtattgatcggctggcgtcgtcactgcgacgctaaacgcggggaagttttcccagccggtatcattgcctgaagcaaaacgctcaccgagattattagcaaaccagctactttgccattgcgcctgaaaacctgactcgctaacttcccgtttggctggtagaaaatcacctaaaaaactgggatgcggccagttgctggttaaggtcatttcgctataacgcccgccaggcaccacagaaagatcgccggtaccgcttaaattcagcgccacattcagcttcaggttctgcttgcgccagtccccttcgggtaaagggatatgcacgccctgcccgccttgctctaacccggtgccgggttcaatggtcagcgccgtaccgttaacttcaggcgctttcaccacaccaataccacgcgcatccccgacgctaatcacaataaatggcttgcctaaggtgatatttggcgcgtcgagttcgctaagacgcgaaacatcgaaatcggcttttagcgttaaatcactgtgccagacctgaccggtatagatgcctatcttgcgttcttccacattctgattgccatcaaccatcaatgactcaggtaaccaaaaatgaataaaacttcgtttccgctccacggttttatcgtcttcctgcaccgtataaagctcggtcacaggaatagcgatgagcggcccaacgagtttttgcggcccgctggtactttggcgaatcacatcttccacatcgctacggtaatcggcacgttcgacaatcacctgccgaatcagcattatcggaatcaacaacagcaatactgcaccaaacaaggtggtcattttccagaacaggggggatttcaacatagtcttctcctttgcaatgacagcaggatacgaaggctatgtgggaagaatttgaagctatgtgaagtgacggtgaagtcgaagcgaggccagcacgccaccttcctgcacgttgcgcagcgtgacttcgccgttaaacaaacgggcgacctcactgacaaacgccaaccccagaccgctgcttttttgcccatttgcacgcggcaaagagtaaaagcgttcaaaaatacgtgacagcgcgtagtcaggaatcccactaccggtatccagcaccttaagggtgacgtattcctgatccacttcggcgcttagcgttatgcaaccgctctcgggagtaaaatcgatggcgttatccagtaaattccccagcgcctgctccagtaacgccggttcagaagcaacgttaacctcagtaggcataacatgcaaagtgatgtttttttctgccaactgcacggtgcgcgcttcgctgacgcggcgaaataatgccgccacatcaacagcagtcagaacgacttcctgacgattctccagtcttgcctggcgtagtaacgtttccaccagtgcctgcattcgcgcattttgcgtcagaatgttgtcggtaaaacgagccaccacttccggcggcggaccttcgcgtaaaatttccgccgcgccacgaatcgccgccagtgggctttttagctcatgagttaacgcataaacatactgctcaatatagtttttcccttccagcttcacgcgcatactttccagcgcctgcgcgagtttacgcaactcgctactaccgagatcggggagaggaacgggcttattgtcagtgacggaatcagcatagcgagtgagcctggcaatagagcggttgatccaccaaaccatgcctgcgccaatcaccagtgcaatccccaacaaaatggcgctggcccataaaattcgccgctcgctacgcttaatgaccggagccatcgccgcgttcggtttgcctacgctcaaaacgccaataagccgcgagccgtccataatcggcgcggcaacatacatcacagaactttcgggatcggcaggattttgcaacgtgctgcgcgcaccatactgaccacgcaacgttagccagacgtcattccagcgcgaataatcctgtccaacggctttatttgccgaatcgaacaatactttgccctgcgcatcggtcatatagacatgatattcgttgcgcactttgttaatgccaccgatattggcgcgaaacgggcgatgttgtagctgattaaacgcctgcgccagttgcccatgcgttgggtccccagagagcaaatcgggacgcgccagctccgccagcaacgttgcggtgtcgattaacgtcccctcggttgctcttcgcacgcccggtttaacttctttgacaaaaatagccagtacgaaccaggccgccaccgccaccagtaaaaaatagcccagcaacaaccgcatgccgatacgcattacaggcccctcaggctatatcccatgccgcgatgagtattaatcggtgaaagatcggggttgatggcgcgcagcttggcacgcagcgttttaatgtgggtatcgacggtgcgatcgtaggtgtcctgcgcatcttcccacacgctatccatcagttgctggcgggaccagacgcggcccggcgacttgagtaacgtcttcagcaataaaaactcataccgcgtcagcgttaatggcgtgtcaaaccagctgatctgcgccgcaggttcattcaattcaaaatgaccaatacggataacgggagacggagtcgagaacttcttcacccgacgcagtaaggtgcgcactctggcgcacacttcgcgaggtgaaaacggtttagccacgtagtcgtcagcgccaatttccagcccaagcaggcgatcgacctcttcacttcgggccgtcaggaacagtacaggtaacgccggatggagcgccagtaactggcggcacaattcaaagccgctgatatcaggcaaaccaacatcgagaatcatgacatcgggaacctgctggcgagctttatccagcactggcaagcctcgctcaaagacctcgacgtcaaaaccttcctgttgcaacatgtagaccagcgtatcggctatcccttgctcgtcttcgactaaccagaccgtttcccgttgcataaatcgcctctgttattgccgccacggcatgacaggaaccgcgctaatcgcgtttttcggcgaaccttctacaactttgtcggagtaagccagataagcgagcgcgttgcgtttagcgtcataaaagcgcacgacctgtaacgacttaaagaccagggacgtgcgttttttgaatactacctcgccctgagctttgccgtttttaatacgatccgacaattcaatcggcccgacttgttgacaagaaatggccgcatcggaggtatcttctgccaggcccaatccccctttaataccaccggttttcgcccggctcacataacaggtgacatttttcacatcgggatcgtcaaaggcttcaacaacaattttgtgatccgggccgatcattttaaatacggtgtcgaccgaaccaatctcttctgcatgagccaatggccccagcattatcaggcttaaagacaggattaaatgcttgtatttcatatcgttaccatttttatctattacacgagcaattagttcgtcacggtaaataacatattgattaagaacaaaatctcaatacttttatttccgtcaagacctaaaacatactcgactaagaaaaaaacactgaatgctaaaacagcaaaaaatgctattatccaattacctgatgtcaggtgctcgttgttgaaaggatgaggatattttatggatcaggccggcattattcgcgaccttttaatctggctggaaggtcatctggatcatcccctgtcgctcgacaatgtagcggcgaaagcaggttattccaagtggcacttacagagaatgtttaaagatgtcactggccatgctattggcgcgtatattcgtgctcgtcgtttgtcgaaatcggcggtcgcactacgcctgactgcgcgtccgattctggacatcgcgctgcaataccgcttcgactctcaacagacatttacccgcgctttcaagaagcagtttgcccagactcctgcactttaccgccgttctcctgaatggagcgcctttggtattcgcccgccgctgcgtctgggtgaattcactatgccagagcacaaatttgtcaccctggaagatacgccgctgattggtgttacccagagctactcctgttcgctggagcaaatctctgatttccgccatgaaatgcgctaccagttctggcacgattttctcggcaactcgccaaccattccaccagtgctttacggtttgaacgaaacacgtccgagccaggataaagacgacgaacaagaggtgttctacaccaccgcgttagctcaggatcaggcagatggctatgtactgactgggcatccggtgatgttgcagggcggcgaatatgtgatgtttacctatgaaggtctgggaaccggcgtgcaggagtttatcctgacggtatacggaacgtgcatgccaatgcttaacttgacgcgccgtaaaggtcaggatattgagcgatactacccggcagaagatgccaaagcgggagatcgcccaattaatctgcgctgtgaactgctgattccgatccgtcgttaacgctgcagctcatctaatgcaggggcgtccagatgcgagatgtcccctgcggtttcaaccacccagccagacgccagccacaagctttcctgataatccacgcgcgaaatagaacagttacgcagacgtaagcggcgctctgcccatgctggtaatccgagaatcgtactcaccaggcatcccagtgcaataccatggctcaccagtagcggtcggcttccctgcggtaagtcccggcaagattccagtgccgcattaacgcgatcgctgagctcctgcattgactcgccttcaggaatacgcccgtcaacggtgccattgaccagctgccgacgccagttctcttcttcttcggtgagtgaatcgatatttcttgtttccagtacacccatatttaattcacgcaggcgagaatcaaagatgatgtcacagccgcaggcctgggcgatgatttccgccgtgcgccgggtccgtcctaaatcgctactgatgatatgcgtaatgccaagctctttggcacgggttgccacctgcatcgcctgttgctcacctttggcggtcagcgggctgtcagactggccctgaatacgtcgctcggcgttccactgcgtttcaccgtggcggactaggtatacctgtaacatgctttttttccgtatactgctgtaacgttaattttctgagtaatgctgattatgcaccaagttgtctgtgcgaccaccaatcccgctaaaattcaggccattctgcaggcatttcacgagatcttcggcgaaggatcctgccatattgcatccgttgccgtcgagagcggtgtaccggaacagccctttggcagtgaggaaacgcgcgctggcgcacgaaatagggtagccaatgcccgccgtttacttcctgaggctgatttttgggtggcgattgaagctggcatcgatggtgacagcactttcagttgggtggtgattgaaaacaccagccagcgcggcgaggcgcgttcggctactttgccgttgcctgcggtgattctggaaaaagtgcgtgaaggtgaggcgcttggtcccgtgatgtcgcgttataccggtattgatgagattggtcgtaaggaaggggcgatcggcgtgtttaccgccgggaaactcactcgcaccagcgtctatcaccaggcggtgatcctggcgctgagtccgtttcataatgccgtgtatcagccattgcaggcctgattaggcgttcacgccgcatccggcattcggtgcacgatgcctgatgcgccatgtcctatcaggcctacaaaatcaatcgcttttcagcaacacgtcttccagccactggcgcagctcgacgggcgcggctttcagactattagatccacgcgtaatcgtcgcgatgcccgcgccgagttcattttttaactcacgctggctcatttcgccgcgcaacagctcttcgacaatacgcacgcgagtccccaacgcttcgcgctcatctggcgtcagcatcaggtttaacaacggtaaatggagatcgttttggtaggcattcttaagcaggtcgacaaaacgtaaccactcctggtgacgctgttctgccatcgctgctgaatagggtgattgttgggccatagtatgtcgccattgttagcgggggaagcaaaatgcctcccccggttgtactcgctaaagagtacgatagcatatcataaacgtgtggatcagtaacgacgtccccattccgtggcgctcatcaacgtcggtttatcccccatgaaatagcggtagtaagcgtcataagccagcacgtttttcacataaccgcgcgtctcggagaatggaatactctcgacaaatgccactgcgtcgatacgccctgcgctgttgccaagccaggttcgcacccgccctggcccggcgttataagctgctgaggagaaaatacggttattgccaaactgctgataaacatattgcaggtaactggtgccaatgttgatgtttgtttccggatccagcaattgcccagggctgctataaccgggaatagagaacatcttcaccgtatgggtcgcggtaccaggcataatctgcatcaggccgctggcccctaccggtgatttcactttcggattccaggcactctcctgacgggcaatcgccatcgcatagctttgcgggatctccttaccactggtgtagcgtttgaaaagatcgttgtaagccagcgggaatcgctcttccagatgatcccacagcttcccggcgatcgttgcctgaacgctaagatcccaccattggttattgaaagcataccgagccagttgagcctgctctgtttttgacttgctcttcaccagattggcccactcgctacgcgcggtgttatcgagattccagtacatcaactcgcgcacgcgcgccatctccggcccctgagtcagggcgctgtcaacattctgcggcgctttatcaatcttcagctcatactcttcgccgatgcgttgtgcagcaaccatcgggtagaaaccacgctgttgcatgagttgatgcaaaatctcttttgcttcagcttcacgtccgcgttccagcaataaatccgcctgccagtaacgccattcatctttctctttcgcttccataggcagacgcgccagccaggtattcaggccgcgacgatcgccggtgccaagcgccattcgcacacggcgttcaataagcgaagtagattgcgaacgcataatcgcgtcatcgcgccatttcgcctgctcgtcggtgacatcgttgcccatcaaacgccatgcgacaatatcgcgcagctcctgaatctgatcttcattaagctgctgtgcctgagcaagcgacgggatcatcagccgtgcattttcagcatcctgccgcgccacactggcaaacgccaccgccgccatttgacgggtaaaatcggtcgcgccggttgtacgcgcgaaggtcagtaccgtattagggttgttcgccagtgaaatgattgccgaagcgatagtctggtaatcggcaggcatctgccctgccagcactgttaccaggccggtgttacccgctttcatcgccagacggatacgctctaaatacgccagcggatcttgtttacctgacgcacgccagacgctaaataacttgtcacaggcgttaggctggctcttgccggttagccacagctctttcgccccttgccaggcttcttcactctgcccggtgttccatttcgcatagtagtaattacattgcgcttcggtagttccgggcttttccgggctaaaggctaacaagccacgccagtcttcacgccgcgccagttcattgacgaaacgagattgcagcgtgcgagcgggaggaagcgtggggttagcgcgaacaaagttagtgaccgtcaccgccggttgattcatcaggtcatcagtgatctggcggtattccaggtagggataaagtgggtaatctttcagtccaggcatcatttgttcgaccacatccatttgtcgattatcccaggcctgcttgatttgcgcgtaacgactacgctgctcatccagtgagtcggctcgcgccacgctgctgaccgtcagcagacagacaccgacagccaacagccgccaggtaacgtgtttggctttttccacaagcgcatcctctaagtgtcaatacatcaatgcagcgtcatgccgcgtaatagatttatgctaaccagtcattgccgtttacgccacgttacggacacttttttacttttacggggtgatcgactggctgggattagacagggaaacaggctacacttcgcctttgaaaactcatcatcacgataaacatagaggcgaagtccaacgtggctcaattcgtttataccatgcatcgtgtcggcaaagttgttccgccgaaacgtcatattttgaaaaacatctctctgagtttcttccctggggcaaaaattggtgtcctgggtctgaacggcgcgggtaagtccaccctgctgcgcattatggcgggcattgataaagacatcgaaggtgaagcacgtccgcagccagacatcaagattggttatctgccgcaggaaccgcagctgaacccggaacacaccgttcgtgagtccattgaagaagcggtttctgaagtggttaacgccctgaaacgcctggatgaagtgtatgcgctgtatgccgatccggatgccgattttgacaagctggccgctgaacaaggccgtctggaagagatcattcaggctcacgacggtcacaacctgaacgttcagctggagcgtgcggcggatgcgctgcgtctgccggactgggacgcgaaaatcgctaacctttccggtggtgagcgtcgtcgcgtggcgttgtgccgcctgctgctggaaaaaccagacatgctgctgctcgacgaaccgaccaaccacctggatgcggaatccgtagcgtggctggaacgcttcctgcacgacttcgaaggcaccgtggtggcgattacccacgaccgttacttcctcgataacgttgcgggctggatcctcgaacttgaccgcggtgaaggtattccgtgggaaggtaactactcctcctggctggagcagaaagatcagcgtctggcgcaggaagcttcacaagaagcggcgcgtcgtaagtcgatcgagaaagagctggagtgggtacgtcagggaactaaaggccgtcagtcaaaaggtaaagcacgtctggcgcgctttgaagaactcaacagcaccgaatatcagaaacgtaacgaaaccaacgaactgtttattccacctggaccgcgtctgggcgataaagtgctggaagtcagcaacctgcgtaaatcctatggtgatcgtctgctgattgactccctgagcttctcgatcccgaaaggagcgatcgtcgggatcatcggtccgaacggtgcgggtaaatcgacgctgttccgtatgatctctggtcaggaacagccggacagcggcaccatcactttgggtgaaacggtgaaactggcgtcggttgatcagttccgtgactcaatggataacagcaaaaccgtttgggaagaagtttccggcgggctggatatcatgaagatcggcaacaccgagatgccaagccgcgcctacgttggccgctttaactttaaaggggttgatcagggtaaacgcgttggcgaactctccggcggtgagcgcggtcgtctgcatctggcgaagctgctgcaggttggcggcaacatgctgctgctcgacgaaccaaccaacgacctggatatcgaaaccctgcgcgcactggaaaacgccctgctggagttcccgggctgcgcgatggttatctcgcacgaccgttggttcctcgaccgtatcgccacccacattctggattaccaggatgaaggtaaagttgagttcttcgaaggtaactttaccgagtacgaagagtacaagaaacgcacgctgggcgcagacgcgctggagccgaagcgtatcaagtacaagcgtattgcgaagtaatgcgtaaaatgccggatgcggcgcaccagcatcgcatccggtattagttaaatgattaatgggaagcaagttcccggaaaaaggcaggattttctttaattgtggcaagtacttttgcagccaatcccgtaggatttcttcgcttcgattcccagcttttaatggtatccacactggttcccagagcttttgccatctcactttgagaaacgttgagttgctcacgaatagctttaacatccgcaatttcgtagcgggtcacccgtgcaggttcttttaaaccttgtttaatctcgacagcctcttccagagaggttttcaactcatcaaaaaaactcattttatatctcgcctttgagcagtttcgtcaacttctttagttgagctttttccgtatctgtcagactatctttggcatttttcggataggccataatcaaataaataatctcttccgtcgccagaaagtaaattattctgacactgccactttttccctgtgaacccgcagccattcggactttacgcaatccaccagtctgctgaatgagatcacctttatcgggagttccgatgagttctttttgtaattcctttaattcatcatcggttgcaatctgcttgatctgacgcgtaaacattggcgtctctataaatattatcgccttacccattccccctccctggcaggtacattgtacaccgaaatggagtactaagtacacttttgaatcagtaatcccactcaacatcttataaagatgattatctttgctcccccatcatctcccgcaccagctccacgcagcgcaggaaacggctgtcgtaatcgtcctcttcaacccgcacgaattcgatattgttctcttccagcatctccaccagcaagttctggaactctttgcgatccaccgaactgccgaggctgcgtaaaccatccgccacccacggcgtgttgttctccagcaggatcaccagatcgaaacggtactcatcaatcaacgcctgcacgaacggatgctcacgcccttcgtactttttgcagaacgcctgggtagtgacaaaatcggtgtcgataaacgccactttattggcatatttcactgcaaaatcaatatattgcgcatgtcccagcgcgattttatcgtagtcggaatactgcaacgcgatctcatcgccaccgaggtgcgaaaagacataatcacgaccatattcccacgcactggtagtgttgaagatattggcaagtttgtttaccagggtggatttaccgctcgattcaccaccgaggatcgccacggtacgcacaaagaatggcttcacttccgtaggaatatattcccagtagcggaacgggttttcgcggatctgcgcaccgctgatactcataaaggtacgcttcggatcgaccagcaccgtctcgatccccagatgttccatatactgcggcgcatcggcttcttccgaggtgtagatcaggtccggctgaatgcctttttcggccataaactttttgatgccgttgctccacacatcccagccgtgtggatacggttccatgccctcttcgttaaaagcatgaatgcggatatttttttgatacttaaaggtctgcaataaccagcgcagacgatccggcacggttggctgctgcgacatggcgctgtcttcgaacaatgcgcggtcgcgggtatcgtcaaaacccataatgatatgcagctcgtcaacctggctacaggcgcgctggataaggtagatatgtccagtatgcagcgggtaaaacttaccgaatacgacaccgatcgttttcttctgccggggaaattcaagtcccaaataacggtgcaatgcctccagcttttgtgcgctggggcttttaattttggcattcagtaactggcttaaataccctttggtcataccgctggcatcagctacctgctgtagagtgcagccctgttgcttgatggcagttttcaggtaatcaaatgacgacatatctccctccgtatctctcattataagtcgtcgaacacgctaagcgcgtcggagagttttttaacgccaaaaatctgcatcccttccggcgcttttttcggcacgttagctgccggaacaattgcccggcgaaaaccgtgtttcgccgcttctgagattcgttcctggccgctgggcaccgggcggatctcccctgccagcccgacttcaccaaacaccaccagatcctgcggtagcggtctgtcacgcaggctggaaaccatcgccagcagtaacgctaaatcggcactggtttccgtcaccttcacgccaccgaccacgttaacaaacacatcctgatcggccatttgtagaccaccgtgacggtgaagcaccgccagcaggattgccagacggttttgctccagcccgactgccacgcggcgtggattcgccatcatcgagtgatcgacgagcgcctgaatctccaccagcagcggacgcgttccttcccacactaccatcactgagctaccggaggtcacttcatcgccgcgacttaagaaaattgccgaagggttgctgacttcacgcagcccctgctcggtcattgcgaagacacccagctcattcaccgcgccgaagcggtttttatggctgcgtaaggtgcgaaaacgtgagtcggcatcaccatccaaaagcaccgaacagtcgatacagtgttccagcactttagggccagccagcgagccatctttggttacgtgcccgaccatgacaatcgccacaccgcgcgttttggcgaagcgcgtcagataagccgccgtttcacgcacctgtgccacgctgccaggcgatgattgtacatccgccatatgcatcacctggatggagtcaattaccatcagcttcggttgctcttcttcggcaatcaggcagatctgctcgatgctggtttccgacagcatattaagattgtcagtcggcaggccaaggcgatgagcgcgcattgccacctgttgcagcgactcttcgccggtgacatacagcgttttcatctgctgcgccagtttgcacagcgtttgcaacagcagcgtggatttcccggcacctgggttaccgccaatcagaatggcacttcccggcaccacgccgccgcctagtacgcggtcgaactctttaaatccggtggaaaaacgcggcagctcttcaaggctgatgtcggaaagtttctggacttttgccactccggcgctaccggcatagccactgagacgctcgttacgcgccaccgttggcgacgcagcaagacgcacctcggtgatggtgttccaggcatgacaggcgctgcactgcccctgccagcgcggataatcggccccgcattcattacaaacaaaggcgcgttttggagcttttgccacggtgtacctcgttaatgctgtgccgcccgcaggatgacgggcaggcaattacttctgattcaggctgccagagaggatgcagaatacacccatcaggtcagcgtgacggatggtgacttccgttttttcattcacttttggcttggcatggtaggcaatccccagccctgccgctttgatcatcggcaggtcattggctccatcgccaatcgccacggtctgcgccagcgggatttcatactcctgcgcgaggcgagtcagagttttcgctttgtactgcgcgtcaacgatgtcgccgatcacattgccggtaaatttaccgtccatgatctccagttcattggctaccacggctgtcaggcgcagcttgtcgcgcaggtattcagcaaagaaagtaaagccgccggaggcaatcgccactttccagcccagcgtttccagcttgagtaccagctgcgttaagcctggcatcagcggcagattttcacgcacctgttgcagaatgttcgcgtcagcgcctttcagcgtcgccacgcggctgcgcaggctggcggtaaaatcgagttcgccgcgcatcgcccgttcggttacctccgccaccctctcgcccgttccggccagtttggcaatttcatcaatacattcaatctggatggcggtggaatccatgtccatcaccagcaaacccggcgtgcgcaggtgcgggattttccccagcggcgcgacatccagctgcgcttcgtgggccaggcgcgtagcccgcgcggtgagtgaacctgccagacgaatcacctgataatcttccacgcaccaggcggcaacaatcaccatcgccgcgcccagtttgctctggtattgggtcagacgttgtttatccagtccacgaccatacagcagccagccgctacgacctgcgtggtaatccagtggcatcacttcatcaccacttaatgaaagaggcagacccggccataaagagacatcttcaggcaggtcgcaccaggtaatgttaggcattaaggctcctgtaaaatcgttcgaagcagggaaaataacgcatgaggctaccttgtatccattgcttctggcaacattaagtctcaaattttcaaagggtggaagatggctcgcacaaaactgaaattccggctgcatcgggcagtgattgtcctgttctgtcttgccttgttagtggcgctgatgcagggagcgtcatggtttagtcaaaaccaccagcgacagcgtaatccacagctggaagaactggcccgcaccctggcgcggcaggtgacgctaaacgttgcaccgcggatgcgtaccgactcaccggatgaaaaacgcattcaggcgatcctcgatcagttaacggatgaaagccgcattctcgacgcaggcgtatatgatgagcaaggcgatcttatcgcccgttctggcgaaagcgtcgacgtgcgcgaccgactggcgctcgacggcaaaaaagcgggcggctattttaaccagcagattgtcgaacccattgcgggtaaaaacggaccgctcggctatctgcgcctgacgctcgacacccatacgctcgccaccgaagcccaacaggtggataacaccactaacattttacgcctgatgttgctgctctcgctggcaatcggcgtagtgctgacccgcacgctgctacagggtaaacgcacccgctggcagcaatcgcccttcctgttaaccgccagtaaaccggtgccggaagaggaagaaagcgagaaaaaagagtgacccattactacaagaaaggaaatcgttatgtccacattacgcctgctcatctctgactcttacgacccgtggtttaacctggcggtagaggagtgtatttttcgccagatgccggctacgcagcgcgttctgtttctctggcgcaatgccgacacggtagtgattggtcgcgcgcagaacccgtggaaagagtgtaatacccggcggatggaagaagataacgtccgcctggcgcggcgcagtagcggtggcggcgcagtgttccacgatctcggcaatacctgttttacctttatggctggcaagccggagtacgataaaactatctccacgtcgattgtgctcaatgcgctgaacgcgctcggcgtcagcgccgaagcttccgggcgtaacgatctggtggtgaaaaccgccgaaggcgatcgcaaagtctcaggctcggcctatcgcgaaaccaaagatcgtggcttccaccacggcactttgctgctcaattccgaccttagccgcctggcaaactatctcaatccggataaaaagaaactggcggcgaaaggcattacctcagtgcgttcccgcgtgaccaatctgaccgaattgctaccggggatcacccatgagcaggtttgcgaggccataaccgaggcctttttcgcccattatggcgagcgcgtggaagcggaaatcatctccccggacaaaacgccagacttgccaaacttcgccgaaacctttgcccgccagagtagctgggaatggaacttcggtcaggctccggcattctcgcatctgctggatgaacgctttacctggggcggcgtggaactgcatttcgacgttgaaaaaggccatatcacccgcgcccaggtgtttaccgacagtctcaaccccgcgccgctggaagccctcgccgggcgactgcaaggctgtctgtaccgcgcggatatgctgcaacaggagtgcgaagcgctgctggttgacttcccggaacaggaaaaagagctacgggagttgtcggcatggatagcgggggcggtgcgatagttacccgcccatgcgggcaactttcccttcgatttgccggattttttccggcatttcttgtgcaatgtggcgaaatgcctcgctgatacgcggatctccggcgaccgtttgccagaactgctgcgccagcgggatcgccgttaaccatgcacttttactgacgttaagatcaaacctcacctcaatggcagcatcacgcaacattccggcgctgtttggtgcataggccatcggcagcatgtcgtagacgggcgtcagcgcaaatggtggttcagataaataaaatgataaattgcctgcgtgcatatcgctgttggcgataagtcgcccaaacgcccagatcacttctgtttgcgccacgctctggtgagtgacaagttgttgctcacacaaacggcgcatagcctccggccacgatcccggagaagagataaactcactctgcaccgcctccagcgacacaatgggcaagcgaccatcgttacctttgcagtcaaatcgttccgcttcaaggaatacctgcctgttacttgttacaagcaccgttgactcgatggcgtggatcccgccgtcgcgcaggatttgcgcggcaatagattccgcaataagcaagtcgccccaacgttggctgaccgcggtttgctgtggcacggtgaatttaaccagcacatgtttattgcctgacggcgtttgtgcatagcaggtaaattttggctgctcaccgcccgcagaagaacccacaatttctcctgccagtgcatcgcttgccagttgttcgtaatgggtgagtttttgatccagaggaattgccgcagggcgttgtgcagtaatccatcgctgataattcccctccccgaccagccagccgccggtgtattcaccgctaaatacggtcagggcgtagagcacatcttcttcctgccagagacggatatcttcagtaagattcagttgcgcggctaacttcctgccccacgcgcgccccaaaaacccctgcggtcgcagatcggtcaaataccagggcaaaccatcaaaccaccgttcgtcgccatctgcgcctgttaccagacaacttccctgcggccagcacaaccggatgtcggcgaatttatgcgcctttccggcatcatccactcgccatacgggaatacgctcaattccgcgataaggacgcagcagtgcatatcgcgttgcccgtgctttaccaaagcgaatcacccgatcttctctggcaacaaggcgtgagaacgtcgcctgactgattgccagacgctggcgcaattccggggcagaacgcggcccttgcaataaaagatcggtcaattcgctcattaatgaatagattcgtgaatagatacttgaatagatttattaacacatttcactgaaaagtatagcgaaaatattcaagctggagagagaaatgaatagataataaaaagccggagcagtctcccactccggcttcacacgacaatcgcctttcagcaaaacacaattactctttatcgcccagcagaacggattccagcgcgattttgatcatgtcgttgaaggtggtctgacgctcagcggcagtggtctgctcgtgagtgcggatgtggtcagacacggtgcagatggtcagggctttcgcgccaaattctgcagcgacgccgtagataccagccgcttccatttccacgccgaggatgccgtatttttccatcacgtcgaacatttcgccgtccggagagtagaacaggtcagcggagaacaggttaccaacacgagcatcaacgcccagtgcttttgccgcgtctaccgcgttacgcaccatgtcgaagtcagcgatagcggcaaagtcatggtctttaaaacggatgcggttaactttggaatcggtgcaggcacccataccgataacgacgtcgcgcagttttacgtgcggcagaacagcgccacaggaaccaacgcggataattttcttcacgccgaaatcagtgatcagttctttggtgtagatggagcaggacgggatacccataccgtggcccattacggaaattttgcggcctttgtaagtaccagtgaagcccagcataccgcgaacgttgttcacttcacgggcatcttcaaggaaagtttcagcaatatacttcgcacgcagcgggtcacctggcatcaaaactacgtcagcaaaatcgcccatttctgcattaatgtgtggagtagccatcattttatcctttttgtgacatattaaaggcggagtcactgctccgcccaaatccatcagaacatggctttgccatattccatatcagaagtaccaaaatattttgccagagtctggccgatatccgcgaaggtttcacgatgacccagcgaacctggtttcactttcgggccgtaaaccagtaccggaatgtgttcacgcgtgtggtcagtaccggtccaggtcgggtcacaaccgtggtcagcagtgagaatcagaatatcgtcatcgcgcagcaaagacatcagctccggcagacggcggtcgaacagttccagacccgcagcataaccggcgacgtcgcgacggtggccccaggaagagtcgaagtcaacgaagttggtgaagacgatggtgttatcacccgcttctttcatctctttgatggtggcgtcaaacagcgcgtccaggccggtcgctttcacttttttggtgataccgcagttggcgtagatgtctgcaattttaccgaccgaaaccacctggccgtgtttttcatcaaccagtttctgcagcacggtcggtgctggcggctcaacagccaggtcgtgacggttaccagtacgctggaagttaccagctttgtcgccgataaacggacgagcgataacacgaccgatgttgtagccgccgttggtcagctcttcacgagcgatttcgcacagttcgtagagtttgtccagaccgaaagtttcttcatggcaggcaatctggaacacggagtcagcggaggtatagaaaatcggcttgccggttttcatgtgctcttcgcccagttgatccagaatgaccgtaccggaagagtggcagttaccgaggtaacccggcagattagcgcgttcaaccagtttatccagcagctcttgcgggaagctgttttcgtgatcggagaaatatccccactcaaacagaaccgggacaccggcgatttcccagtgaccagacggggtgtctttaccggatgacatttcgtgcgcccatgcgtacgcgccgataacttcagcgttgccatccattcccgccggaatgaaaccggtagaaccttcgtgtgctttcgccagcccaagacgggtcagatttggcagattgagcgggcctttacgaccgtggtcagcttcgcctttggcacaagcttctgcgatatgacccagggtgtcagccccgacgtcaccaaagcgttctgcatcttctgtagcgccgatgccgaatgagtccagcaccataataaatgcacgtttcatatgttctccgtactcagtgcttcaaatttaaatgatcagatcagtataccgttattcgctgatacggcgatagacagttggtgtgctttccggtgctttatcggcaagtttaattgccgctttcaccgctttcgccgcttcctgccagctgttttcgtctttcgcgtggataactgccagcggacgctgaccgtctacctggtcgcccagacgcgccatatcagtaaagccgacgctgtaatcgatggtgtcagatgcctgacggcgtccgccgcccattgcaaccactgtcatccccagtgcgcgggtatccatttcactgacaaacccttcggtatcagcatagactgctttcgtcagcatcgctgtcggcagatacttcgcgtagttctcaacgaagtcggtcgggcctttttgtgccgcgaccatacgaccaaagacttctgccgctttaccgttgtccagcaccgcctgcaatttcgcgcgcgcttcggcgtcatttttcgccagtttgccggagatcagcatctccacgcacagtgccatcgtgacatcaaacagacgcgggttacgatattcacccgtcaggaactgcaccgcttcacgaacttcaaccgcgttacctgcactggaggccagtacctgattcatatcggtgagcagcgcggtggtgcgcacgccagcgccgttagccacgccaacaatcgcttcggcaagggcttcagagagttcgtaggtcggcataaacgcgccgctacccactttcacgtccatcaccagcgcgtccagaccttccgccagtttcttcgccagaatagaggcggtgatcagcgggattgaatccacggttgcggtaatatcgcgggtcgcgtagaaacgtttatccgccggagccagtgagctggtctggccgataatcgccacgccgacgtctttaataatttcgcggaaacggttgtcatccgggaaaatgtcgaagccagggatggattccagtttgtcgagcgtaccgccagtatgaccgaggccgcgaccggagatcatcggaatatagccgccacaggcagcgaccatcggccccaacatcagcgaagtcacatcgccgacaccgccggtcgagtgt

SEQ ID NO: 10005 - DNA, 44942 bp, Escherichia coli
cgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcgacaggtcagaacaggacgtgttgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcgaagagcccagtcggaagactgggcttttttgcgttggtgcggaataaatgccggatgcgacgcatcttatccgaccttgtattatccctccagtgcagagaaaatcggccagttttctctgcctgcagtccgcatgccgtatccggccttgggttctaacctgtatggtagatttatgcggcggactgcctttctcccgaagtgataaaccggacagtatcatagaccggttttcccggtaatccgtatttgcaaggttggtttcactatggaacatgaacttcattatatcggtatcgacaccgctaaagagaaactggatgtcgatgtgttgcgtcctgatggtcgtcatcgcaccaaaaaattcgctaacaccactaaagggcacgatgagctggtgagttggctgaaatgtcacaagattgaccatgcgcatatctgcatcgaagcgaccggcacctatatggaacctgtcgcagagtgcctttacgatgctggctacatagtgtcagtcattaatcctgcactgggtaaagctttcgctcagagtgaaggactgcgtaacaagactgataccgtggatgccgcatgctggcagagttctgtcgtcagaagcgccctgcagcctgggaagcgcatcacccgcttgaacgcgcgttgcatgccctggtagtacgccaccaggcgctgacagatatgcacaggcaggaactgaatcgcactgaaacggcgcgggaagtccagaggccgagcattgatgctcaccttctgtggcttgaagcagagctgaagcgtcttgagaagcagataaaagacctgacagacgatgatccggatatgaaacaccgcaggaaactgctggaaagcatcccgggtatcggagagaaaacatctgcggtattgctggcttacatggtctgaaggaccgttttgcccatgccagacagttcgccgcttttgcgggtctgacaccacggcgttatgaatcaggcagtagtgtgagaggggcaagccggttgagtaaagccggacatgtgtcgcttcgcaggccgttgtatatgcctgcaatggtagccaccagtaagactgagtggggacgggcgttggcagctaatggcaagaaaggaaaggtgattctcggctcgataatgcgcaagctggcacaggtggcgtatggagtgctgaagtcaggcgtgccgttcgatgcgtcacggcataatccggtagctgcgtaaaaatcgcggaagggatgaaacaacagcgcctgacggcgctgtgtctggcatgcctgcaatccgggagactggaccaggaaaaaacttgctggccgtaacagtatctacgctcccacataagccagattcaacagcgaatacgtcttccccaaattgcccacttccatacttcctccttaccagaaatctatccttaagctccttaataaccattttcctgctaactaaattcatggttaaggttgcataatgatatgcaacaaatgtataacatttttattaccaaaaaataaacaaaagcgaccgacaaaagcatcggattacggcaggagacataatggcatggctgaaagtactgtaacggcagacagcaaactgacaagtagtgatactcgtcgccgtatttgggcaattgttggggcctcttcaggtaatctgatcgagtggttcgatttctatgtctactcgttctgttcactctacttcgcccacatcttcttcccttccgggaacacgacgactcaactactgcaaacagcaggtgtttttgctgcgggatttctgatgcgcccaataggcggttggctatttggccgcatagccgataaacatggtcgcaaaaaatcgatgctattatcggtgtgtatgatgtgtttcggctcactggttatcgcctgtttgccaggctacgaaacaatcggtacctgggctccggcattattgcttcttgctcgtttattccagggattatccgttggcggagaatatggcaccagcgccacctatatgagtgaagttgccgttgaagggcgcaaaggtttttacgcatcatttcagtatgtgacgttgatcggcgggcaactgctagctctactggttgtcgtggttttacaacacaccatggaagacgctgtactcagagagtggggatggcgtattcctttcgcgttaggggctgtgttagctgttgtggcgttgtggttacgtcgtcagttagatgaaacttcacaacaagaaacacgcgctttaaaagaagctggatctctgaaaggattatggcgcaatcgccgtgcattcatcatggttctcggttttaccgctgcggcctccctttgtttctataccttcaccacttatatgcagaagtatctggtaaatactgcgggaatgcatgccaacgtggagagtggcattatgactgccgcattgtttgtattcatgcttattcaaccacttattggcgcgctgtcggataagattggtcgccgtacctcaatgttatgtttcggttctctggcaaccatttttaccgttcctattctctcagcattgcagaacgtttcctcgccttatgccgcttttggtctggtgatgtgcgccctgctgatagtgagtttttatacttcaatcagtggaatactgaaggctgagatgttcccggcacaggttcgcgcattaggcgttggtctgtcatatgcggtcgccaatgctatatttggtggttcggcggagtacgtagcgttgtcgctgaaatcaataggaatggaaacagccttcttctggtatgtgaccttgatggccgtggtggcgtttctggtttcactaacattgcaccgtaaaggaaaagggatgcggctttagtgacgggtcagttgccagacggtatagccggtgcttgcaccggcgatatcccaggcaaaatccttccagctccagccgctcccctcagggcggctatcccaaagctcttttgacgcccccagactgacagagaacatcaatccaaacatggcactgcgatcccggctcatcccctgatgctgtgaatattcatttccggcggcggaaagcatcgccgaggcgataaagtgttgagctttatcctgcccgctccagctatcgttagccatatggctgcatccagaaagtaacaatagcgaacagacaaaaagaatacgcaaaacgtggcctccaaaaaacaaaccccgtacaggacggggttgtgattacaggatgcggctaattaatcggtcgatgcggatacggcgcaaacggcggatgagtttacgaaccttcaccggataatcggcaatactttgcagatcgcgatagtgcttaacgatggtggtatgctcgcggatcagctccagttctttctctcgctgcggcgcaagctccagttgtggatcgtggatcaaaatggcgttttccagatccagacgccaggcgcgtgggttcaggttattaccggtgatcaacatccacttatcatcaacccacatccctttcaggtgataggtgttgtcgtcatctttccataaccgaaccactagctggtcagtattgacgtaatactgcaaacggctcaggaaacgacgcagattgatctcatagagataaggcaatgcgccaattatcttgaaaggttcatcttccggaatgtagaagtcattcgcggttttatcaccaacaataatttcgacctttttcccttcgcgcagcaactggataatattgcgcacaaggattgctggcaggttgaagtatggcgtacagatggttagtttctgctcggcacaaggcataagatggaaaatggtcttgttcaacagactcgatttccccagccccactagcggcgttacggaaagctgatcgttgtcggcatcgccctggaaatgataagcggcatcacgcagctcctggcggaacagacgaatatcgttcttgatttccgggctttttggccgattaacatcatccagacgattaacgccgcggccattcataatattctgtgtaacccattcaaacataatgtctgacatcttacggttacggatcagatgataacggtcgtagcgatatttatcgtgctgatgcaggtaaacatcgttcaggctggcaccgctataaagtacgctatcgtcgatgataaagcctttaaagtgcagaacaccaagggcttcacgggtattgattggaacgccataaaccggaacatctacgcccggattttcctgcgccatgcggcagtaccagtcagcgttagtgttagatgccgcagcgccaatgcgtccacgttgtgcacgatgccagtcgaccagcacccgcacatccagttccggacgctgccttttagcctcatacaacgcgttcagaatgcctttgccaccgtcatcctgttcgagatacagggcgacaatgcaaatgcgctgcttcgcgctggctattttttccagcagcgtctcccggaagtcggcgggagcgtaaaagaaatcgacatcatcaactgattgagaaatcttgggtagttgggcaaggtgttgttgatgtttattacgcttaaattttgacaacatcacagtgcatttcttctctgttcattgaagggtcctctgtgcaatgcagacgacataagcgggcaataataacaccagtcccgattaagtggtcaacatttccagtaccttactcatgattcctcgcgctgggcaagatttagcgtaagcccaacgatcccctcttcgagctggatatcaacgttaaacccgagcttgcgggccagcgccaccatgccacgattgtttggcatcgtaataccattcagacgttgtagtccgtgatctcgcgtataggtaatcaacttttccattaagcgtcgacctaagcctaaccctttgagatccgagcgaaccagcacggcaaattcggcatcgatgttatcagggtcggagatcgcacgtgtgacgccgaggatctcttccgtttgatcaattcgtcgtaccgctacaaatgccatttcccgatcgtagtcgatctgcgtcatgttggctaaatcttcatgggtaaattcgttgatctcgctaaagtagcggtaataaagatcttctttggtgactcgcgaaatgaattgctgaagctgtggctcatcttctggcaaaatcgggcggaacaagcagcgttcaccgtttttcaattctacccattcttccagctgatgcggataagggcgcacagccagccggctctcgttatcaccttcaaacggcgcgatatccagcgtgacatccagcgcggtaaattcactgccagaagccagcaaaggatgaatatccagacgctgaatttccgggcaatcgacaatcaagttggaaacctgcaccagaagctggctcaagcctgcaacatccaatgggcgtagcgcactgcgtgcacgaatctttttacttttgatcccctgaataaccagatagcgggccaggttcatgttcagcggcggcagtgcgacgacggcttgatcttcaggacgccactccacaccgccttcacccagcatgattaacggcccgaaaaccggatcgtgctcaaccacaacccgcaactcctgagcgccagcacggttagccatactttgcaccaacaggccgtggacccgcgcctgcggccaggccatttttacgcgatcgaaaatagcgtttgccgcttgctggacttcattggctgtacgtaggtagagcatgacgccctgaacttccgatttatgtggaatatccggcgagcgcaatttcagtgccaccggatagccaatctgtttggcaatatgtaccgcttcggtgctattactggcaatccaggtagggagagtattcataccatacgcttgcaggatgggctgaacttcatgggtatcgagcgacgtagccccttcggcaatcgcatgttgcaacagaagatgcgcttctgcggtattggaagtcagattgctgggcaacgccggcgtttcgcgtagttgcttctgattacgccggtactcgaccatatgcataaaagcagtgatggttccttccggagtacggtaggtcggcagcccggcttcgctgaataaacgtcgtgcctcttgcgaggagtgctcgccgcaccagttcgtcagcaaagagacatatttgctgcggggatgatgctttaccgcttcaattaatacttgcgcgctttctgttgcgggagcagcggcgctgggcgaatgaataaccatcagcgcatcaaaatcctggctgtggagcagaatgtccagcgttttgacataatgctcgctgctggcgtcatcgcgcagatcgagcgggttagagattgccacatgccctggcagtgcatcgcgcagtttctggcaggtttcttcgcttagcgttgccagcttgccattgcgtgaccataaggcatccagcgccagcgcggcaggcgcagcaccgttgctgataatcatcaaccggtcgccacgcagcgggcgcatatggctaagggtttccaccgccgaaaacagttcgtgggtgtcctgtacccgcaacaaaccggcacgctgaatagctgcatcccacgccggatccattcctgccgtggtgttcaacagacgttgagccgccgggctacgtccgcttttaatcaccagaatcggtttattacgtgaggcgctacgggccgccgaaacaaaacgtcgcgcatcacttaattgttcgagatagagcaggatggcgctggttttactgtcgcgcgccaaatagtcgagcaattcatcaacgtcgatatccaggctgtcgccgagcgcaataaagtaggaaaagcccatctcacgctgttgcgcccagtcgaggatggtgttggagacagcagccgattgcgaaataaacgccagcttgccgcgtttaatcggcacaggtgaaaagctggcattcagaccttgccagggagccagtaagcccagactgtttggtcctagcaggcgcatgttatggcgcagggcgcaggcgcggagatcttcgtgttgcgatgccggggcggaaagaataatgcaggttttacagcctttctcgccgagctcttccagaagagcaagattacggctggcattggtacataaaaccgcaaggtcgggtgtaaagggcaagcgggcaatatccggccaggccaacacacccaacaccgctttccaggctggcgtcaccgggagtaccggtccgttaaagcctcccgccagcaggttacgcatcatcaggtaacctgcgcgattgggtttcatcgatgcgccaattaccgcaatcgattttggtcgcagtagtgcttccagtcctcgctgactcataccggtctcccgcagaagtgaccgaatgattttaaacgctttctaactgttctgctgtgatgcttcccggatgttgcgtttttcctgccagatagcgtgttttaaagcgggtaaaatgctcgcctaaccctgtcgccgccctggtatcgccggccatatctaacagtgcgatggctacctcggcagtacaatattggccttcagcctgggcttcacgcaggcgataggcagaaagccgagaaagatcgacggaaatgacgggaagattatccagatacggacttttacgaaacatcttgcgagcttctggccaggtaccatcgagcatgataaatagcggaggcttaccggcaggtggtgtgaagatcacttcccgttgctcatcagcatacgaagcgggaaagaccaccattggctgatagtccgggttttgcaccagatccagcaaatcttgcgagggttcggtacgcgaccattgaaacgcaacggtatcaggcaaaatatcagcaatcagacgcccggtattactgggcttcattggctcggtgtcgaacatcagcaaacagaagcgactttttgcttgtgctggggtaattgtcgaacagagacataatttctctggcaaaagacagcgttggcagcgacgaacgcgattaccgcgggcaagaaaaggacgtgttgcacgcgcaatacgctcggcgcgtaactggagaacagcgttttcggtcataagggagcgtcgaaaaaacgccattgtcgcagaggagaaaacggggcacaagatgcgccccggtaagattaaagagattcattcagccagctatcgaacggcgctttcggcactgcgccattaagcatgtcgacaacctgaccatttttgaaaatcatgatcgtcggaatactgcgaataccaaagcggctgctcaattcacgttcagcttcggtattcactttcacaaagcgcactttaccgctacgctcttgcgcgacatcttcaaaaattggtgcgaaattacggcaggggccgcaccacggtgcccagaagtcgatcaccacaggtagatcatctttcagcaatttgtcgagcgtttcaccggtcgcattaatcacctctccgtcaaacaagtcgtgaccgcagcgtccgcattttgccgcatcttcgatccgatcgtcgggaatgcgattgatggcctgacaatgggtacaaacggtattcataactaacctcgggatgagtaaggagacttatcggcaacgacgccggtatgtttctaatatgttacatattatcggggacattgttccagacaacaatctgttttattcaatgggtatgatagacacaggctttggaacgaaatcatggcgaaccgcgcggacttcgggtaatctgcgcgcttcgcgcagcgctggtggagaaaagcatgaacgatgaaatgaaaggtaaaagcggcaaggtcaaagtgatgtatgtccgcagtgatgatgattctgataaacgtacccacaacccgcgtaccgggaaagggggcgggcgtccaggaaaatctcgtgctgacggtggccgtcgccccgcccgcgatgacaaacagagtcagcaccgtgaccgcaagtgggaagattcgccgtggcgcacggtttcccgcgcgccgggtgatgagacgccggaaaaggccgatcacggtggcatcagtggtaaaagttttattgatccggaagttttgcgtcgtcagcgtgcggaagaaacccgcgtctacggcgaaaacgcctgtcaggcactgttccagagccgtccggaagcgattgttcgcgcctggtttatccagagcgtaacgccacgttttaaagaagccttgcgctggatggcggcaaaccgcaaagcgtaccatgtggtggatgaagcggaactgacaaaagcgtcaggcacggaacatcacggcggcgtttgcttcctgatcaaaaagcgtaacggtacaaccgtgcagcagtgggtaagccaggcaggcgcgcaggattgtgtactggccctggaaaacgaatctaacccgcataacctgggcggcatgatgcgtagctgtgcgcacttcggcgtgaaaggtgttgtggtgcaggatgcagcactgctggagtctggggcggctatccgtaccgcagaaggcggcgcagagtacgttcagccgattactggcgacaacattgttaacgtgctggatgatttccgtcaggcgggttacaccgtagtgacaacttccagcgagcagggtaaaccgctgttcaaaaccagtctgccagcgaaaatggtactggtgctgggtcaggaatatgaagggttaccggatgccgcacgcgatccgaacgatctgcgcgtgaagattgatggtactggcaacgttgccgggctgaatatctctgtcgcaaccggcgttcttcttggcgaatggtggcgtcagaataaagcctgataaatcagccgggtggcaactctgccatccggcattttcccgcaaatttactcactctctgccggtaatactggcatccagtcaatcggcgtctcgccacgttgttccagccactgatttgccagcacaaaatggttgcagccaaagaatccacgatgcgccgaaagcggcgacggatgcggtgctttcagtacatgatggcgttgcttatctataatcgcccctttcttttgcgcatgtgatccccacaacaaaaacaccacgccttcgcgatgctgatttatgaggctgatgactttatcagtaaacgtctcccagccgaggctggcgtgggaatgcgcctgaccagcgcgaaccgtcaagacagtattgagcagcagaacaccctgacgcgcccagctttcaaggtaaccatgattagggcgggtgaaaccgggaatagtattttccagctctttatacatattcagcagtgacggtggtgtcgcaatgccggggcgaacggaaaatgccagaccatgcgcctgtcctggtccgtgataaggatcctgaccgagaatcaccactttaacgtcacccaactccgtaaagcggaacgcgttaaagacatctttttgtggtggatagatagtgacgccggactgccgctcgctggcgacggtctgaagggtattaagaaaatagggttgctgcttctcttcagccagcacatcatgccaggttaattcgttagccatctcgctctcctgcgaatctttaatccgcctagcttaactgcttctttctacagaacaaaatcatgctcattttatagacaaaaagacatgcaaaaaaatgtaaattggtaaaatttcacatctgcataagttgatgtaaaacaataaaatccatttgtgaccacacttgatatgtggtttttgttgatttaaatcaaagaatcaagggtgtttgaggagtatatatacactcaagcaacaatggttttaccaattggccgcgacaggctgaacaaatcaaataattttgccggggaggcatcacatgattacaggtatccagattactaaagccgctaacgacgatctgctgaactctttctggttgctggacagcgaaaaaggcgaagcgcgttgcatcgttgcgaaagcaggttttgcagaagacgaagtggttgcagtaagcaaactgggtgacattgaataccgtgaagttccagtagaagtgaaaccagaagttcgcgttgaaggtggtcaacacctgaacgttaacgttctgcgtcgtgaaactctggaagatgcagttaagcatccggaaaaatatccgcagctgaccatccgtgtatccggttatgcagttcgctttaactctctgactccggaacagcagcgcgacgttatcgctcgtacctttactgaaagcctgtaaggcttaagtagcaagttactaagcggaagagggcgacctcttccgctttttttcgttaatagaaaatgcgtaccgcgcaatagaccagcaacagggcaagcacgatatttaactggcgaccatactggcgaaacaatcgctgaaacagatgccccgccagcgcccagcacacattgccaaacgtcccaatcatcgccagcaaaacgctgacgccaactacccaacttagcgcctgtgtttgcggcagaacaaacgtcgacagtgccgtaacaccgtacaaaatgattttgacgttcacaaactgcaaagcaaagctggcccaaaaactgattggttttgtctgaagtccgtcttcctttgttgggctggtggcgattttccacgccagccagacaatatatgccgcccccgcccaactcaaaaggtgtaccgctgccgggtcaatcactgccagtgaaaatgaaatgcccgcacacagtaacatcacaatcaaaaatcccagactcatccctgccagcacacgggtactttgacgaaatccatgcgacgtagcagagctaagggcgagaatattgttcggtcctggcgtcatggcggtaatcagggtgtaagtccaaaaagcacttaaaagggtcggtgtcacttgttatctcctctgttttggtagacagtacccgacacggaacatttaaaaaaatgaatgtttttacattctaaattcgatattttcgataggtttggggttatggatctgcgccgttttattacacttaaaaccgtggtggaagagggttcctttttgcgagcttcgcaaaaattgtgctgcacacaatcgacggtgacttttcatattcagcagcttgagcaggagttctcggtacaattgtttgagaaaattggtcgacgaatgtgccttacccgcgaaggaaaaaagctgctgccgcacatctatgaacttacccgagtgatggatacgcttcgtgaggctgctaaaaaagagtcggatccggacggggaactacgcgttatttcaggcgaaacgttgctctcttatcgaatgccgcaggtgttgcagcgttttcggcaacgcgctccaaaagtgcgtttatcgttgcagtcgctgaactgttacgtgatccgtgatgcgctactgaatgatgaggccgatgtcggggttttttatcgcgtagggaatgatgatgctctgaaccgacgagagttgggtgaacaaccgctggcgctggtggcttcaccgcaaattgcagatgtcgattttactgagccgggaagacataacgcctgtagctttattatcaacgaaccacaatgtgtcttccggcagatatttgagagcacgctgcgccagcggcggatcacggtggaaaacaccattgagcttataagtatcgaaagcatcaagcgttgtgtcgcggcaaatatcggagtcagttacctgccgcgttttgcggtggtaaaagagttgaagtgcggagaattaattgaattgccttttggcgaacagtcgcagaccattacggcaatgtgcgctcaccatgccggaaaagcggttagcccggcgatgcacacttttattcagtgtgttgaagagtgttttttgccgggataaaaacaatgccgggcttaaacccggcattgagattactcttctgtcgtttgcggtggcacgcccgttccgcttggtttacggcgcttaccaatatttttagtgtcgcgatggcgttttttcacccgcggcttctctttctctttagcttttttcttctcggcacgtttagccaacactttcttcgatggcttgccggtctgcttctcgcttggcgcacgcgttttcggacgtaactcatcaattacgcgagctttaattggctcttcaatataacggccaactttgcccagcagcagatggtcatgggcttccaccagcgaaatcgcggtgcctttacgaccggcgcgcgcggtacgtccgatacggtgcaaataagtatcgccactgcgcggcatatcgaagttaaagacgtggctgacatccggaatgtcgataccgcgcgcggcaacatcggtagcaaccagtacgtttacgcggccttcggtcaagcgtttaatcgcttcgttacgcttgccttgtaccatctcaccttcgagatagcagttgttgatgcctgcttcgcgcagccagtttgccagctcatgcacacgctcacgcttacgcacaaacacaattgagcgggtcgcttccggctgttttaacagatgcaccagcaacgcggttttatgctcaagatcatcggcgcggtaataccactgatgaatttttttgcgctcacgggtggacggattggcagaaacttccaccggatcttccaacagacgctcggcaaagtcctgaatcgcatcgccttccagcgttgccgaaaagagcagggtctgtttacgccagcgcgtttcgccagcaatatgttcgatatcctgggcgaagcccatatccagcatacggtctgcttcgtcgaggatcagcgtttcaaccgcgcggcaatcgaagttctcttcttttatgtattgcagcagacgtccggtcgtggcgaccacaatgtcctggttttcgctgaacacttctgcgtggttcatataagccacgccgccggtgatggtggcaatatccagatgcgtatgtttcgccagttcgcgggcatgatcggccacctgcatcgccagctcgcgagttggggtgaggatcaaaatacgcggcggaccggatttcttacgtgggaaatcgagcaggtgctgcaacgctggcagcagatacgccgccgttttaccggtgcctgtcggcgcagaaccgagtacatcacggccatcgagcgcaggcggaatggcggcagcctgaatggcggtcgggcgagtgaaacctttatcctggagggcttccagcaggctttcgtcgagttcaagttcggaaaaagtcgttacagtcatgttctacctctgtgtggggcgctgattatagacgttacggctgcaatcttcatctgtttgtatggatatcgcttctcgggtattgttctcacccggtgctatcgccgtttttcctgcaaggttttattttcatgtcacagtctacatccgtgtttcgtcgtaatggatttacttttaaacagttttttgttgctcacgatcgctgtgcgatgaaagtgggaacggatggtattttgctgggcgcatgggcaccggtagctggggtaaaacgttgccttgatatcggcgcgggtagcgggttgctggcattaatgctggcgcagcgaacagatgacagcgtgatgattgatgcagttgaactggaaagtgaagctgccgcgcaagcgcaggaaaatatcaaccagtccccgtgggcagagcggattaatgtccacacggcggatattctgcagtggatcacacagcagacagtacgcttcgatttaatcatcagcaacccaccttactatcagcagggagtagagtgcgcgacacctcaacgggaacaggctcgctataccactacgcttgatcacccatcgttgctgacttgtgcggcggagtgcattaccgaagagggatttttctgcgtggtgctgccagagcagattggtaatggttttactgaactggcattaagtatgggctggcatttacgtttgcggacggatgtggcggaaaacgaagcgcgactgccgcatcgggtgctgctggcattctccccgcaggcgggagaatgctttagcgatcgcttagtcattcgtgggccagaccagaactattccgaagcgtatacggcgctgacccaggctttttatctgtttatgtaatgattgccggcagaaaggatcgatggaccggaatgcgtgagcagttccggataatccagcgtgaaatgcaggccacggctctccttgcgcatcatcgcacagcgaacaatcaactcggcaacctgtaccagattacgcagctccagcaaattatttgagacgcggaaatgggcgtaatattcgtctatttcttgttggagcatggttatccgccgcagggcgcgtgccaggcgcttcgttgtgcgaacaatgccaacgtaatcccacataaacagacgtagctcgtgccagttatgctgaattactacccgttcgtcagggttctcaacgcggctttcatcccacggcggtaacgtactgacgccgtgggcataaggtatacgtctgctgatatcttctgccgccgaccagccatagaccagacactccagcaatgaattcgaggccatgcggttagcgccgtgtaagccggtataactcacttcgccaatggcatacaaaccatcgacgtccgtacgcccatgatcatcaaccattacaccaccgcaggtataatgtgcagcaggcacaatcggcacgggttctttcgtgagatctatccccagcccgagcaatttttcataaatcatcgggaaatgctggcgaataaaatcggcgggcttatggctgatgtcgaggaacatacaatctgcgccgaggcgtttcatttcatggtcaatggcgcgggcgacaatatcgcgcggggccagttcgccgcgctcatcaaaatcgggcataaaacgcgtgccgtccgggcgcttgagataagcgccttcgccgcgcagtgcttccgttaacaggaaattgcgtgcctgtgggtgatacagcgcggtagggtggaactgattaaattcgagattggcaacccggcagcctgcgcgccacgccatagcaatgccatcgccagaagaaatatccggattggtggtgtactgataaacttttgaagcaccgccggttgccagtaccactgcttttgcgtggcaggtttcaaccgtttctttatttcggttccatacccacgcgccaacaacccatcgcgtgcccggcaggccaattttgtcagaaacaatcagatcaaccgcgttgctgcgctccagcacgcgaatattcggatggttctgcgccttgcccaccagcgtggtttctacttctctaccggtggcgtcggcggcatgaagaatacgacggtgactatgtccaccttcacgagtcagatggtagctttcttcgccattcggctgaatgtgggtatcaaacaacaccccctggtcgattagccattgcacacaggatcgtgcattactggcgacaaattcaactgcatggcgatcgcaaataccagccccggcaatcaatgtgtcttccacatgcgagtcaatgctgtcagtttcatcaaacacggcggcaataccgccctgggcataaaatgttgaaccttccgttaccgggcctttacttagaacgatgacctgatgctggtcagccaggcgcagcgccagtgaaagtccggctgcgccgctaccgataatcaacacgtcacatgaatgttcagggagagtattcattttctttgtttaatttactaaacacggtttggtcagcataacatcatgttgtgcgaataaacacctgctattttaatatttgttacagtgactaaacacgctgcctcagggcggcgagaaaacgagaagttactggctggtggaggattaggtggtgaaataaaaaggccgttgggttactcttcaggcagttaaatgggcatttctacacagataatgcgatgttcagattctgtagacttataatgatagataatgatccgtctacagcatgacaaacaaaaacagatgcgttacggaactttacaaaaacgagacactctaaccctttgcttgctcaaattgcagctaatggagtggcgtttcgatagcgcgtggaaatttggtttggggagactttacctcggatgagcgagcagttaacggaccaggtcctggttgaacgggtccagaagggagatcagaaagcctttaacttactggtagtgcgctatcagcataaagtggcgagtctggtttcccgctatgtgccgtcgggtgatgttcccgatgtggtacaagaagcttttattaaagcctatcgtgcgctggattcgttccggggagatagcgctttttatacatggctgtatcggattgctgtaaatacagcgaaaaattacctggttgctcaggggcgtcgtccaccttccagtgatgtggatgccattgaagctgaaaacttcgaaagtggcggcgcgttgaaagaaatttcgaaccctgagaacttaatgttgtcagaagaactgagacagatagttttccgaactattgagtccctcccggaagatttacgcatggcaataaccttgcgggagctggatggcctgagctatgaagagatagccgctatcatggattgtccggtaggtacggtgcgttcacgtatcttccgagcgagggaagctattgataacaaagttcaaccgcttatcaggcgttgacgatagcgggatactggataagggtattaggcatgcagaaagaacaactttccgctttaatggatggcgaaacgctggatagtgagctgcttaacgaactggctcataacccagaaatgcagaaaacctgggaaagctatcacttgatccgtgactcaatgcggggtgatactcccgaggtgctccatttcgatatctcttcacgcgtgatggccgccattgaagaagagccagtacgtcaaccggcgacattgatcccggaagcccagcctgcgccgcatcaatggcagaaaatgccattctggcagaaagtacgtccgtgggcggcacagcttacccaaatgggcgtagcagcatgcgtatcgcttgcagttatcgttggcgtccagcactataatgggcaatctgaaacgtcccagcagcccgaaacgccagtatttaatacactgccgatgatgggtaaagccagcccggttagtctgggagtaccttctgaagcgaccgcaaataatggtcaacagcagcaggtacaggagcagcgtcgtcgcattaatgcaatgttgcaggattacgaactgcaacgccgactccactctgaacagcttcagtttgagcaggcacaaactcagcaagccgctgtacaggtgccaggaattcaaactttaggaacgcaatcgcagtaatgaagcaactttggtttgccatgtcattagtgacaggtagcctgttattctctgctaacgcctcggccactcccgcgtccggggcgttattacagcagatgaacctggccagtcagtcactgaattacgagctgtcattcatcagcatcaataaacagggtgttgagtctctgcgttatcgacatgcacgcctcgataaccgtccgcttgcacagctgttgcaaatggatggcccgcgccgggaagtggtacagcgcggcaatgaaatcagctactttgagccgggccttgaaccgttcacgcttaatggcgattacattgttgattctctgccatcgctcatttataccgatttcaaacgcctttctccttactacgactttatctccgtgggacgcacgcgtattgctgatcgtctttgcgaagtcattcgcgtagtcgcccgtgatggcacacgctacagctacattgtgtggatggacaccgaatcgaaattaccgatgcgggttgatctccttgatcgcgatggtgaaacgctggaacaatttcgcgtgattgcttttaacgtcaatcaggatatcagcagcagtatgcagacgctggcgaaggcaaatttgccgccgttgctttctgttcctgtaggtgaaaaagctaaattcagctggacgccaacctggttgccacagggttttagcgaagtttccagtagtcgacgtccgctaccgacgatggacaacatgcctatcgaatcacgtctctattccgacggattattcagcttctcggtaaacgttaaccgcgctacgccatcgagcagcgatcagatgttgcgcaccggacgcagaaccgtcagtacaagcgtacgtgataacgccgaaatcaccattgtcggtgaactgccgccgcaaacggcgaaacgcattgccgagaatattaagttcggggcagcgcaatgatcaaagagtgggctaccgtcgtctcctggcaaaacgggcaggcgctggtcagttgtgatgttaaagcctcatgcagcagctgcgcttcacgcgccggttgcggtagccgcgtgttgaataaacttggcccgcaaaccacgcataccattgtcgtaccctgtgatgagccgttagtgccggggcaaaaagtagaattaggaatcgccgaaggcagcctgcttagctccgcattactggtttatatgtcgccgctggtgggattattcctcatcgcttcgctatttcagctactctttgcttctgacgtcgcagcattatgtggtgcgatcctcggcggttttggcgggttcctgattgcgcgcggctactcgcgtaagtttgctgcccgggcagaatggcaaccgatcatcttaagcgtggccttgccgcctggccttgtgcgatttgaaacatcttcggaagacgcgagccagtgatttcactggctttgttgcattttgcataacaaatgcgaggacgtttccagataccacaatccatacggtatgaacatttcctcgcctcaatgttgtagtgtagaatgcggcgtttctattaatacagacgttaagctcagaacagcgacttctaaaagcctggttaaccgggcattaaggcacaataatcatactttatgaagaatatacgtaacttttcgatcatagctcacattgaccacggtaaatcgacgctgtctgaccgtattatccagatctgcggtggcctgtctgaccgtgaaatggaggcgcaggttctcgattccatggatcttgagcgtgagcgtggcattaccatcaaagcgcaaagcgtgacgctggactacaaagcgtctgacggcgaaacctatcagcttaactttatcgacaccccgggccacgtagacttctcctatgaagtttctcgttcgctggctgcatgtgaaggtgcattgctggtggtcgacgccgggcagggcgtagaagcgcaaaccctggcaaactgctacaccgccatggaaatggatctcgaagtggtgccggtactgaacaagattgacctgccggcagctgatcctgaacgcgtggcggaagaaattgaagatatcgtcggcatcgacgccactgacgcggtgcgctgttcagcgaaaaccggcgttggcgtgcaggacgttctcgaacgtctggtgcgcgacattccgccgccggaaggcgatccggaaggcccgttacaggcactcattatcgactcctggttcgacaactacctgggcgttgtttcacttatccgtattaaaaacggcaccctgcgtaagggcgacaaagtgaaagtcatgagtaccgggcagacctataacgccgaccgtctgggtatttttacgccaaaacaggttgaccgcactgaactgaaatgtggcgaagtaggctggctggtatgtgcgattaaagatatccacggcgctccagtaggcgataccttaacgctggcgcgtaatccggcagaaaaggcgctgcctggctttaagaaagtcaaaccgcaggtatacgccggtctgttcccggtaagttccgacgactatgaagccttccgtgacgcgctgggtaaactcagcctgaacgatgcctcactgttctatgagccggaaagctcaagcgcgctgggctttggtttccgctgcggcttcctcggtctgctgcacatggagatcatccaggaacgtctggaacgtgaatacgatctggatctgatcaccactgcgccgaccgtagtgtatgaagttgaaaccacgtcaagagaagttatctacgtcgacagcccatccaagctgccagcggtaaataacatctacgaactgcgcgagccgattgcagaatgtcacatgctgctgccgcaggcatatctcggcaacgttattacgctgtgcgtagaaaaacgcggcgtgcagaccaatatggtttaccacggtaatcaggtggcgctgacgtacgagatcccgatggcggaagtggtgctcgatttcttcgatcgcctgaaatctacctcgcgtggttatgcgtctctggattacaacttcaaacgcttccaggcgtccgacatggtacgtgtagacgtattaatcaacggtgaacgtgttgatgcgttggcgctgatcacccatcgtggtaattcgcaaaaccgcggtcgcgagctggtggagaagatgaaagatctgatcccgcgccagcagtttgatatcgccattcaggcagcgattggtacgcacatcattgcgcgctccaccgtgaaacagctgcgtaaaaacgtactggctaaatgttatggcggcgatatcagtcgtaagaaaaagctgctgcagaagcagaaagaaggtaagaaacgcatgaagcagatcggtaacgtcgagctgccgcaggaagcgttcctcgccattctgcacgtcggcaaagacaacaaataacccttaggagttggcatggcgaatatgtttgccctgattctggtgattgccacactggtgacgggcattttatggtgcgtggataaattctttttcgcacctaaacggcgggaacgtcaggcagcggcgcaggcggctgccggtgactcactggataaagcaacgctgaaaaaggttgcgccgaagcctggctggctggaaaccggtgcttctgtttttccggtactggctatcgtattgattgtgcgttcgtttatttatgaaccgttccagatcccgtcaggttcgatgatgccgactctgttaatcggtgattttattctggtagagaagtttgcttatggcattaaagatcctatctaccagaaaacgctgatcgaaaccggtcatccgaaacgcggcgatatcgtggtctttaaatatccggaagatccaaagcttgattacatcaagcgcgcggtgggtttgccgggcgataaagtcacttatgatccggtctcaaaagagctgacgattcaaccgggatgcagttccggccaggcgtgtgaaaacgcgctaccggtcacttactccaacgtggaaccgagcgatttcgttcagaccttctcacgccgtaatggtggggaagcgaccagcggattctttgaagtgccgaaaaacgaaaccaaagaaaatggaattcgtctttccgagcgtaaagagacattgggtgatgtgacgcaccgcattctgacagtgccgattgcgcaggaccaggtggggatgtattaccagcagccagggcaacaactggcaacctggattgttccgccgggacaatacttcatgatgggcgacaaccgcgacaacagcgcggacagccgttactggggctttgtgccggaagcgaatctggtcggtcgggcaacggctatctggatgagtttcgataagcaagaaggcgaatggccgacaggtgtgcgcttaagtcgcattggcggcatccattaatagcccatcttcgttcacgttgtcgccgttatggcgacaacgtgaattatttatgagataaatctcccgtggctaacgacatcccccgtcgttgtgtatagaatattcccccgaagtttaaggttggcacctccaggttgccacggcacacgaaacagcgttggtccccatataccgctaaactgcagcgaagcagttagcagagctatgtatatcaggtctgtttcgtgtgctgaattgttgacgcatttatttattggtatcgcatgaaccccatcgtaattaatcggcttcaacggaagctgggctacacttttaatcatcaggaactgttgcagcaggcattaacccatcgtagcgccagcagcaaacataacgagcgtttagaatttttaggcgactctattctgagctacgttatcgccaacgcgctttatcaccgtttccctcgtgtcgatgaaggcgatatgagccggatgcgcgccacgctggtccgtggcaatacgctggcagaactggcgcgcgaatttgagttaggcgagtgcttacgtttagggccaggtgaacttaaaagcggtggatttcgtcgtgagtcaattctcgccgacaccgtcgaagcattaattggtggcgtattcctcgacagtgatattcaaaccgtcgagaaattaatcctcaactggtatcaaacccgtctggacgaaattagcccaggagataaacaaaaagatccgaaaacgcgcttgcaagaatatttgcagggtcgccatctgccgctgccgacttatctggtagtccaggtacgtggcgaagcgcacgatcaggaatttactatccactgccaggtcagcggcctgagtgaaccggtggttggcacaggttcaagccgtcgtaaggctgagcaggctgccgccgaacaggcgttgaaaaaactggagctggaatgagcatcgataaaagttactgcggatttattgctatcgtcggacgtccgaacgttggcaaatccacattgttgaataaactgctggggcagaagatctccatcacctcccgcaaggcgcaaacaactcgtcaccgcattgtggggatccatactgaaggcgcgtatcaggcgatctacgttgataccccaggcctgcatatggaagaaaaacgcgctattaaccgtctgatgaacaaagcggcgagcagctccattggcgacgttgagctggtgatttttgtcgtagaaggcacccgctggacgccggacgatgaaatggtgctcaacaagctgcgtgatggcaaagcgccggtaatcctcgcggtgaacaaagtggacaacgtgcaggaaaaagccgatctgctgccacacttacagttcctggcaagccagatgaacttcctcgatatcgtgccgatctctgccgaaaccgggctgaatgtcgacactatcgcggcaatcgtgcgtaagcatctgcctgaagcgacccatcacttcccggaagattacatcaccgatcgctcacagcgttttatggcgtctgaaattatccgcgaaaaactgatgcgttttctcggcgctgaactgccgtactccgtgaccgtggagatcgaacgtttcgtctctaacgaacgcggcggttatgacatcaacggtttgattctcgttgagcgtgaagggcagaagaagatggtcattggcaacaaaggggccaagatcaaaaccatcgggattgaagcgcgtaaagacatgcaggaaatgttcgaagcgcctgttcaccttgagctgtgggtaaaagtgaaatccggttgggccgacgacgaacgcgcactgcgcagtctcggttatgttgacgatctttaagagtaactccgatggaaggctggcagcgcgcttttgtcctgcatagtcgcccgtggagcgaaaccagcctgatgctggacgtcttcacggaggaatcgggtcgcgtgcgtctggttgccaaaggcgcacgctctaaacgctctactctgaaaggggcattacagcctttcacccctctcttgctacgttttggcgggcgtggcgaagtcaaaacgctgcgcagtgctgaagctgtctcgctggcgctgccattaagcggtatcacgctttacagcggtctgtacatcaacgaacttctctcccgcgtactggaatacgagacgcgcttctctgaactctttttcgattacttgcactgcattcagtctcttgccggggtcactggtacgccagaacccgcgttgcgccgctttgaactggcactgctcgggcatctgggctatggcgtcaattttacccattgtgcgggtagcggcgagccggtagatgacaccatgacgtatcgttatcgcgaagaaaaagggtttatcgcaagcgtcgttatcgacaataaaacgttcaccggaaggcagttaaaagcgttaaacgcgcgggaatttcctgacgcagacacactgcgcgccgcgaaacgctttacccgcatggcgcttaagccgtatcttggcggtaaaccattaaagagcagggaactgttccggcagtttatgcctaagcgaacggtgaaaacacattatgaatgatgaggattgtcatggctgaattactgttaggcgtcaacattgaccatattgcaacgctgcgtaacgcgcgcggtactgcttacccggatccggtgcaggcggcgtttattgctgagcaggcgggagcggacggcattaccgtgcatttacgtgaagatcgccgccacattaccgaccgcgatgtgtgcatcctgcgccagacgctggatacccgcatgaatctggagatggcggtgaccgaagagatgctggcgatcgccgttgagacgaagccacatttttgctgtctggtaccggaaaagcgtcaggaagtcacaaccgaaggcggcctggacgtcgcagggcagcgtgaaaaaatgcgcgatgcctgcaaacgtctggcagatgccgggatccaggtttctctgtttatcgacgccgatgaagagcagatcaaagctgtggcagaggttggcgcaccgtttatcgagatccacaccggttgctatgctgatgccaaaactgacgccgaacaggcgcaagagttggcgcgtatcgccaaagccgcgacctttgccactagtctcggtctgaaagttaacgccggacacggtctgacctatcacaacgtgaaagccattgccgccatccctgagatgcatgaactgaatatcggtcatgccattattggtcgtgcagtgatgaccggactgaaagatgcggtggcagaaatgaaacgtctgatgctggaagcgcgtggctaatggcaatattaggtttaggtacggatattgtagagatcgctcgcatagaagcggtgatcgcccgatccggtgagcgcctggcacgccgcgtattaagcgataacgaatgggaaatctggaaaacgcaccaccagccagtgcgttttctggcgaagcgttttgctgtgaaagaagcggcggcaaaagcatttggcacagggatccgcaatggtctggcgtttaatcagtttgaagtattcaatgatgagctcggcaaaccacggctacggctatggggtgaggcattaaaactggcggaaaagctcggcgttgtaaatatgcatgtaacgcttgccgatgagcgccactatgcttgtgccacggtaattattgaaagttaaaataataccgttctctttataaagtaaaacccccgaactggtaaggaacgggggttttactttttaactttaattttgtgcagcacacgattccaacgaaaatgattatggatcaatttcgttgacctgtacaagcaacttgcaatctctgacataaaaaacgcgagcctttacgaagaaatcgacattgatgaaaagattaacgtgaccgctttttgataagtacattaaaatcggtttcgttattggcaattttgctgtgctttacaccatgccactgaattcccccattgaaacgagtggtgtcgtcaaagctctggtgtggagtgcagcactcgattccaataactcgcacgttcagttttggggagatgtaagggctaatctgaacggctgcattccttgtttaaggaaaaacgaatgactgattgccgatacctgattaaacgggtcatcaaaatcatcattgctgttttacagctgctccttttgttcttataacacaaggaaacgtacttaaggtgcgtccggtgaaccaatcggacgcgcctttaataactataaataagtgtctgggcagatactatataaattaacttagtgaatgattatgctaatatcatcatttaaataaatataatagcgttaagatttttctataaaataattaacactctacttccagagcagaatattaaattttatccgcgtggtgcatcagcacaaatttatcccacaactgttcttccgtctcgacatgttgcggatctttcacaatagtattggggatcggacacaccttctggcaggttggtgtctcgtagtgccctacgcattcggtacacttatcgctgttaatctcgtagatatgttcacccatcgaaatcgcctcattcgggcattcgggttcacacatatcacaattgatgcattttttagtgattaacagcgccataaggaaactctcaaaacaacacaaaccgggcgggcattatacgcgcattctttactcagaccagttttttcaccagcgcttcgctatgacgaatacgttctggtgccagttccagatcctgctgaatcagcgcaatgaacagcaaatccgttaacattccctgcgcgtgacaagcagagattgaagcactgtttgtcgcttgttcttcggcaatggtatacaggcaatgagaagcacgctgttgcagggcattgggagtaaagccggtaatagccagcacttttccgcccactcgcagcatctcatctgccgccaggtttaactcgcgtcgtacaccggtgtaggaaatggctaataacagatcgtcaggggacgacgcctgtactgtagcgagtagcgcatgcatatcgcgcactgcggcagcattgaagccaatcttcatcagcttccaggcaaagttttgcgccaccagacccgaagcgccaataccggtcagaattatccgccgcgcagagcgcaacattgttacgcattcatgcagtttctcttcagtattaacgtttagcgttgcgtacatagcggcagtattttctttaatcagtttttcgccgaccagccgtaacggatcatcaccgcggatttggttatgaatgggcacggagggagattccggctggcttgccagcgcttcactcaacgccaactttagtgccggaaaacctttatagccgagtttttgcgcgaacttcacgacgctggactgactgactccggcttcgttggccagttgctgagagcttaaatggcgcgccgtatcaggttgtagcagcagataatccgccagttttttatcactctgggcaagcccctggtaacgctgacggatacgaagtaagccgttcatatctttcctcgcgatgaaataatggcgacaacaggcaatatgagacacacgcgagtgaattttatattccattgccgctaattgccatgaattaaaaattccagttagccatgatgcggtcgattgttgccggaaaagtgatgatctatctgttaggctatgtagtagcgaaaattaatcaggatgtttcagtccagaggagtatggtttggcaactcacgagcgtcgtgtggtgttttttgacttagatggaacattgcatcagcaggatatgttcggcagttttttgcgttatttactgcgtcgccaaccgctgaatgcgttacttgttctgccgctgttgccgatcatagccattgcgttattgataaaaggtcgtgcggcacgctggccgatgagtctgcttctgtggggatgcacttttggtcacaatgaagcgcgtttgcaggcgttgcaggccgatttcgtacgctggtttcgtgacaatgttaccgcctttccgctggttcaggagcgattaaccacctacctgttaagttccgatgctgatatctggttgattaccggctctccgcagccgctggttgaagcggtttatttcgatacgccctggctgccgcgggttaatcttatcgccagtcagattcagcgtggctatggtggttgggtattgacgatgcgttgtctgggacatgaaaaggtcgcgcaactggagcgcaaaatcggcacgccgctgcggctgtacagtggctatagcgacagtaatcaggacaacccgctgctttatttctgtcagcatcgttggcgagtaactccgcgcggtgaactccagcaactggaatagagtaaagcatagcgtccgtgtataatgcgccgcgcttttataaccggagttttctttttgtctgaagtcgaatttagccacgaatactggatgcgtcatgcaatgacgctggcgaagcgtgcctgggatgagcgggaagtaccggtcggcgcggtattagtgcataacaatcgtgttattggcgaaggctggaaccgtccgattggtcgacatgatcccaccgcacatgcagaaatcatggccctacggcagggcggtctggtgatgcaaaattatcgtctgatcgacgccacgttgtatgtcacgcttgaaccctgtgtaatgtgtgccggagcgatgatccacagtcgcattggtcgcgtggtctttggtgcgcgtgacgcgaaaactggcgctgcgggatctttaatggatgtgctacatcatccgggtatgaatcaccgggtggaaattacggaaggaatactggcggatgagtgcgcggcgttgctcagtgacttctttcgcatgcgccgccaggaaattaaagcgcagaaaaaagcgcaatcctcgacagattaattttgtttctcttcactcccttttctggaaaatagcagagagggagagtgggtcaaatagtttgatgacgactgggaaagaaacgagagaaaaggaaatttctctttgcccaactccgtaggcgataccgccggataatcctgcgccagttgcatcgccgcttctgtagcctgcttctctttctcttgcagataacccaccaggctaatctgatacttacgaatattttcgacataagcgtaggcttcatgcccacgagcgtagccgtaagtcagcttgctgtaatagggtttctggctaagtaaaggcagacgctgttttacgtcagcccaactgtcaggattccctttggtttttgccgtcagggcacgggcatccagcatatgcgcatagcccatattgtacgcggcgagggcaaaccaaatccgttcgttctccggcacactttccggcactttactcatcatatcctgcaaataacgcacgccgccgctgatgctctgttcggcatcggtacgatccgtaatgccgaggctttgcgcggtatttttggttagcatcatcatgccgcgcacacccgtcggtgaagtggcctgcgcatcccagtgcgattcctgataagcaatagcggccagcaaacgccagtcaatttcttcggcgtatttctcaaacaggggctttaactgcggcagtaccgcatcgacggcgcgtaaaaatgtgcgcgtatcgacgtaatcaaaatcatcgccatgccccaggtatttctcttcaatgcgtgccagcgtaccgtcttcattcatctcattgaagaaatcgagcagagcggcggaaagggtattatcgccatctaacgggctaaaccaggtcaccggttgttcatcggtgatatcgagcgctacggcgagttccgggtgaacacgctgaaacaggctgatggcgacagaatcagcaatggtgtaatcgagttttccttcgatgacatcttccattaattccgcagagccttttttgtcgtctaccttccagcttaattccgggaattttgtgtctttcagggtctggagatcgttaaccaccacgtgacccggtgcaacggtgagttgctccgccgtcaggttgcccagcgtacgtgggcgatactgacccactttataaaccagttgttgtgacacggaataataggtaggaccaggctgataattttttacccgctcactgttatagaccagtcctgccgccagcaggtcggcgttaccattatcgaggtcgtcaaacagctggctgatattctgccgcacggtcactttcagttttacaccgaggtaatcggcaaactgtttcgccagttcgtaatccaggccaaaaggtttcccgttgatttcgttatacgtcaggggagtatgaatggtgctcacacgcaactctccccgcgcttgaatggcggcgatacggttgtcggctttaccaaaccagggaatggatggccagagagcgaccgcgagcagcagtgccagaatgccgatgaacagataattaatctttaattttttcaattagttaattctctgtgtcgtgcgcgtcccagcttgaaaaaacgtaataatagtgaaaggtttactcataaatgagcggcattttgcgtaaacctgcgccagatggcaacttattacagccattggcggcacgcgttgctaattcacgatggtgattttatttccacgcaaacggtttcgtcagcgcatcagattctttataatgacgcccgtttcccccccccttgggtacaccgaaagcttagaagacgagagacttatgatggaaattctgcgtggttcgcctgcattgtcggcattccgaatcaacaaactgctggcacgttttcaggctgccaggctcctggttcacactatttacgccgagtatgtccattttgctgacctcaatgcgccgttaaacgatgatgagcacgcacaacttgaacgcctgctgaaatatggcccggcactcgccagccacgccccgcaaggcaaactcctgctggtgaccccgcgtcctggcaccatctctccctggtcttcgaaagcgaccgatattgcccataactgcgggctgcaacaggtaaaccgccttgagcgcggcgttgcttactatatagaagccggtacgctgaccaatgaacaatggcagcaggttaccgctgaactgcacgaccgcatgatggaaacggtcttttttgctttagatgatgcagagcagctgtttgcacaccatcaaccgactccggtcaccagcgttgatttgctggggcagggccgtcaggcgctaatcgacgctaacctgcgtcttggcctggcactggcggaagatgaaattgactatctgcaggatgctttcacaaggcttggtcgtaatccgaacgacatcgaactgtatatgtttgcccaggcgaactccgagcactgccgccacaaaatttttaacgccgactgggttatcgatggtgaacagcagccgaaatcgctatttaagatgatcaaaaacaccttcgaaaccacgccggatcacgttctctctgcttataaagataacgccgccgtaatggaaggttctgaagtgggccgctactttgctgaccacgaaacgggccgctacgatttccatcaggaaccggcgcatattctgatgaaagtcgaaactcacaaccacccgacggcgatttctccgtggccgggcgcggcgaccggttccggcggtgaaatccgcgatgaaggtgccaccggacgtggcgcaaagccgaaagctggtctggttggtttctccgtatccaacctgcgaattcctggcttcgaacagccgtgggaagaagatttcggtaaacctgagcgcattgttaccgcgctggacatcatgaccgaaggcccgctgggcggcgcggcgtttaacaacgaatttggtcgcccggcactgaacggctacttccgtacttatgaagaaaaagtgaacagccacaatggcgaagagctgcgcggttatcacaaaccgatcatgctggcgggtgggatcggcaacattcgcgccgatcacgtacaaaaaggcgagatcaacgttggtgcgaagctggtcgttctcggcggcccggcaatgaacatcggtcttggcggcggcgcggcgtcttctatggcatctggtcagtctgatgccgacctcgactttgcttccgtacagcgcgacaacccggagatggagcgtcgctgccaggaagtgatcgaccgttgctggcagcttggtgatgccaacccaatcctgtttatccacgacgttggcgcaggcggtctttctaacgccatgccggaactggtgagcgacggcgggcgcggcggtaaatttgaactgcgcgatatcctgagcgacgaaccgggcatgagcccgctggaaatctggtgtaacgaatcccaggaacgctacgtgctggcggttgctgccgatcagttaccgctgtttgacgaactgtgtaagcgtgagcgcgcgccatacgcggtgattggtgaagcgaccgaagaactgcatctttctttgcacgatcgtcattttgataatcagccgattgatctaccgctggacgtactgcttggcaaaacgccgaagatgacccgcgatgtacaaacgctgaaagcgaaaggcgacgcgctggcccgtgaagggatcaccatcgctgacgcggtgaaacgcgtgctgcatctgccgaccgtggcggagaaaactttcctggtgaccatcggtgaccgcagcgtaaccggcatggtagcgcgcgatcagatggtggggccgtggcaggtgccggtcgctaattgtgcggtcactaccgccagcctcgacagctactatggcgaagcgatggcaattggcgaacgtgcgccagttgcgctgctggatttcgccgcttctgcccgtctggcggtcggtgaagcgttaaccaacatcgccgcaacgcagattggcgatatcaaacgcatcaaactttccgccaactggatggcggcggcaggccaccctggtgaagatgcgggcctgtatgaagccgttaaagctgtgggcgaagaactttgtccggcgctgggcctgacgataccggtgggtaaagactctatgtcgatgaaaacccgctggcaggaaggtaacgaagagcgcgaaatgacgtcgccgttgtcgctggtgatttccgcatttgcccgcgtggaagatgtacgtcacaccattacgccgcagctttctaccgaagataacgcactgttgctgattgatttgggcaaaggcaataacgcgctgggcgcaacggcactggcgcaggtttatcgtcagcttggcgacaaaccggcagatgtacgcgatgttgcccaactgaaaggcttctatgacgcgattcaggcgctggttgcacagcgtaagctgctggcgtatcacgaccgctctgatggcggcctgctggtaacgctggcggaaatggcctttgctggtcattgtggcattgacgcggatatcgccactctgggtgacgatcgcctggcggcgttgtttaacgaagaactgggtgcggtgattcaggtgcgagccgctgaccgtgaagccgttgaagcggtactggcacagcatgggcttgctgattgcgtccattatgttgggcaggcggtttccggtgaccgttttgtgattaccgccaacgggcagactgtatttagcgaaagccgcaccacgttgcgtgtctggtgggcagaaacgacctggcagatgcagcgtctgcgtgacaacccggagtgtgccgatcaggagcaccaggcgaaatcaaacgacgccgatccgggcctgaatgtgaaactgtcgtttgatatcaacgaagatgtggcagcaccgtttattgccactggcgcgcgcccgaaagttgccgtactgcgtgagcagggtgtgaactcccatgttgaaatggcggcagctttccaccgtgcgggcttcgatgctatcgacgtgcatatgagcgatctgctggctggacgcacgggcctggagggtttccacgtcctggtagcgtgcggtggtttttcctacggtgatgtgctgggcgctggtgaaggttgggcgaagtctatcctgttcaatgaccgtgtacgcgatgagtttgcaaccttcttccatcgtccgcaaacgctggcgctgggggtatgtaacggttgccagatgatgtctaatctgcgtgaactgatcccgggtagcgagttgtggccacgttttgtgcgtaacacctccgatcgctttgaagcgcgtttcagtctggtagaagtaacccaaagcccgtcgctgctgttgcaggggatggtgggctcgcagatgccgattgctgtctctcacggtgaagggcgcgtggaagtgcgtgatgcggcgcatctggcggcactggaaagcaaagggctggtggcactgcgctatgtcgataacttcggcaaagtcactgaaacctacccggctaacccgaacggttctccgaatggtattacggcagtcacgactgaaagtggtcgagtcaccattatgatgccgcacccggaacgtgttttccgtactgtcagcaactcctggcatccggaaaactggggcgaggatggcccatggatgcgcattttccgcaatgcacgtaagcagttggggtaagtcgtcaacccattggtattgcagcccggatgaggcattcacgccgcatccggcattaagcaccaaccgctattatgagctcccaacttcgggagcttttttgtgtctttaaatcacgacaatgggtggtttgccgtgtcgctttttggtgacacttaactcattgattttaatattatctaataagtttatcttaagttgtctctttttagcgacacagtggctgatttacattcaaatagtggagaagccataaacccctcaaagcagtttataatcagtacgttaccaaactattttctttattggcacagttactgcataatagtaagcagtggctcattcaccgacttatgtcagccccttcgggacgtgctacataaaattcgaatgacgcacaacaaggtgcctgccgtccaacttctgatatcagcgtagctatatcaaccatcgggcgaaacgtcgagttaggcaccgccttattccataacaaagccgggtaattcccggctttgttgtatctgaacttcccctcggttagcatcaggctattcgcgtctgacgagagtaacgccttgaaccgctggcccgtttttccccgctcattacgacaactggtaatgctggcatttttgctgattctgctgcccctgttggtgctggcatggcaagcctggcaaagcctgaatgcacttagcgatcaggcggcgctggttaaccgcactacgcttattgatgcccggcgcagtgaagcgatgaccaacgcggcactggagatggagcgcagctaccgtcagtactgcgtgctggacgaccctacgcttgcgaaggtttatcaaagccagcgcaagcgttacagcgaaatgctcgatgcccacgcaggcgtgctgccggacgataaactctaccaggcattacgtcaggatttgaataatctggctcaacttcagtgtaacaacagcggtcccgatgctgctgccgccgcgcgtctggaagcctttgccagtgccaataccgaaatggtgcaggccacgcgcacagtggtgttctctcgtgggcagcaacttcagcgtgaaatcgccgaacgtgggcaatattttggttggcaatcgctggtgctatttctggtgagtctggtgatggtactgcttttcacgaggatgattatcggtccggtgaaaaatatcgagcgcatgatcaaccggctgggggaagggcgttctctgggcaatagcgtctcgttcagtggaccgagcgagttacgctcggttgggcaacgtattctttggttaagtgagcgcctgtcatggctggaatcccaacgccatcaatttttaagacatttatctcatgaattaaaaacgccactggcgagtatgcgcgagggcactgaattactggctgatcaggttgtcgggccgcttacgccagagcaaaaagaggtggtgagcattcttgatagcagcagccgcaatttgcaaaagctgatcgaacaactgcttgattacaaccgtaaacaggcggacagtgcggtggaactggagaatgttgagttagcaccgctggtggagacagtggtttctgctcatagcctgcccgcacgggctaaaatgatgcataccgacgttgatctcaaagcaacagcttgcctggcggagccaatgctgctgatgagcgtactggataatctttactccaatgcggtgcactacggggctgaatccggtaacatttgccttcgcagcagtttacatggtgcgcgggtttatattgatgtcatcaatacaggcacgcccattccgcaagaggaacgcgccatgatcttcgaacccttttttcagggaagccaccagcgaaaaggggcggtgaagggcagcggtctgggattaagcattgccagggattgtattcgccgtatgcaaggggaactgtatctggtcgacgagagcgggcaagacgtttgtttccgcattgaattaccgtcgtcgaaaaacacgaaataatgctaacagcccatcccatcaggctattttatttgtcagttcggccccgggcagtgctcgaaatcttcacgtacgacatgtacgctctggtttctccgcgctgtccatgtccaaactgcctgcaacaattacgcccactgggataggctttaagtctggtgaatatgcgacacatttttcaacgattattgccccgacggctgtggctggcagggctgccatgtctggcattgctgggttgcgtgcagagtcacaataagccagccattgatacgccagcagaagaaaaaattccggtttatcaactggctgactatctttctactgaatgtagcgacatctgggcgctgcaaggtaaatcaaccgaaaccaatccgctttactggctgcgggcgatggattgtgctgatcgtttaatgcctgcgcagtcgcgtcagcaagcccgccaatatgacgacggcaactggcaaaatacctttaaacaagggattttgctcgccgacgccaaaattacgccgtatgagcgccgccagctggtcgcgcgcattgatgcgctaagtaccgagatcccggcacaggttcgcccactgtatcaactctggcgcgacggtcaggcgctgcaactgcaactggcggaagagcgccaacgctacagcaaactccagcagtccagcgacagcgagctggatactttgcgccagcaacatcacgttctacaacagcaactggaactcactacccgcaagctggaaaacctgaccgatattgaacgccagctctcgacccgcaaaccggctggaaatttctcgccggatacgccgcacgagagtgaaaagcccgcgccatccaccgatgaggtcactcctgatgagccataaacctgcgcatttattactggtcgatgatgatccgggattgctgaaactgcttggcctgcgcctgaccagcgaaggctacagcgtggtcacggcggaaagtggcgttgaaggattacgggtactgaatcgcgaaaaagtagatttagtcatcagcgacctgcggatggatgaaatggatggtatgcagctatttgctgaaattcagaaagtgcagccgggaatgccagtaattattcttaccgcgcatggttctattcctgatgccgttgctgcaacacagcagggcgtgttcagttttctcaccaagcctgtcgataaagatgcgctatatcaggtaattgacgatgcgctggaacaatccgcgccagccaccgacgaacgttggcgcgaggcgattgtcacccgcagcccgctgatgctgcgcttgctggaacaggcgcggctggtggcacaatcagacgttagcgttttgattaacggccagagcggcaccgggaaagagattttcgcccaggctatccacaacgccagcccgcgcaacagcaagccatttattgctattaactgtggcgcattacccgagcaattgctggagtcggagctgtttggtcatgcacgtggcgcgtttactggcgctgtcagcaatcgcgaaggtttattccaggcggcggaaggcggtacgctatttctcgatgagattggcgatatgcccgcaccgttgcaggtcaaactgctgcgcgtgttgcaggagcgtaaagtgcgcccgctgggcagtaaccgcgatattgatatcgacgtgcggattatttctgcgacccaccgcgacctgccaaaagcgatgacgcgcggggaattccgtgaagacctctattaccgcctcaacgttgtcagcctgaaaattccggcactggcggagcgcacagaagacattccgctactggcaaatcacctgttgcgccaggcggcagagcgacataaaccgtttgtccgcgcgttctccaccgatgcaatgaaacgcctgatgactgcgagctggccgggcaacgtgcgccagttggtcaacgtgattgaacagtgcgtggcgctgacatcatctccggtaattagtgatgcgctggtggagcaggcgctggagggcgaaaacacggcgctgccaacctttgttgaggcgcgtaatcagtttgaactcaactatttgcgtaagctgctgcaaatcaccaaaggcaacgtcacccacgcggcgagaatggcggggcgcaaccggacagaattttataaactgctttcccgacacgaactggatgcaaacgatttcaaggaatgaattggcgttatgtgttacgtttagcagatcaaaagacaggcgaccttttcaaggaatagcatgaaaaagattgatgcgattattaaacccttcaagctggacgatgtccgcgaagcactggctgaagtcggtattaccggcatgacggtcactgaggtgaaaggttttggccgccagaaaggccataccgagctgtaccgcggtgcggagtatatggtggattttctgccgaaagtgaaaattgagattgtcgtaccggacgacattgtcgatacctgtgtcgataccattattcgcacggcgcaaactggcaaaatcggtgacggtaaaatcttcgtcttcgacgtggcacgggtcattcgcatccgtaccggtgaagaggacgacgcggcaatttaaaacgcgtcaagggttgccggatgtttccatccggcaacatcaaatcacagcaccttatgcgggccaaagcattcgtaatgaatgttttcctgtttcacgcccagatccactaactgtttcgcggcaaactgcatgaagccaaccgggccgcagagatagaactgcattgtcggatcgctgaacgcaccttccagtttgctcaaatccatcagaccttcgctatcaaactgacctttagcgcgatcggcttcattcggctgacgataccaggtgtgtgcggtaaagcgtggcagtgattgacccagttccttaacttcatcggcaaaggcgtgaacatcgccattttctgccgcatggaaccagttcacttgtgctgtgtggcctgcttttgccagcgtgtcgagcattgccagcattggcgtttgaccgacaccggcagagattaacgtcactggtgtgtcatctgcgacagccataaagaaatcacctgccggagcgaccagtttcacgacatcgccaacattggcgtgattgtgcagccagttggatacctgcccaccctcttcgcgtttcaccgcaatacgatagcctttgccatccggtttgcgagtcaaagagtactgacgaatttcctgatgcgggaaaccttccggcttcagccagacgccgagatattgccccggacggtattctgccactgcgccaccgtcgaccggctccagttcgaagctggtgataagtgcgctgcgtggtgttttagccacaatgcggaaatcgcgagtaccttcccaaccaccggctttgctggcgttttcgttatagatttccgcctcgcgattgataaatacattagccaggacgccataggctttaccccacgcgtccagcacttcctgccccgggctgaacatttcgtccagcgttgccaacaggtgttcaccgacgatgttgtactgttccggtttgatctggaaactggtgtgcttctgcgcgattttttctaccgctggcagcagcgcaggcaggttttcaatattgctggcgtaggcggcaatagcgttaaacagggcttcacgttgatcgccattacgctggttactcatgttaaaaatttctttgagttctgggttatgagtaaacatacggtcgtagaaatgggcggttaactttggtcccgtttccaccagtaaagggatggtggcttttactgtagcgatggtttgagcgtcaagcatatggtcttccttttttttgcatcttaattgatgtatctcaaatacatcttataaaaaatagccctgcaatgtaaatggttctttggtgtttttcagaaagaatgtgatgaagtgaaaaatttgcatcacaaacctgaaaagaaatccgtttccggttgcaagctctttattctccaaagccttgcgtagcctgaaggtaatcgtttgcgtaaattcctttgtcaagacctgttatcgcacaatgattcggttatactgttcgccgttgtccaacaggaccgcctataaaggccaaaaattttattgttagctgagtcaggagatgcggatgttaaagcgtgaaatgaacattgccgattatgatgccgaactgtggcaggctatggagcaggaaaaagtacgtcaggaagagcacatcgaactgatcgcctccgaaaactacaccagcccgcgcgtaatgcaggcgcagggttctcagctgaccaacaaatatgctgaaggttatccgggcaaacgctactacggcggttgcgagtatgttgatatcgttgaacaactggcgatcgatcgtgcgaaagaactgttcggcgctgactacgctaacgtccagccgcactccggctcccaggctaactttgcggtctacaccgcgttgctggaaccaggcgataccgttctgggtatgaatctggcgcatggcggtcacctgactcacggttctccggttaacttctccggtaaactgtacaacatcgttccttacggtatcgatgctaccggtcatatcgactacgccgatctggaaaaacaagccaaagaacacaaaccgaaaatgattatcggtggcttctctgcatattccggcgtggtggactgggcgaaaatgcgtgaaatcgctgacagcatcggtgcttacctgttcgttgatatggcgcacgttgcgggcctggttgccgctggtgtctaccctaacccggttcctcatgctcacgttgttactaccaccactcacaaaaccctggcgggtccgcgcggcggcctgatcctggcgaaaggtggtagcgaagagctgtacaaaaaactgaactctgccgttttccctggtggtcagggcggtccgttgatgcacgtaatcgccggtaaagcggttgctctgaaagaagcaatggaacctgagttcaaaacttaccagcagcaggtcgcgaaaaacgccaaagcgatggtagaagtgttcctcgaacgtggctacaaagtggtttctggtggtactgataaccacctgttcctggttgatctggttgataaaaacctgaccggtaaagaagcagacgccgctctgggccgtgctaacatcaccgtgaacaaaaacagcgtaccgaacgatccgaagagcccgtttgtgacttccggtattcgtgtaggtactccggcgattacccgtcgtggctttaaagaagccgaagcgaaagaactggctggctggatgtgtgacgtgctggacagcatcaatgatgaagccgttatcgagcgcatcaaaggtaaagttctcgacatctgcgcacgttacccggtttacgcataagcgaaacggttaatctgttgaaaaaaggcttccttcgggaagcctttctacgttatcgcgccatcaaatctgccgtaactgcgcctcaacatacaaatagccaattcccagtacctgttgtgcgcggcttaattgcccaaagccaatctgtgtcgctttcacgctcggtccttcgtcgcggtcgaacgggttaaatcccgtctggcgaataatggtattaagccagttctcaccaaaggcacaactgcgaccgtacaaccaaatctgattaatattgaggatgttgaggaagttatacagactcaaaccaatggcgttggcactgtggtcaacccaactggtgatccacggttctccactctgccaggcagcgattaactgcgcggtagtcaatttttcaggatcaagctgagtattaaccggttgtgattttagccatacccgcgcctgtttttttaatgcgcttaacgaggcgacggtttccaggcagccataacgcccgcagtcgcagacgacgccatccggattaacgatggtgtgaccaatctgtccactgccatacaaactgccgcgataaatttgctcgttaatcacgaacgacgagccaatgccgtaatcaacgttgattacgcagaaatcacgcacttgtgaattattttgccatttctccgccagcgccagcatcacgcagtcattatcgaccattacccgaatgcccagcttctcttccagcaggtacttcacctcaatcggtgttgcccacggcgcttgcggcatggtttgcgacacgccggtcactggatcaacctgaccgtggattgccagagccagattgatggtgcggtccggccacaatttacggtggcgatgccagcatttttcgatttcggacagcagcgcctgcggcgtcggtgcatcaatctgtaaatactcaaattcgcctttcggacttaaacaggcattagcgacctgacactcaatgctggtgggcgtcacgttcaggcacagcgtccagtctccttccggcgcaatcagccatgtaccgctactatgcccgcgcgtctggctttcatcgtcgatattcaccacccgtttttcgctttcca

SEQ ID NO: 10006 - DNA, 42320 bp, Escherichia coli
tgttgaccaagaacgtcaaggttgtcggtgaaccgcctgaagaaccaagcctgctggcttctatcttcatctcctggttcccgatgctgttgctgattggtgtctggatcttcttcatgcgtcaaatgcagggcggcggtggcaaaggtgccatgtcgtttggtaagagcaaagcgcgcatgctgacggaagatcagatcaaaacgacctttgctgacgttgcgggctgcgacgaagcaaaagaagaagttgctgaactggttgagtatctgcgcgagccgagccgcttccagaaactcggcggtaagatcccgaaaggcgtcctgatggtcggtcctccgggtaccggtaaaacgctgctggcgaaagcgattgcaggcgaagcaaaagttccgttctttactatctccggttctgacttcgtagaaatgttcgtcggtgtgggtgcatcccgtgttcgtgatatgttcgaacaggcgaagaaagcggcaccgtgcatcatctttatcgatgaaatcgacgccgtaggccgccagcgtggcgcaggtctgggcggtggtcacgatgaacgtgaacagactttgaaccagatgctggttgagatggatggcttcgaaggtaacgaaggtatcatcgttatcgccgcgactaaccgtccggacgttcttgacccggccctgctgcgtcctggccgtttcgaccgtcaggttgtggttggcttgccagatgttcgtggtcgtgagcagatcctgaaagttcacatgcgtcgcgtaccattggcacccgatatcgacgcggcaatcattgcccgtggtactcctggtttctccggtgctgacctggcgaacctggtgaacgaagcggcactgttcgcagctcgtggcaataaacgcgttgtgtcgatggttgagttcgagaaagcgaaagacaaaatcatgatgggagcggaacgtcgctccatggtgatgacggaagcgcagaaagaatcgacggcttaccacgaagcaggccatgcgattatcggtcgcctggtgccggaacacgatccggtgcacaaagtgacgattatcccacgcggtcgtgcgctgggtgtgactttcttcttgcctgagggcgacgcaatcagcgccagccgtcagaaactggaaagccagatttctacgctgtacggtggtcgtctggcagaagagatcatctacgggccggaacatgtttctaccggtgcgtccaacgatattaaagttgcgaccaacctggcacgtaacatggtgactcagtggggcttctctgagaaattgggtccactgctgtacgcggaagaagaaggtgaagtgttcctcggccgtagcgtagcgaaagcgaaacatatgtccgatgaaactgcacgtatcatcgaccaggaagtgaaagcactgattgagcgtaactataatcgtgcgcgtcagcttctgaccgacaatatggatattctgcatgcgatgaaagatgctctcatgaaatatgagactatcgacgcaccgcagattgatgacctgatggcacgtcgcgatgtacgtccgccagcgggctgggaagaaccaggcgcttctaacaattctggcgacaatggtagtccaaaggctcctcgtccggttgatgaaccgcgtacgccgaacccgggtaacaccatgtcagagcagttaggcgacaagtaagttcccgtatcagatgactgtatttgtaccgaaaaccccggggcgtgctccggggttttttcttatcaattcataccagggataacatcatgaaactctttgcccagggtacttcactggaccttagccatcctcacgtaatggggatcctcaacgtcacgcctgattccttttcggatggtggcacgcataactcgctgttagatgcggtgaaacatgcgaatctgatgatcaacgctggcgcgacgatcattgacgttggtggcgagtccacgcgcccaggggcggcggaagttagcgttgaagaagagttgcaacgtgttattcctgtggttgaggcaattgctcaacgcttcgaagtctggatctcggtagatacatccaaaccagaagtcatccgtgagtcagcgaaagttggcgctcacattattaacgatatccgctccctttccgaacctggtgctctggaggcggctgcagaaaccggtttaccggtttgtctgatgcatatgcagggaaatccaaaaaccatgcaggaagcgccgaagtatgacgatgtctttgcagaagtgaatcgctactttattgagcaaatagcacgttgcgagcaggcgggtatcgcaaaagagaaattgttgctcgaccccggattcggtttcggtaaaaatctctcccataactattcattactggcgcgcctggctgaatttcaccatttcaacctgccgctgttggtgggtatgtcacgaaaatcgatgattgggcaattgctgaacgtggggccgtccgagcgcctgagcggtagtctggcctgtgcggtcattgccgcaatgcaaggcgcgcacatcattcgtgttcatgacgtcaaagaaaccgtagaagcgatgcgggtggtggaagccactctgtctgcaaaggaaaacaaacgctatgagtaatcgtaaatatttcggtaccgatgggattcgtggtcgtgtaggggatgcgccgatcacacctgattttgtgcttaagctgggttgggccgcgggtaaagtgctggcgcgccacggctcccgtaagattattattggtaaagacacgcgtatttctggctatatgctggagtcagcactggaagcggggcttgcggcagccggtctttccgcgctattcactggcccgatgccaacaccggccgtggcttatctgacgcgtaccttccgcgcagaggctggaattgtaatttctgcatcgcataacccattctacgataacggcattaaattcttttctattgacggtactaagctgccggatgcagttgaagaagccatcgaagcggaaatggaaaaagagatcagttgtgttgattcggcagaactgggtaaagccagccgtatcgttgatgccgcgggtcgttatatcgagttttgcaaagccacgttcccgaacgaacttagcctcagtgaactgaagattgtggtggattgtgcaaacggtgcgacttaccacatcgcgccgaacgtactgcgtgaactgggggcgaacgttatcgctatcggttgtgagccgaacggtgtaaatatcaatgccgaagtgggggctaccgacgttcgcgcgctccaggctcgtgtgctggctgaaaaagcggatctcggtattgccttcgacggcgacggcgatcgcgtgattatggttgaccatgaaggcaataaagtcgatggcgatcagatcatgtatatcatcgcgcgtgagggtcttcgtcagggccagctgcgtggaggtgctgtgggtacattgatgagcaacatggggcttgaactggcgctgaaacagttaggtattccatttgcgcgcgcgaaagtgggtgaccggtacgtactggaaaaaatgcaggagaaaggctggcgtatcggtgcagagaactccggtcatgtgatcctgctggataaaaccactaccggtgacggcattgttgctggcttgcaggtgctggcggcgatggcgcgtaaccatatgagcctgcacgacctttgcagcggcatgaaaatgttcccgcagattctggttaacgtgcgttacacagcaggcagcggcgatccgctggagcatgagtcagtcaaagctgtgaccgcagaagttgaagctgcgctgggtagccgtggacgtgtgctgttgcgtaaatccggcaccgaaccgttaattcgcgtgatggtggaaggcgaagacgaagcgcaggtgactgaatttgcacaccgcatcgccgatgcagtaaaagccgtttaaaacgataaatggctggctaaaaaggcggcgattgtcgccttttttctcagcgaacacatcggttttgctgtttttttccgcagttgatacaatgcaataaaattgcccttgcgaaggtcattcgctttggttagtattcacacccgcttcagtgggaaagattaaaaactcccgctttattggttgaagcattggtacgcggcaactccgcaaggaacaggttgattatgtacgaagctcttttagtagttttccttattgtggcaattggccttgttggtctgatcatgctgcagcaaggtaaaggcgctgatatgggagcctccttcggagcaggcgcttccgctacgctgtttggttcaagtggttctggtaacttcatgacccgcatgacagcgctgctggcaacgttattcttcatcatcagtctggtgctgggtaacatcaatagcaacaaaaccaataaaggtagcgaatgggaaaacctgagtgcgccggcgaaaaccgaacaaactcagccagctgctccggctaagccgaccagcgatatcccgaactaaaaagtagtatccgtgccgaggtggtggaattggtagacacgctaccttgaggtggtagtgcccaatagggcttacgggttcaagtcccgtcctcggtaccaaattccagaaagacgctgaaaagcgtcttttttcgttttggtcctggtctgaggaatggttgtcaggtatctgtatctcgtccagttgctttactcgtagctggtactttgaaacgatggtgccggtacgccttagttataaacttttcccttctgctgacataattggcactttattgtgtcaactccagttccggtacgaatacggatatgtttacttctcgataaaccatcctgctcctgtcagtataactactgatggctacgttctgcgtaatgtttagagacgcattgataatgttatttaattactgagaacaatggccgcatcatttaaaaagaaaaaactaacagtgtttcggtctgatatggatcagagttgaaaaacatgtctgatataaaattgaacattgttgataattgtttatattggttgtgaacttggatttctggatgacagtattcaacaaatttgttagaagttttaaatctcattggttgttgtatctttgtgttattgtttttggtattacgaacttagtcgcctcttccggagcacatatggttcagcgattgctgtttttcgttctgaccatcctggttgttaaacgtatatcatcccttccgcttcgcctgcttattgccgtaccatttgtgttactgactgcggcagatatgagtattagcctctattcatggtgtatctttggtacaactttcaatgatggatttgcgattagtgtgctgcagagtgatccggatgaagttgtcaaaatgctgggaatgtatatcccttatctatgtgcttttgcctttttatcccttcttttttttgcagtaataataaaatatgatgtttccttgccgacaaaaaaagtgacaggaatattattgctgattgtcatttcgggcagtttattttccgcttgtcaatttgcttataaagatgcaaaaaataaagaggcgttcagtccatatatactagcgtcgcgatttgctacctatacgccgtttttcaatctcaattattttgctttagcagcgaaagagcatcaaagattactctcaattgcaaacacggtgccgtattttcaactatcagtcagggatacaggtattgatacctacgtgttgattgtgggggagtctgtacgtgtcgacaatatgtctttgtatggatatacacgctctacgacaccgcaagtcgaagcacaaagaaagcagatcaaactgtttaatcaagcaataagcggtgcaccttacactgcgctgtcggttcccctttctttaactgctgattctgttttgagtcatgacattcataattacccggacaacattattaatatggctaatcaagcaggatttcagactttctggctaagctcgcaatccgatttccggcagaatggtacagcagttaccagtatcgccatgcgcgccatggaaacagtctatgtcagaggatttgatgaattgttgttgccgcatttatcgcaagcgttacagcaaaagacgcagcaaaaaaaactgattgttcttcatttaaatggaagccatgaaccggcttgtagcgcctatccgcaatccagcgccgtgtttcaaccgcaggacgatcaggatgcctgctatgacaactccattcattacacagatagtttgctaggtcaggtttttgaattattaaaagatcgccgcgcctcggtcatgtattttgccgaccacggcctggaacgcgaccctacgaagaagaacgtctattttcatggaggtagggaggctagccagcaggcatatcatgtccctatgtttatctggtatagccccgttcttggggatggcgtggatcgcacaacggaaaacgatatcttttccactgcgtacaataattaccttattaatgcgtggatgggggtaacaaagccggaacagccgcaaacgctggaggaagtgattgcacactataaaggagactcacgggttgtagatgcaaaccatgatgttttcgattttgtgatgctaagaaaggaatttactgaggataagcaaggtaaccccacccctgaagggcagggttgatgtcgaattactggcctttattttccagattctccacctgcggcacgcctgaagtggcagaggaggagagcaggccagttttggcataaccaaaaagtttctctcgggtatcagtgatatccagattacgcatggtcaattgaccaatacgatcatctggcgagaacaccgagtcgcctttttccatcgtcagacgctctggcttgtaggtcaggttctctgagacggtattcaggattgaataatcgttcccgcggcgcagctccagagtaacttcaccagtgatctggctggcaacccagcgttgcagagagtcccgcagcatcagcgcctgggaatcaaaccaacgcccctggtacagcagacggcccaactgacgaccatgtgcatgatactgctcgatggtgtcttcgttgtgaataccggtcagcagacgttcataagcgatatgcagcagcgccatccccggagcctcgtaaataccacggcttttcgcttcgatgatacggttttcaatctggtcgctcatgcccaggccgtgacgaccgccgatgcggttagcttccagcaacatttctacgtcgtcgctaaaggttttaccgttcagcgccaccggatgaccttgctcaaagcgtactgtgacttcttctgccgggattttcacgctctcatcccaaaacttcacgcccataattgggttgacgattttgacgctggagttgaggtattccagatccttcgcttcatgcgttgcaccaagcatgttggagtccgtggagtaagctttttcgacagacattttgtagtcgaaaccgcaggcaatcataaattcagacatctcatgacggccgcccagttcatcaataaagtcagtatcaagccacggtttgtaaatctgcagttcagcattggtcagcagaccgtaacggtagaaacgttcgatatcgtttcctttataggtgctgccgtcaccccagatattcacgccatcttctttcatagcagcaaccagcatggtgccggtcacggcgcggcccagcggcgtcgtgttgaaataggtcagtccaccagtggtgttatgaaatgcgccacactgaatagcggcaataccttcggccaccagttgtttgcggcagtcgatcagacgtgcgttctccgcgccgtattccatggcacgacgagggatcgcatcataatcctcttcgtctggctggcccaggtttgcagtatatgcataaggaacagctcccttttgtcgcatccacagcagtgcggcactggtgtccagaccgccggaaaaagcgataccaatacgttgacctaccgggagatgcttgagaatcgtcgtcataaaataacaccctgcttaattaactgatgatgagcctggatttctgctctcactgaatttttatgcaaaataaatgagttttcatttaatcatcttttatcggagacaggaagagtttagtgtgttttttgtaaaataatgcgcttaagggaaagcaggagaaggtaaaagtattcaacaaatgaaagtgaactggatattcattcacgtgattagcaataaacgttgacaaaatgtggcgtggatcactataatgcctgcagattttacgtcccgtctcggtacaccaaatcccagcagtatttgcattttttacccaaaacgagtagaatttgccacgtttcaggcgcggggtggagcagcctggtagctcgtcgggctcataacccgaaggtcgtcggttcaaatccggcccccgcaaccactttcccttagagtcctttttcaaatatactgtgaagacttcggccttcgtagtgggatttgaaaaaatccttctggaaagtgctccagaccgcagttgcggttatagggttcagttatataaagccccgatttatcggggttttttgttatctgactacagaataactgggctttaggccctttttttatgtcttgggggtgggcttgtccacattagagcaaaaattaacagagatgattactgcgccagttgaggccctgggttttgaactggttggcatcgaatttattcgcggtcgcacatccacactgcgcatctatattgatagtgaagatggcatcaatgttgatgattgtgctgatgtgagccaccaggtaagtgctgtgctggatgttgaagaccccatcaccgttgcttataacctggaagtctcctcaccgggtctcgatcgcccactgttcacggctgaacactacgcccgttttgtcggagaagaggtgactctggttctccgtatggcggtacaaaaccgtcgtaaatggcagggcgttatcaaagcggtagacggtgaaatgatcacagttaccgtcgaaggtaaagatgaagtgttcgcgctgagtaatatccagaaggcgaacctggttccccacttttaatagtctggatgaggtgaaaagcccgcgatgaacaaagaaattttggctgtagttgaagccgtatccaatgaaaaggcgctacctcgcgagaagattttcgaagcattggaaagcgcgctggcgacagcaacaaagaaaaaatatgaacaagaaatcgacgttcgcgtacagatcgatcgcaaaagcggtgattttgacaccttccgtcgctggttagttgttgatgaagtcacccagccgaccaaggaaatcacccttgaagccgcacgttatgaagatgaaagcctgaacctgggcgattacgttgaagatcagattgagtctgttacctttgaccgtatcactacccagacggcaaaacaggttatcgtgcagaaagtgcgtgaagccgaacgtgcgatggtggttgatcagttccgtgaacacgaaggtgaaatcatcaccggcgtggtgaaaaaagtaaaccgcgacaacatctctctggatttgggcaacaacgctgaagccgtgatcctgcgcgaagatatgctgccgcgtgaaaacttccgccctggcgaccgcgttcgtggcgtgctctattccgttcgcccggaagcgcgtggcgcgcagctgttcgtcacccgctccaagccggaaatgctgatcgaactgttccgtattgaagtgccggaaatcggcgaagaagtgattgaaattaaagcagcggctcgcgacccgggatctcgtgcgaaaattgcggtgaaaaccaacgataaacgtatcgatccggtaggtgcttgcgtaggtatgcgtggcgcgcgtgttcaggcggtttctactgaactgggcggcgagcgtatcgatattgtcctgtgggatgataacccggcgcagtttgtgattaacgcaatggcaccggcagacgttgcttctatcgtggtggatgaagataaacacaccatggatatcgccgttgaagccggtaacctggcgcaggcgattggccgtaacggtcagaacgtgcgtctggcttcgcagctgagcggttgggaactcaacgtgatgaccgttgacgacctgcaggctaagcatcaggcggaagcgcacgcagcgatcgacaccttcaccaaatatctcgatatcgatgaagacttcgcgactgttctggtagaagaaggcttctcgacgctggaagaactggcctatgtgccgatgaaagagctgttggaaatcgaaggccttgatgagccgaccgttgaagcactgcgcgagcgtgctaaaaatgcactggccaccattgcacaggcccaggaagaaagcctcggtgataacaaaccggctgacgatctgctgaaccttgaaggggtagatcgtgatttggcattcaaactggccgcccgtggcgtttgtacgctggaagatctcgccgaacagggcattgatgatctggctgatatcgaagggttgaccgacgaaaaagccggagcactgattatggctgcccgtaatatttgctggttcggtgacgaagcgtaataaactgtagcaggaaggaacagcatgacagatgtaacgattaaaacgctggctgcagagcgacagacctccgtggaacgcctggtacagcaatttgctgatgcaggtatccggaagtctgctgacgactctgtgtctgcacaagagaaacagactttgattgaccacctgaatcagaaaaattcaggcccggacaaattgacgctgcaacgtaaaacacgcagcacccttaacattcctggtaccggtggaaaaagcaaatcggtacaaatcgaagtccgcaagaaacgcacctttgtgaaacgcgatccgcaagaggctgagcgccttgcagcggaagagcaagcgcagcgtgaagcggaagagcaagcccgtcgtgaggcagaagaatcggctaaacgcgaggcgcaacaaaaagctgaacgtgaggccgcagaacaagctaagcgtgaagctgctgaacaagcgaaacgtgaagctgcggaaaaagacaaagtgagcaatcaacaagacgatatgactaaaaacgcccaggctgaaaaagcccgccgtgagcaggaagctgcagagctcaagcgtaaagccgaagaagaagcgcgtcgtaaactcgaagaagaagcacgtcgcgttgctgaagaagcacgtcgtatggcggaagaaaacaaatggactgataacgcggaaccgactgaagattccagcgattatcacgtcactacttctcaacatgctcgccaggcagaagacgaaagcgatcgtgaagtcgaaggcggccgtggccgtggtcgtaacgcgaaagcagcgcgtccgaagaaaggcaacaaacacgctgaatcaaaagctgatcgtgaagaagctcgcgcagcagtacgtggcggtaagggcggaaaacgtaaaggttcttcgctgcagcaaggcttccagaagccagctcaggccgttaaccgtgacgttgtgatcggcgaaaccatcaccgttggcgaactggcgaacaagatggcggttaaaggctctcaggtcatcaaagcgatgatgaaactgggcgcaatggcaaccatcaaccaggttatcgatcaggaaaccgcacagctggttgctgaagagatgggccacaaagttatcctgcgtcgtgaaaacgagctggaagaggcggtaatgagcgaccgtgacacgggtgctgcggctgaaccgcgcgcgccggttgtgaccatcatgggtcacgttgaccacggtaaaacctctctgctggactacattcgttcaacgaaagtggcctctggcgaagcgggcggcattacccagcacattggtgcataccacgttgaaactgaaaacggcatgatcaccttcctggacaccccggggcacgccgcgtttacttcaatgcgtgcacgtggtgcgcaggcaacggacatcgtagtcctggttgttgctgcagacgacggtgtaatgccgcagaccatcgaagctatccagcacgcgaaagcggcgggtgttccggtggtggttgctgtgaacaaaatcgataaaccagaagccgatccggatcgcgttaagaacgaactctcccagtacggcatcctgccagaagagtggggcggcgaaagccagttcgtacacgtatctgcaaaagcgggtaccggtattgatgaactgctggatgctatcctgctgcaggcggaagttctggagctgaaagcggtacgtaaaggtatggcgagcggtgcggttatcgaatccttcctcgataaaggtcgtggtccggttgctaccgttctggtacgtgaaggtactctgcacaagggcgatatcgttctgtgtggcttcgaatacggtcgtgttcgtgcaatgcgtaacgaactgggtcaggaagtgctggaagcgggtccgtccattccggtggaaatccttggcctgtccggcgtaccggctgcgggtgatgaagttaccgttgtacgtgacgagaagaaagcgcgtgaagttgcactctatcgtcagggtaaattccgcgaagttaaactggcgcgtcagcagaaatctaaactcgagaacatgttcgccaacatgaccgaaggcgaagttcacgaagtgaatattgtcctgaaggcagacgtacagggttctgtggaagcaatttccgactccttgctgaaactgtctactgacgaagttaaagtgaagatcatcggttctggcgtaggtggtatcaccgaaaccgacgctaccctggctgcggcgtccaacgccatcctggttggcttcaacgtacgtgctgatgcctctgcacgtaaagtgattgaagcggaaagcctggatctgcgttactactccgtcatctataacctgatcgacgaagtgaaagcggcgatgagcggtatgctgtctccggaactgaaacagcagattatcggtctggcggaagttcgtgacgtgttcaaatcaccgaaatttggtgctatcgcaggttgtatggttaccgaaggtgtggttaaacgtcacaacccgatccgcgttctgcgcgacaacgtggttatctacgaaggcgagctggagtccctgcgacgcttcaaagatgacgttaacgaagtccgtaacggtatggaatgtggtatcggcgttaagaactacaacgatgtccgcactggcgatgtgatcgaagtattcgaaatcatcgagatccaacgtactatcgcttaaggtttttagggttccatgcgggataaggcgtttatgtcgcatcctgcatggattgcctgatgcgacgctggcgcgtcttatcaggccaacgtgaacagcccttccacctgaaattaattttaaaaaggggctaacagccccttttttgtcaggagaatttattatggcgaaagaatttggtcgcccgcagcgcgtagcgcaggaaatgcaaaaagagatcgctctcatcctgcagcgtgaaattaaagatcctcgtctgggcatgatgaccaccgtttccggtgtcgaaatgtctcgcgacctggcgtatgccaaagtatatgtgacgttcctcaacgacaaagatgaagacgcggttaaagcgggcatcaaagcgttgcaggaagcttctggtttcatccgcagcctgctggggaaagcgatgcgcctgcgtatcgtgccggaactgaccttcttctacgacaactctctggttgaagggatgcgcatgtcaaacctggtgaccagcgtggtcaaacatgacgaagaacgtcgtgttaacccggacgacagcaaggaggactaatgagtcgtcctcgtcgtcgcggtcgcgacattaacggcgttttgttgctggataaaccgcaggggatgtccagcaacgatgcgctgcaaaaagtgaaacggatttataacgccaaccgtgccgggcataccggtgcgctggacccgctggcgaccggcatgttgccaatttgcctcggggaagcgacgaagttttcccagtatctgctggactccgacaaacgctatcgggtcattgcgcgtcttggacagcgtaccgatacttctgatgccgacggacaaatcgttgaagaacgtccggtaacctttagtgcagagcaactggcggcggcgctggataccttccgtggcgatatcgaacagatcccttcgatgtattcagcactgaaatatcagggcaaaaaactgtacgaatacgcgcgtcagggcattgaagttccgcgtgaagcgcgcccgattaccgtttatgaattgctgtttattcgccatgaaggcaatgagctggagctggaaattcactgctcaaaaggcacttatatccgcactatcattgacgatctcggcgaaaaactcggttgtggcgcgcatgttatttacttgcgtcgtctggcggtaagtaaatatccggttgaacggatggtgaccctggaacatctgcgtgaactggttgagcaagccgaacagcaggatattccggctgcggagttacttgatccattactgatgccaatggacagtccagcttcggactacccagtggtgaatcttccgttaacgtcttctgtttacttcaaaaatggtaacccagttcgtacatccggtgcgccgctggaaggactggttcgcgttacagagggtgagaacggcaagtttatcggtatgggcgaaattgacgatgaaggccgcgttgcgcctcgtcgcctggtggttgaatacccggcgtaatgttaaccgtcttgcgataacaggtcgctacgagtagaatactgccgcttaacgtcgcgtaaattgtttaacactttgcgtaacgtacactgggatcgctgaattagagatcggcgtcctttcattctatatactttggagttttaaaatgtctctaagtactgaagcaacagctaaaatcgtttctgagtttggtcgtgacgcaaacgacaccggttctaccgaagttcaggtagcactgctgactgcacagatcaaccacctgcagggccactttgcagagcacaaaaaagatcaccacagccgtcgtggtctgctgcgcatggtttctcagcgtcgtaaactgctcgactacctgaaacgtaaagacgtagcacgttacacccagctcatcgagcgcctgggtctgcgtcgctaattcttgcgagtttcagaaaagggggcctgagtggccccttttttcaagctgacggcagcaattcactggaaactaatgtattgttgctatgaatgatcttccgttgcagaggttcgcgcggctaatgagaggctttacccacatagagctgggttagggttgtcattagtcgcgaggatgcgcagaagatcgggtattaacaccagtaccgtaaggtactgtctaagaaagagaaaggatattacattgcttaatccgatcgttcgtaaattccagtacggccaacacaccgtgactctggaaaccggcatgatggctcgtcaggctactgccgctgttatggttagcatggatgacaccgcggtatttgttaccgttgttggtcagaaaaaagccaaaccaggtcaggacttcttcccgctgaccgttaactatcaggagcgtacctacgctgctggtcgtatcccgggtagcttcttccgtcgtgaaggccgcccaagcgaaggcgaaaccctgatcgcgcgtctgattgaccgcccgattcgcccgctgttcccggaaggcttcgtcaacgaagttcaggttatcgccaccgtggtttctgttaacccgcaagttaacccggatatcgtcgcgatgattggtgcttccgcagcactgtctctgtctggtattccgttcaatggtccgattggtgctgcccgcgtaggttacatcaatgaccagtacgtactgaacccgactcaggacgagttgaaagagagcaaactggatctggttgttgcgggtactgaagccgctgtactgatggttgaatctgaagctgaactgctgagcgaagaccagatgctgggcgcagtagtcttcggtcatgaacaacagcaggttgttattcagaacatcaatgaactggtgaaagaagccggtaaaccgcgttgggattggcagccggagccggtaaacgaagcgctgaacgcgcgcgttgctgcgctggctgaagctcgtctgagcgatgcttaccgcatcaccgacaaacaagagcgttatgcgcaggttgatgtcatcaaatctgaaaccatcgcgacactgcttgctgaagacgaaaccctggacgaaaacgaactgggtgaaattctgcacgctatcgagaaaaatgttgttcgtagccgcgtactggcaggcgaaccgcgtatcgacggtcgtgaaaaagatatgatccgtggtctggatgtgcgtactggtgtgctgccgcgtactcacggttctgcgctgttcacccgtggtgaaacgcaggcgctggttaccgcaacgctgggtactgctcgtgacgcgcaggttcttgatgaactgatgggcgaacgtaccgataccttcctgttccactacaacttccctccgtactccgtaggcgaaaccggcatggtcggttctccgaagcgtcgtgaaattggtcacggtcgtctggcgaagcgcggcgtgctggcagtaatgccggatatggacaaattcccgtacaccgtacgtgttgtgtctgaaattaccgaatccaacggttcctcttctatggcttccgtgtgcggcgcgtctctggcgctgatggacgcaggtgtgccaatcaaagctgccgttgcgggtatcgcaatgggtctggtgaaagaaggcgacaactacgttgtactgtctgacattttgggcgacgaagatcacctgggcgatatggacttcaaagttgcgggttcccgtgacggtatctctgcattgcagatggatatcaaaattgaaggtatcaccaaagagatcatgcaggttgcactgaaccaggctaaaggtgcgcgtctgcatatcctgggggtaatggaacaggcgatcaacgcgccgcgtggcgatatctctgagttcgcaccgcgtatccataccatcaagatcaacccggacaagatcaaagatgttatcggtaaaggcggttctgtaatccgtgctctgaccgaagaaaccggcaccaccatcgaaattgaagatgacggtactgtgaagattgcagcgaccgacggcgagaaagcgaaacacgcgattcgtcgtatcgaagagatcactgcagaaatcgaagtgggccgcgtctacaatggtaaagtgacccgtatcgttgactttggcgcatttgttgccattggtggcggtaaagaaggtctggtccacatctctcaaatcgctgataaacgcgttgagaaagtgaccgattacctgcagatgggtcaggaagtaccggtgaaagtgctggaagttgatcgccagggccgtatccgtctgagcattaaagaagcgactgagcagtctcaacctgctgcagcaccggaagctccggctgctgaacagggcgagtaaggttgccatttgccctccgctgcggcggggggcttttaaccgggcaggacgccttgttagcaaccgggaacaggacgttcattcaaccgtggtcttcgggagtgggaaatgaagccttttttgcgctggtgtttcgttgcgacagcacttacgcttgcaggatgcagtaatacttcctggcgtaaaagtgaagttctcgcggtaccattgcaaccgactttacagcaggaagtgattctggcacgtatggaacagatccttgccagtcgggctttaaccgatgacgaacgcgcacagcttttatatgagcgcggagtgttgtatgatagtctcggtctgagggcattagcgcgtaacgatttttcgcaagcgctggcaatccgaccggatatgcctgaagtattcaattacttaggcatatatttaacgcaggcaggcaattttgatgctgcctatgaagcgtttgattctgtacttgagcttgatccaacttacaactacgcgcacttgaatcgcgggatcgcattatattacggcggtcgtgacaagttagcgcaagatgatctgctggcgttttatcaagacgatcccaatgatcctttccgtagtctgtggctttatctcgccgagcagaagctcgatgagaagcaggctaaagaagtgttgaaacagcacttcgaaaaatcggataaggaacagtggggatggaacattgtcgagttctacctgggcaacattagcgaacaaacgttaatggaaaggctcaaggcggacgcaacggataacacctcgctcgctgagcatctcagtgaaaccaacttctatttaggtaagtactacctaagtctgggggatttggacagcgccacggcactgttcaaactggcggttgccaacaacgttcataactttgttgagcaccgatacgcattgttggaattatcgctcctgggccaggaccaagatgacctggcagaatcggaccagcaatagctgacgtacacatcagcccgtaatcttttttgattgccatcaccttaacgggtgagggcgttgttgttcgttaatacacctactttgagccggttcacacttttcaatgaaaattgctgatcaatttcatgatgagttatgtagactggccgccattaattttgaggcacacgtactacatggctgaattcgaaaccacttttgcagatctgggcctgaaggctcctatccttgaagcccttaacgatctgggttacgaaaaaccatctccaattcaggcagagtgtattccacatctgctgaatggccgcgacgttctgggtatggcccagacggggagcggaaaaactgcagcattctctttacctctgctgcagaatcttgatcctgagctgaaagcaccacagattctggtgttggcaccgacccgcgaactggcggtacaggttgctgaggcaatgacggatttctctaaacacatgcgcggcgtaaacgtggttgccctgtacggcggccagcgttatgacgtgcaattacgcgccctgcgtcaggggccgcagattgttgtcggtactccgggccgtctgctggaccacctgaaacgtggcactctggacctctctaaattgagcggtctggttctggatgaagctgacgaaatgctgcgcatgggcttcatcgaagacgttgaaaccattatggcgcagatcccggaaggtcatcagaccgctctgttctctgcaaccatgccggaagcgattcgtcgcattacccgccgctttatgaaagagccgcaggaagtgcgcattcagtccagcgtgactacccgtcctgacatcagccagagctactggactgtctggggtatgcgtaaaaacgaagcactggtacgtttcctggaagcggaagattttgatgcggcgattatcttcgttcgtaccaaaaacgcgactctggaagtggcagaagctcttgagcgtaacggctacaacagcgccgcgctgaacggtgacatgaaccaggcgctgcgtgagcagacactggaacgcctgaaagatggtcgtctggacatcctgattgcgaccgacgttgcagcccgtggcctggacgttgagcgtatcagcctggtggttaactacgatatcccgatggattctgagtcttacgttcaccgtatcggtcgtaccggtcgtgcaggtcgtgctggtcgtgcactgctgttcgttgagaaccgtgagcgtcgtctgctgcgcaacatcgaacgcaccatgaagctgaccattccggaagtagaactgccgaacgcagaactgctgggcaaacgtcgtctggaaaaatttgccgctaaagtacagcagcagctggaaagcagcgatctggatcaataccgtgcactgctgagcaaaattcagccgactgccgaaggtgaagagctggatctcgaaactctggcagccgcactactgaaaatggcacagggtgaacgtactctgattgttccgccagatgcgccgatgcgtccgaaacgtgaattccgtgaccgtgatgaccgtggtccgcgcgatcgtaacgaccgtggcccgcgtggcgaccgtgaagatcgtccgcgtcgtgaacgtcgtgatgttggcgatatgcagctgtaccgtattgaagtgggccgcgatgatggtgttgaagttcgtcatatcgttggcgcgattgctaacgaaggtgacatcagcagccgttacatcggtaacatcaagctgtttgcttctcactccaccatcgaactgccgaaaggtatgccgggtgaagtgctgcaacactttacgcgtactcgcattctcaacaagccgatgaacatgcagttgctgggcgatgcacagccgcatactggtggtgagcgtcgtggcggtggtcgtggtttcggtggcgaacgtcgtgaaggcggtcgtaacttcagcggtgaacgccgtgaagggggtcgtggtgatgggcgtcgttttagcggcgaacgtcgtgaaggccgcgcaccgcgtcgtgatgactctaccggtcgtcgtcgtttcggtggtgatgcgtaatcatcgctgaacagcgaacacaatctgtaaaataatatatacagccccgattttaaccatcggggctttttttctgttttttgtactcatgtactggtacagtgcaatgcataacaacacagtcgcactatttttcactggagagaagccctcatggcaacactaaccaccacccaaacgtcaccgtcgctgcttggcggcgtggtgattatcggcggcaccattattggcgcagggatgttttctctgcctgtggtcatgtccggggcgtggttcttctggtcaatggcggcgctgatctttacctggttctgtatgctgcattccggcttgatgattctggaagctaacctgaattatcgaatcggttctagctttgacaccatcaccaaagatttgctgggcaaaggctggaacgtagtcaacggcatttccattgcctttgtgctctatatcctgacttacgcctatatttctgccagcggttcgattctgcatcacaccttcgcggagatgtcgctgaacgtccctgcacgggcagctggatttggttttgcactgctggtagcgttcgtggtgtggttgagtacgaaagctgtcagccggatgacagcaattgtgctgggggcgaaagtcattactttcttcctcaccttcggcagcctgctggggcatgtgcagcctgcgacattgttcaacgtcgccgaaagcaatgcgtcttatgcgccgtatctgctgatgacactgccattctgtctggcatcgtttggttatcacggtaacgtaccgagcctgatgaagtattacggcaaagatccgaaaaccatcgtgaaatgcctggtgtacggtacgctgatggcgctggcgctgtataccatctggttgctggcgacgatgggtaacatcccgcgtccggagtttatcggtatcgccgagaagggcggtaatattgatgtgctggtacaggcgttaagcggcgtactgaacagccgtagtctggatcttctactggtcgtgttctcaaactttgcggtagcgagttcgttccttggcgtaacgctgggtttgtttgactatctggcagatctgtttggttttgacgactcggctatgggccgtttgaaaacagcgttgctgacctttgccccgcctgttgtgggtggtctgctgtttcctaacggattcctgtacgccattggttatgctggcttagcggctaccatctgggcggcaattgttccggcgctgttggcccgcgcatcgcgtaaacgctttggtagcccgaaattccgtgtatggggcggcaagccgatgattatgctgattctggtatttggcgttggcaacgcactggtccatatcttatcgagctttaatgtgctgccggtgtatcagtaatcagcggtgccttatccgacatttctgctgcctacacaatgcctgatgcgcttcgcttatcaggcctacgtaggacagcgttgccagctcggataaggcttcccgcgttaagacatactatcccaacaactcttccttaacatccatcgccagttcaaacgaatgcaggcgcgcctggtggtcgaaaatctgcccgttaaccataatctcatcggcgtcggtttcgcgcaggatcgactgcaagccatgacgcactttcgctttatcgcccaccagcgacatactcagcgcctgctgcacaccatactgttcggacggcgaccagaactgatccatattttgaatcggtggcggcagttgcccggtttcgccgcggcgcagcttcacaaaggcttgctgcattgaggtaaacaggaattcggcatcgcggttgctgtcggcggcgataatattgatgcacaccatcgcatacggtttctccaaccgtgccgacggtttgaagttgctgcgataaagatgcagcgcctggaacaacatatccggcgcgaagtgtgaggcaaacgcaaacggcagaccaagctgcgccgccagttgcgcgctgtaaaggctggagcctaacaaccacacggggattttctcgccatagcctggtaccgggcgcacatgcggattgggatcgcgggcgtcaaaccagtccaccagttccgcgacatcgcgggggaaattatcaatatcgccgctcatatgacgacgcagcgccatcatggttcgctgatcgctacccggtgcacgacccagccccaaatcgattcgccccggatagagcgtattgagcgtgccgaactgttcggcgatcaccaatggtgagtggttaggcaacatcacgccgccagaccccagatgcagcgtggtggtattcgccgccagatagccaattaacaccgacgttgcagcactggcaatgccggtcatattgtggtgttccgccagccagtagcgatgatagccgcgcttttcagccagacgggcgagatcgagagagtgggagaacgcatctcgcgctgaagaaccttcgggaatgggggccagatcgagtaacgaaaacgcaatggttttatcagtcataacagctcactttgttaccgattaatctttaatactgcattaaagagtagttaaagttgttaacaaagtgagctatatacttacgcttgcagctccagcccggccagccgccgccagtagccgttacaatcgctgtttgccgtcaacggcagtggtgcagcgccattttcattggcgcggaaggcgtcgagcattgcgaaagtgtcagtaccctgcggtgacaggcggaccacatcgaccagcccctgcatggatgccagctcgttaccgaggttgtaaacgtagccgctcatggtctgaatgccgttgagtacaaacacttgttggttttcctgcgacagcacgttgcgcccgttcggatacttaatgcagcaggtttcgcactcatctttcgggcggtcttccgaacgcgcggtaaagcagcgagcagagtaggccagcggcagatgaccgtagctcaagacttccacttcaaactggttacgaatgcccagctcatcgcactgattaagcagattcaccagccagtcgcgggaaagctccaccggcatacaccagcgcatcatgccctgtttgagcaatattttcagcgtcaccgcgttgtagcagttcagcgcgtgcccggcgacgaacggcagtttgcgttcagcgcacatattcaccacgccgagatcgctggcttcaatcagaaactcaccgttctcaacatagcgtttcagttcgcccagttcggaggatgcctgcaccagcgccagcgtggagagcacaatctgcttgccacttccggcgagtgattttgccatctccagccagtcgccaactttggttgcccggcgcttgctgcataccgcttcaccaagataaatcacgtcggcgctgctggcggcggcctgctgataaaattcttccagcgtctcttttggccagtaccacagcactggccctaaggaatatttcattgcttttctcactgccatttacggtgatatgcgccaagggtggtctgcgtgccttcggacatcgacccgagcgtctccatccacgcgctttgcggtatgaagttttgcggatcggccttacaacggtcgatagcctgacgccagactttcgccacctggctgacatacgccgggctacgctggcggccttcaattttcaccgaagcgatattcgccgccattaactccggcagcagttccagggtattgagactggttggttcttccagcgcatgatagcgctcgccgttcaccagataacgccctttacatagcgtcggataacctgcgttttcgccgtcctgataacggtcgatcagcacttcgttcaggcgggattccagcccctgcggcgtttgttgccagcgcacgaaacgggccggagaacacgcgcccacggtgttgggcgactcacccgtcaaatacgacgacagatagcaacgaccttccgacataatgcacaggctgccgaaagcaaagacttccagtggtacaggtgtgacccgtgccagttgtttcacctgatgaatcgacaacacgcgcggcagcaccacgcgggcaacgtcaaaatggcgatgataaaagttaatcgcctcttcattggtcgccgaagcctgcaccgatacgtggcgctcaatatgcggataacgctcggcggcgtactccagcatggcgaggtcggcgagtatcagcgcgtcggcacccagttgcgccgccatatccacggcgcgctgccaacgggcgtaaccgtccggatgcgcaaaagtgttaatcgcgatgtgaagtttgcggcgatgttgatggacaaaactcaccgcttcctgcaattttttctcggtaaagttaaggccggcgaagtgacgggcattggtatcatcttttagcccgatataaacagcatctgcgccgttttcgatggccgccttaagcgccgggagatttccggcagggcagagcagctccataatttttcctgaaggttgcgctatcaaaacgcaaaaatgttaacgaactgggattttagttaaccttgctgcgacaatttttgatttaaggcagttaaagttgtattggtggtagcagcaatttcatatggaattgttgatttataccgctatgttatttttctgatatggcaaaataggatgattgttgaaacagggagtaaaactcgtgttggataaactgcgttcccgtattgtgcatttggggccatctctgttgagtgtaccggtaaaactgacgccatttgcgctaaaacgccaggttcttgagcaggtcttaagctggcaattccgtcaggcgctggatgatggcgagctggagtttcttgaaggtcgctggttaagtattcatgtgcgtgatattgacctgcaatggtttacctcggtggtgaatggcaaactggtcgttagccagaacgcgcaagctgatgtgagttttagtgccgacgccagcgatctgctgatgattgcggcgcgtaaacaagatccggatacgctcttcttccagcgtcggctggtgattgaaggcgatacggagctggggctgtatgtgaaaaacctgatggacgccattgaactggagcaaatgccgaaagccttacgcatgatgctgctgcaactggcggattttgttgaggcgggaatgaaaaccgcgcctgaaaccaaacagacatcggtaggtgaaccatgctaattcgagtagaaattcccattgatgcgccgggtattgatgccctgctgcgtcgttcattcgaaagtgatgcggaagcgaagctggttcacgatctgcgtgaagatggctttctgacgctggggctggtggcgacagatgacgaaggtcaggtcattggctatgtggcatttagtccggttgatgtgcagggcgaagacctgcaatgggtcggcatggcaccgctggcggtagatgaaaaataccgtggacaggggctggcacgccaactggtctatgaaggactcgattcgcttaatgagttcggctatgccgcagtggtgacgctgggcgatccggcgctgtacagccgtttcggctttgaactggcggcacatcacgatctgcgttgccgctggccgggcactgaaagtgccttccaggtacatcgtttagcggatgacgcgctgaacggtgtaactggtctggttgagtatcacgagcacttcaatcgcttttaatctccggggtttgcaggctgctcaacagttctgcaaacactgcaccttccgctaccagacgctctttttgccgtttggtcagttgcttaacgcgatattctgcccgtaacgccagcgaacgatcgcccactggtgcggaaaacgccagcgttagttctcccttcccgcgcagtgctttcgcccctttgccgctttggtgctgctgatagcggcgttcgacatccgtggtgatcccggtataaagcttattgtcggcggtacggatcaagtaaagaaaccagggtgtcatcgtctgcgtcgcatgttaaggtcaggcccacagtataaaagagaacagcaatggaaacactcaccgccatcagccgttggctggcaaaacaacatgttgtcacctggtgtgtgcagcaggaaggggaactgtggtgcgccaatgccttttatctttttgatgcgcagaaagtcgccttctacattttgacggaagaaaaaacgcgtcatgcgcagatgagcgggccgcaggcggcaattgccggaacggtaaacggtcagccgaaaacggtagcgttaattcgcggcgtgcagtttaaaggtgagatccgcagactggaaggcgaggaaagcgacctcgcacgcaaggcgtacaatcgtcgctttccggttgccagaatgctgtcggccccggtatgggaaatccggctcgatgaaatcaaattcaccgacaacacgctgggctttggtaaaaaaatgatttggctacgtaactcaggcaccgagcaggcgtaacgcctcgcggttaaacgctggcagatcgtccggtgtccggctggtaaccagctgatctttatcgaccaccacttcctgatcgtaaaattccgcgcccgcgtttttaacatcaatcacgatcggtttaacggcggtcagcttacgaccaaggatcacatcggcgctgatcagcaactggggaccgtgacagatggcgaaaacaggtttgccgctgttcacaaaatcgcgtgtgaaggtgacaaaacggttgtcaccacgcagataatctggtgaatgaccgcccggtagcagcagggcatcgaactctgcgggcgtcacttcatcgatggatttatcgatggccacgctggcttctccttttttgcctttcaccgttttacccgcttgtttttcaatggtaatcacttcgtgtccggctttacggaactcgtctgcgggtgaagtaaattctgaatcctcaaattcatcagtgattaaaacggcgattttcttactcatgcttcctccgcgttgttgcattggatgaggcgaattttccacaatcggggataattacctcatgatctattaagcctggtgcatgagccggggagcgcaaggcagacaattctgtaaaggagcgaagatgagtcaggtactgattacaggcgcaacggggctggtgggcggtcacctgctgcggatgttgattaatgaaccgaaagttaacgccattgctgcgccgacgcgacgtccgttgggcgatatgcccggggtgtttaatccccatgatccgcaactgactgacgcgctggcgcaggtcaccgatcccatcgacattgtgttttgttgtctcggcaccacgcggcgagaagcggggagcaaagaggcgtttattcatgccgattacacgttggtggtggataccgcattaaccgggcggcggctcggtgcgcagcatatgctggtggtcagtgctatgggtgctaatgcccactcgccgtttttctataaccgcgtcaaaggggagatggaagaagcattaatcgcccagaactggccgaaattgaccattgctcgcccgtcgatgttactgggcgatcgtagcaaacagcggatgaacgaaacgctttttgcgccgctgttccgtttgttacccggtaactggaaatccattgatgcgagagacgtggcgcgggtcatgctggcagaggcgatgcggcctgagcatgaaggtgtgacgattttaagctcttcagaattacgcaaaagagctgaataattattcccaagaattgatagtgagcgtaatattcacgcgctcaattatcataacttattcctggggaatgctatgactggtcagtcttcatctcaggcggcaacgcccattcagtggtggaaacccgcgcttttctttctcgttgtcattgccggtctctggtatgtgaaatggcaaccttactacggcaaagcgtttactgctgccgaaacccacagtatcggtaaatctatccttgcgcaggcggatgctaatccgtggcaggcggcgttgaattacgcgatgatctattttctcgcggtatggaaagcggcggtgctgggggtgatcctcggttcgttgattcaggtgctgatcccgcgtgactggttgttgcgtacgcttgggcaatcgcgctttcgcggcacgctgctgggaacgctgttttcgctgccgggtatgatgtgtacctgctgtgcggctccggtcgcggcgggaatgcgtcgccaacaggtgtcgatgggcggtgcgctggcattctggatggggaatccgttgttaaacccggcgacgctggtgtttatggggttcgtcctcggctgggattttgcggcgattcgtctggtggcggggctggtgatggtgttgctgattgcgacgctggtgcaaaaatgggtgcgtgaaacaccgcaaacgcaggcaccggtcgaaattgacataccggaagcacagggaggattttttagccgctggggcagggcgctatggacgcttttctggagtacgatcccggtttacatccttgcagtactggtgttgggtgccgctcgcgtctggttattcccccatgccgatggtgctgtcgataacagcctgatgtgggtggtggcgatggcggtggcaggatgcttgtttgtcattcccacggcagcagaaattccgattgtacaaacgatgatgctggcaggtatgggaactgctccggcgctggcattgttgatgacgctcccggcggtgagtttgccgtcactgattatgctgcgcaaagcgttcccgacgaaagccttatggctgacgggggcgatggtggcagtgtctggtgtgattgtcggcgggctggcgctgttggtttgatttgagggaaaacatgtcggatgcggcgtaaacgccttatccgacctacggtttgcatcgttgtaggcctgataagacgctgcaagcgtcgcatcaggcattacaagggctgctatttaataaacgtaaacgccgtagttacccgcttcacgccgcttacccggctggcaatatctgccgccgctttcgcttcacgttcagtcaccagccccatcaggaacacttcaccgttttcggtggtcactttcacgttggacgatttcaccaggtcgctggttaacagctgcgaacgtactttggtggtgatccacgtatcgttagacgcttcgcccagaccaatcggctggccctgacgaatctcgttatacacttcgttggcaccgtctacgcccatagcaatctgtttggcgcgagccgaaagttcagcgtttggtgactgcccaaccagcagcactttgccctgataggccgttacattaatgcgcgcttctttcttaatttgttcgtctttcgacaatgcgctgttcacgcgcacttccagggtaccatcgtctacctgggtgccgacactgcgtgggtcagttgcggctttggtacccacagcagcagtacccactacggcagcggcaacacaaccttgcaacagcagcgcggaaataaggactgcgattggcgataatgccttcatgtattctccttaaacatcctggtgagggaaaagcgtgttatcgatcagatcgcacaggcaatttaccgtcagcatatgcatttcctgaatgcgagcactacgatgcgaaggaatgcggatctccacatcctgtggccctaacaaacctgcaagttcaccgccgtcatagccggttaatgccacaatggtcatatcacgcgtaacggcagcttctaccgcttttacaatatcgcggctgttgccacgggtggaaatggctaacaatacatctcccgcatggcccagcgcccgcacctgttttgcatacacttcatcatgtaagcgatcgttggcaattgccgttaagacaacattatcagtatttagtgcaatggcaggtaagctgggccgctccgtttcgaaacggttgatcatgctggcagcaaaatgctgtgcattggcagcggaagttccattaccacaacagaggattttgttgccattgagcagagactgaaccagcgtcatggctgcacgggagatggcatccggaagcgcctctgccgccgcaatttgagtttgaatgctttcagtgaagcaagctttaattctttcttgcacgctaatccttaaaccttaattatgagtggtcattaaaggcatccttaatccactcaacctcattcccggtgaaggctaccacatcgaaccggcaatccacagtatcaaaactcccattatgacgcgcgagccacaagcgggcagtctgtaataatttgtgttgtttgctgcgggtcacactggctgccgcgccgccataaagcgcagagcggcggtaacgcacctcgataaaaacggtggtccggccttcacgcattatcagatcgatctcgccgccacgctcgttcacgttagcggcgataaaccgtagtcctttgccttccagccagcgacgcgcttgtgcttcccacgcatcgccggtctgtttggtggttaactggcggggactacctgaccttgttggtactgtagccatgataacttcctgttaatcacgcaatccgggtttgccgtcaggcttccggtattaccgttgatttcaaaaccctgaacctggcgcatttgtgagaaatgatttgccaacgaccaggcatcgacgcccatcgcatacatgcgagccagcgaataatcgttgttcaccgcgctgagcgcctgctgcattaacggcagattaccgcctgccagcatcgggatttcgctgtactgcaagccttccatctccaggcggaaatccgggccagcggtcccttgcgcactgcgggagctggcgtacagcgttgcaccgctctggctaccgttacgcatggcgatcattggtttgataaaagcgatttcacccggcgttgccacaatgtacaccgcatcgacacgaccgccattattggtgaactgatcatcggttggtgtggtttgcagcgttggattgttggtcgtcatgccggagtcggttgtttctctgggagtaatcgggctacccgttaaagcgatacccgaaccgccgttaacacccgcgcgtaactcgctggtggaaccaaatttttgttgcagaacggtgccgccgcccagtttctgccactcttgcgcaaacgcattggctacgcgatcgcccaatgaactgcgtgggatcagcaccagcggcgcttgtttaccctggtcacgaatatgacgcgctgcatcgcgcgcttcgtcttccggtgaaagcgcgaagtaacaaatattgacgcggttttcgatgttctccggctggttcagtgccagcacgttcagcggagtgttgctcttcagcaactcttcaacgttatttttcagcaacggaccgaccacaatactcgcgccatcctgctgaacctggcttaagatctggctaagtggttgtgatgaggtatcgtagattttcagctctgcggatggatttgcgggtgcgcttaccgctgcggtgcttgtcgccggggcgcttacaggcaccgactgagccgcaggctgttcaccggtcagatcgctaaccgaagcttgtgccgggctggcaacgccatccacggtttgcggctgaggttgttctgctacgtctgcggcaggtgcggctgctacctgggccaccactggctgagtgccgatatttttcgccgcttcaaagccttgctgaatagtgcgaccaaataccgctgcctggccattcagcggcaacagcagggcgattttgttggtcgatgcgggtttaaacgcttttacgttaaccaactgcgttggcagcattttcgcgcccgggttgttcggataacgtttctgccagtcggcgatcccagctttcatcatgtcaggatcgttacggttatcaaaccagacgcgctgcaaatccagccagccttgcagaatattttcgtcggcgttgatcaccagcgtattcgcctgctcctgagtcatggaggagagcgcctgccatgtggcgtcaatattctgctgcttttctttcgcaccgagcagcggttcctgagcaattaacgcgcgcagtaaatcaatggaaggacgcccctggctggcatcgatttttgcctgccagtaacgggcttgctggttttgttctaaatcggcaggtgtgattttcgccagcaagttttgcgcgccagcaaaatctttctgcgccagtttaatctctgccgccagcagtgttttctcgcgacgctgagtatcattcagttcttgcggtagttggttaaacaactcaactgcctgcccggttttaccttctttcaccagtgcacgaatggcgagtaattgccagttgatcctggtatcatcagaactttgctgcatctgttgcaggtaaaaggcagaatcagcctgcgccgtgccctgcatataagcagtggactgatcgggagtatgggtgccacaaccggcgaaaatcagggctgccagaacaacaggcagacaacgcgcggctttcaaacgagaaaatgttgagggtaccataatgtatccagtgatattttttttacgcaatgctcaatattaaatcggcaatacggacgacacaatgaaacaacaccaatcggcggataattctcagggccagctttacattgtaccgacgccaatcggcaatctggcggatatcacccagcgtgcgttggaggtattacaggccgttgatctgattgccgccgaggatacgcgtcacaccggtttattgctgcaacattttgggattaatgctcggttgtttgcgctgcacgaccataacgaacaacaaaaagccgaaacgctgctggcgaagctgcaagaggggcaaaacattgcgctggtttccgatgccggaacgccgctaattaacgatcctggctaccatctggtgcgtacctgccgtgaagcggggattcgcgtggtgccgctacccgggccgtgtgctgctatcactgcgttaagcgccgcgggtttaccatccgatcgtttttgttatgaaggctttttacctgccaaatcaaaaggccgccgtgatgcgctaaaagccattgaagcggagccgcgcacgctgattttttatgaatctacccaccgtctgttagatagcctggaagatatcgttgcggtattaggcgaatcccgctacgtcgttctggcgcgtgagctgaccaaaacctgggaaaccattcacggcgcgcccgttggcgagctgctggcgtgggtcaaagaagatgaaaaccgtcgcaaaggcgaaatggtactgattgtcgaaggccataaagcacaggaagaagacttacccgccgatgccctgcgcacgctggcgctgctacaggcagaactgccgctgaaaaaagcggcggcgctggcagcagaaattcacggcgtgaagaaaaatgcgctgtataagtatgcgctggagcagcagggagagtgattacaggcgtcgcagcaggaatagcgttgcaacgcctgtagcaggcgagttaacgacgacacatctcatcaatcatgcatgtgaaatagttatgcagccataaaaatgaagccgggatagcggtagagactttagccgtgagaaaacgttctgtcgcatcctgttttccttcgccagtcaccagtaacaaaacttcgcgggcattgagaatatccttcaggcctaaggtgatcccacgagtcacgggacggtccgcggtttttaacatctcatgttgctgtgttctggcatcaagttgactgatatggcaggccggttgcaggctttctcccggttcgttcagcccaagatgaccgtttttccccaatccgagaacgcataagtccagaccgcctttgcgcgcaatcaggttcgttacccgttcgcactctgtctcatttatctcttcggagtgaaagctgatgagctggtcttcacgtaaccccagcggctgcacgatatgctgttgaaggaaagtttcgcaggtaccaggcatcgttaatggcagatccacccattcgtcgagcttcacgaaggtgagctggctgacatcaacctgctgctggtggattttttctaccagataatgatacgtcagtaatggcgtggctccggtcgccaggcaaatcacggcatccggtttgcgacggatcacggccaataaatattcgctggcacgttcacttaacgccgtatagttttcaacttgttgaagggtttgcacaggatgaaattccttaagtaaagaggcaccgccagacgcggtgcctcgttccatttacaaaatgccgaatgcagaacaaacaatagaaagaacaaacgtcacgccgattaacagcaccggatgcgcttttttcacccgcaggaagtaatacatcagcagggtgtaggccatcggtaaaatattcgggaagactttatcgaagaaatcctgttgcagtgcgacgctgtgggtactgtcgatggcaaacgacgtcaccacgttaatatgcacatacgaagcgatcagcccgccgattactgtgatcccgaggatagttgccgaacgagcaatcatctgcgagttctctcgcactttatcgatagccttcacgccgactgaataaccgacgtgggtccagccgacgcgcaggaaaaagataagcaggtaaacggcgaaaaacaaaatcggtcccaacaggttcccctgactggcaaacgatgagcaaatccccgccataattggcaacaaggtaaaccagaaaatcgcatcgccaatcccggcgattgggccaaacagcgccactttgaggcctttaatggtgtcgcggttttctcctttttcttccatcgaaattaataaccccatcaggaatccgaccagattagggtgggtattaataaattcgaggttatctttcatcgccgcgcttaggcccggtttgtcgtccttataaatctttttcaggatcggcaacatcgcccaggtaaaaccgcccgcctgcatcctttcgtagttaaagcttgcttgtagcagtgacgaacgaaagcccagacgggtgatatcttttttactgatttcagatcccattgctgtagtcctcttcttcatttttactggcaacgggctgcggttgcgcttgctgccgggatttcgcattgaaaaactcatacaccgcaaagcctgcgcccagtacggcaaccggcaacaggttgctgacctggatgtagcaaacaaacaggaaaccggcgatcaggtaagggatatattgtgctttgaacatcacgcgcagcagcaagccaaaaccaacggcaggcagaataccgccagccacttcaaagccgtgggtcagccaggcgggcatcgctttcaccagcgcctgcatcgccccttgtgccaggtaagtacagaggaaagcaatcaccgcatacgctgaagcgacgatgagcatcgttgcccagttaagtcgggaaaatgctgccgtatccgcctcttttgcgcatttatcggctttggtcataaataatgagaaagcggaatagaagaacagaatgacgtactgcattaacaaactaaacggcaggccaagaccaattgccgttttggcatcaacgcccgtagaccatgcaatgacagtggtcatcagacccgccataatagggttgggcggctgaacaccacctgcaggggttaatccggcgaaagccaactctgtcaggccaccggtaattaagccagtctgaatatcaccgagaatagcacctgtaagggtacaaacgattatcgggcggaataaaaataaggcttccagctaaaaatcaatccccagaaagaaaactaacgccgccagggataatccctggagtagggttatttcatgcatttttattacctcaaaccaatattaaggctattttagatttagtcagggatttgttctttttgatcgccagggacgtcctgaatgaaaacatttacgccacgttgtttaataaaacgtaaatccgtgagatcctggtcatcgacataaactttactgctgatttgctttttcccttccgagaaatgcatattgccgacgttgacatctttcaggtcaataccaccttctaccaatttacgtaccgtttgtggcgtacggcaaatcaggaagatcttctgatgtggtgcagctttgccgatgacgttaatggttttttcgatagtaaagaaacgaatgccaaagccgtaggtttctgcggtaatacccattaatttctgttgaatatcatcgttagcgacaacatcatccacgactactaacagattcgcaccgatggtggatgtccaggtcacgccaacctgaccgtgaaccagacggttatcaatacgggttaagagaatatttggactgctcattgtgtaatcctcaccataaagttgaataatataatctttttaaatatattattgttgcgatattgtactgatgtatttattaaggtttagttatctcctttaccattaaggcactccccgatattaatcgggaagtacattgggataaatcataaaaaactaatgattatgctgaaattcgattcgctgaaccacagacattaattttatttctgacaacttctttcatcgcatccattccgacgcgcatataataacgaggatcattaccctgaggattttccgcaaaccaggctttaaccgcgccagcgaaggctatttttaattctgtggcaacgttcacttttgttacgccaagttcaatagtgcgacggacaaattcatccgggacatcgctggcaccatgcagcaccagaggaacatccaccacttcacgaatttccgccagccgctggaaatcaatcttcggcgttttgctgtataagccgtgcgccgtaccaatcgctaccgccaggctgtcgacgccagtcagttcgacaaagcgtttagcttcttgtggatcggtcaggaatgcactttcggcgtcaacgctcatgtcatcttcaacaccgccgaggcggcccagttctgcttccacgctgcaatcctgggagtggcagaagtcgacaaccgatttcaccagcttcacgttctcggcaaacgggaaatgactgccgtcgatcatcgcgctgcgcacgcctgcgtggactttacggcgaatatcatccagcgattcgtggtgatcgagatgcagtgccagcggcatgttataggtcgtggaataggcgctacacagggcgtagatctcttccagcgcgatatgcttaaaggtccccggcgtcccggcgaggatcaccggcgatcgcatttcactgcacacttcgaggatcgcctggatcgtctcggcgttatgaatgttaaaggcaggcaccgcgtagccattggcctgggcgtcctgtaacagatatttggtggagataatgctcataatgcgatcctcttatgcctgccacggatgaatgattacgccttgcaccacgcggttaacggtgccactggctgatggggtatccggcgtattacccatgtgcagcgactgcatcagtgcaaatgtctgggcgtacatcaggaagcaaaatgcctgctcaacgtcgataaagtgacgggacggcggcaggatgatatgtggaccggcggcaataacgtcgttgctttccgcggcgatggcgattacgcgcattgcctggttatcgcggcggagttctgccagcagatcaagatcatactgacgggtgtaagggtggctggagacaaacaccaccaccagcgtttcgttatcgaccagcgatttcgggccatgacggaatccggtcggggaatcatagaaggccgccagtttacccgctgtcagttccagcactttcagcgccgactcgcgtgctgcgccctgtaagccaccgctgccgagataaacgatccgtttccacggtgcgtaaccaaacacaccttcgctgaaatcgcccagtgaggtcaggatcgcctggcaacgatccgccacatcgcggaaggtttggctgttgatcgtctcaggtgcgaaaaccgcgaggcagctggccatcatggtggtaatgctgctggtcatcgcgaagccgcgatcgtgcgtttctgcgggcatcagcagggcaaacgcgttgtcgctgttgatcgcgttttggtaaagagcgcccgcttcgttgcaggtgatcggcaggtgatagcattctggtacaaattgatttgccagttccacggcggcgacgctttccgggctgttgccggatcgaccgaaggagatcaacagcagcggatgagctggattcaggtagtccatcggattagtgaccagatcggtggtcggtacggcgctgaagtttttaccggtatggctggcgagccacggcgcgatgatgtcaccgataaatgccgaggttccggctccggtcaggatgatccgcagattctctttgcgcagtaacggttcaaggaagttattgagcgcggaacgtagcgcgtcgatgttggtgagtgaacggatccatgcgcgaggctgatggcggatctcttcttcagtccatgtaccggttgcggcagcagcaggggtgtaattttctggcataactcaatccttagtctgatgaacttgacgtcggcgttgtcgctttcgcttgcctttcgtttcatttcacttggtgatttctttcgttggttaaaatttatagaaaagaaactgaaagttcaatgaagaaaaaggaaataaaacgaaatctgtgatcgttgaaagaaaaggcaagggaagtaaaagggattgctggatgcggcgtaaatactttatccggccttacggtcaccaaccgtaggtcggataagacgcattagcgtcgcatccgacaccgctgcacagatcaaaacgaaagaaaaagaaggccttacgggggaagtgaaggcctaataaaggagcaaaccatcaaaacgaagctaattgaccctgaatccagatttgttgcacatgcagcccgctatccagcgcaacgacgctggcgcgtttgcccggtttaagcgatcccagaacaccatcaacacccagcattcgcgccggatgcagcgacgccatatggatggcttccgcaggcgttacgcccgtcaactcgaccatgttgcgcactgccgcatcgacagacagcgtactgcccgccagcccaccggacgcggtacggacaacgccaccgcgcatctgcacttcttcaccacataacgtatagtgaccatccggcatcccggctgcctgcatcgcgtcggtgatcagtacgatcctctctttcgcacagcaacaacagagcgacattgccgccggatgtacatgatgaccatcggctatcagttccagccaggcgcgcttgtctgttaatcccgcgccaaccattcccggttcgcggtgatgtaaacctgtcatcccgttatagcaatgcaccaggccgtcggcaccagcatcaaacgcggcacgggtttgttgccaggtcgccgcgctatgccccagcatcacccgtacgttttgctgtttaagatggcggatggcctgcaatgccccttctttttccggtgccagcgccaccacgcgcaaggtatgctgagaaacggcaatcaattgatccagctcggcaatttccagctcgcggaacagctccggtggatgcgcgcctttattctgcggcgtgaagtacggtccttcgagataactccccagcacttgcgcaccaggtccgccgcgttggcaacgttgagcaatacgttccagcgccgcatgaatggtattaagcggcgcggttacggtggtcggtaaccaactgccgacaccttcgcgtgctttgtgcattgccagcttgtcgagcacatccggcgcgtcatccattacatcaacgcccgcaccaccgtgtacatgggtgtcgatgtaagcgggacagagcagttccgcatcgcgttcagtcacgcccactggaatcggttcgattgctgcgattacaccgtcagcaatacgcaactgatggtcatcgagccatccctcttcagtcagcagccttctggcgcgcagaacgtgtgtcatattccttcctcgaccggacattcttcatggcagcggcctaactcgtccaccagactggtcagcccacggtgtccacactccagcgcctgcacacggaactcttcaccgcttaacccttcgcgctccagcaccatttccagtagcagttgcaaattggtgccggtgatcacttcacagcccggtttttgcatcgccagcgttgaagctacgcgaaacggcgtgccgcccagcaaatccgtcagaaaaacaatgccgtcttcacaatccagttgggcgatggcctcttcaagctgcgatgtaagcagcgcggtgcttgaggtttccggaaaatcgatggcgataaactgcgattgctcaccgagaatttgcttcattgctttttccatgccgctggcaaatccgccatgccctgtcaaaataatacttaacatctaatacctcattgtatttaaaggaaatggcagaatttaccgacgatgccgagaaccacggtaatcgcaatcaggcgcagcggactccagccgcggcgtaccagccagaacatggtcagggtgtagaccagcggtaagaaggctggcatcagtttgtcgataacatcagcctgtaacttaaccactgcgtcgcccgcggtgatttccagcgtggtgcttaaacgaacataggttgccaccagcgcgccgattaccgtcatcccaacgatagatgccgcatggccgacttttttggtatttgctttaatgagtggaatcgccgccacgcccatgcggtaagcataatgcgccagaccaaaacgcagccccaggtgcaccacgttgaacagcacaataaagacgacagcgccaagaatagagccttgtagcgcgaggcttgcacctatcccgccacaaatcggcagtagcgttagccagaacatcgcatcgccaatcccgccgagcggcgcaccgacggcaattttggtgctctgaatactgttaacgtcctgcttagaacgctccatcgcaaggataatgccgataacaaacgtcaccagaaacggatgggtattgaagaaacccatatgccccttcatggcgcgcgccaggtcgcgtttattagtgtggatctttttcagtgctggcagcaggccgtacagccagccggaagcctgcatacgttcgtagttgaaagaagcctgtaacagcatggaacgccaggcgacgcggttgatatcttttttcgtcagctctgcgccaatgctctgatcttcatacacgttttcattgacgccagtcagcagtgtttcttcgttttcactgacgttcggcagggtggtttgattagatgccatcttcaaattcctctttctgtgccgcaggttgagtcggttcaggagatttacgcagcaggtcgatcagcgccatcgccagcgcggcggcagcaatagccagcaccggtaacttgagccaggctgcggcaacaaagcccaggatgaagtaggggatgtagacgtttttcatcatgattttcagca

SEQ ID NO: 10007 - DNA, 41778 bp, Escherichia coli
acgtgtgggactttccccaacgccgtgccttgagcgtgtgcgtcggctggaaagacaagggtttattcagggctatacggcgctgctgaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtctgcttaccgtaagttactgggggaaaccctgctgcgtctgcctggtgtcaatgacacacggacatacgttgttatggaagaagtcaagcagagtaatcgtctggttattaagacgcgctaacacggaacaggtgcaaaatcggcgtattttgattacactcctgttaatccatacagcaacagtactggggtaacctggtactgttgtccgttttagcatcgggcaggaaaagcctgtaacctggagagcctttcttgagccaggaatacactgaagacaaagaagtcacattgacaaagttaagtagcggccgccgtcttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgctgttcaccggttggtcatgggtgaccattgctgaaaaactcggcggctggattttaaatattcttaccttcgccagtaatcgtacccgtcgcgatgatacctgggtcgatgaagatgagtatgaagacgacgaagagtatgaagatgaaaatcacggcaaacagcatgaatcacgccgtgcccgtattcttcgcggcgcgctagcgcgtcgtaaacggttggcggaaaaattcattaatccgatggggcggcaaacagatgctgcgctgttctccggtaagcggatggatgatgaagaagagattacctacactgcacgcggtgtggctgccgaccctgacgacgtcctgttttcgggcaatcgtgcaacgcagccagaatatgacgaatacgatccattattaaacggtgcgccaattaccgaacctgttgctgtagcagctgctgctaccacggcgacacaaagctgggctgcaccggttgaacctgtgactcagacgccgccagttgcctctgttgatgttccacctacgcaacctacagtagcctggcagcctgtaccggggccgcaaacgggagaaccggttattgcacctgcaccggaaggttacccacagcagtcacaatatgcgcagcctgcagtgcaatataatgagccgctgcaacaacctgtacagccacagcagccgtattatgcgcctgcggctgaacagcctgtgcaacaaccttactacgctcctgcgccggaacagtctgcgcaacagccgtattacgcccctgcgccagaacaaccggtggcaggtaacgcctggcaagccgaagagcagcaatccacttttgctccacagtctacataccagacggagcaaacttatcagcagccagccgctcaggagccgttgtaccaacagccgcaacccgttgaacagcagcctgttgtggagcctgaacccgttgtagaagagacaaaacccacgcgtccgccgctttactattttgaagaagtggaagagaagcgagcccgtgaacgtgaacaacttgcggcctggtatcaaccgattccagaaccggttaaagaaccggaaccgatcaaatcttcgctgaaagcaccttctgttgcagcagtacctccagtagaagccgctgccgctgtttctccgctggcatctggtgtgaaaaaagcgacactggcgacgggggctgccgcaaccgttgccgcgccagtcttcagtctggcaaatggcggtggaccgcgtccgcaggtcaaagaggggattggcccgcagttgccacgaccgaaacgcatccgcgtgccaactcgtcgtgaactggcgtcttacggtattaagctgccctcacagcgtgcggcagaagaaaaagcccgtgaagcccagcgtaatcagtacgattctggcgatcagtacaacgatgatgaaatcgatgcgatgcagcaggatgaactggcacgtcagttcgcccagacgcagcagcaacgctatggcgaacagtatcaacatgatgtgcccgtgaacacagaagatgcagatgctgcggcagaggcagaactggctcgtcagtttgctcaaactcaacaacaacgttattccggcgaacaaccggctggggcgaatccgttctcgctggatgattttgaattttcgccaatgaaagcgttgctggatgatggtccacacgaaccgctgtttacgccaattgttgaacctgtacagcagccgcaacaaccggtagcaccgcagcagcaatatcagcagccgcaacaaccggtagcaccgcagcagcaatatcagcagccgcaacaaccggttgcaccgcagccgcagtatcagcagccgcaatatcagcagccacaacagccggttgcacagcagccgcaatatcagcagccacaacaaccggttgcacagcagccgcagtatcagcagccacaacagccggttgtatcacagccgcaggataccctgcttcatccgctgttgatgcgtaatggcgacagccgtccgttgcataaaccgacgacgccactgccttctctggatttgctgacaccgccgccgagcgaagtggagccggtagatacctttgcgcttgaacaaatggcgcgcctggtagaagcgcgtctggctgatttccgtattaaagccgatgttgtcaattactctccggggccagttatcactcgctttgaattgaacctggcaccgggcgtaaaagcagcgcgcatttctaacttgtcacgtgaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaagtctgtcggggtgaacgcgatgatcctgagcatgctttataaagcacagccagaagatgtgcgtttcatcatgatcgacccgaaaatgctggagctttcggtttatgaaggcattccgcacctgttaacggaagttgttactgatatgaaagatgccgccaacgcgctgcgctggtgtgttaacgagatggagcgtcgttataaactgatgtctgcgctgggtgtgcgtaatctggcgggttataacgaaaaaattgctgaagccgatcgcatgatgcgtccgattccagacccgtactggaagccgggtgatagtatggatgcgcagcatccggtgctgaaaaaagaaccatacattgtggtgttggtggacgaatttgccgacctgatgatgacggtaggtaaaaaagtggaagagctgatagcacgtctggcgcaaaaagcccgtgccgcgggtatccacctcgtactggcaacgcagcgtccatcggttgatgttattactggtctgattaaagcgaatattccgacccgtatcgcctttaccgtatccagtaagattgactcacgtaccattcttgatcaggctggtgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagtgaaagcgaaggtggcgtgggcggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggaaatcgtgaagtgctggccccaccgccatttgactaattaatgcaacgtaggccggataagacgcgatagcgtcgcatccggtattctatcaactgaaaattcagtattttcttctttcctcaagctgattattagcctggaatagagagtagagggaactcccgattgggagtgacgtaatttgaggaataatgatgaaaaaaattgccatcacctgtgcattactctcaagtttagtagcaagcagcgtttgggctgatgccgcaagcgatctgaaaagccgcctggataaagtcagcagctttcacgccagcttcacacaaaaagtgactgacggtagcggcgcggcggtgcaggaaggccagggcgatctgtgggtgaaacgtccaaacttattcaactggcatatgactcaacctgatgaaagcattttggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgttctgacgccgaaagccagcaatggcaatctgaagcagttcaccattaacgtgggacgtgatggcacaatccatcagtttagcgcggtggagcaggacgatcagcgcagcagttatcagctgaaatcccagcaaaatggggctgtggatgcagcgaaatttaccttcaccccgccgcaaggcgtcacggtagatgatcaacgtaagtagaggcacttgagtgagcaatctgtcgctcgatttttcggataatacttttcaacccctggccgcgcgtatgcggccagaaaatttagcacagtatatcggccagcaacatttgctggctgtggggaagccgttgccgcgcgctatcgaagccgggcatctgcattctatgatcctctgggggccgccgggtaccggcaaaacaaccctcgctgaagtgattgcccgctatgcgaacgctgatgtggaacgtatttctgccgtcacctctggcgtgaaagagattcgcgaggcgatcgaacgcgctcggcaaaaccgcaatgcaggtcgccgcactattctttttgttgacgaagttcaccgtttcaacaaaagccagcaggatgcatttctgccacatattgaagacggcaccattacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcattgcataagtcggtacgtggtagcgcacccgatgcggcgctctactggtatgcgcgaattattaccgccggtggcgatccgttatatgttgcgcgtcgttgcctggcaattgcttccgaagatgtcggcaatgccgacccacgggcgatgcaggtggcaattgcggcctgggattgctttactcgcgttggcccggcggaaggtgaacgcgccattgctcaggcgattgtttacctggcctgcgcgccaaaaagcaacgctgtctacactgcgtttaaagccgcgctggccgatgctcgcgaacgtccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaatgttatcgttgcggtaatgttgttaatgtatccctgtggtcgcaggctgtggccacatctcccatttaattcgataagcacaggataagcatgctcgatcccaatctgctgcgtaatgagccagacgcagtcgctgaaaaactggcacgccggggctttaagctggatgtagataagctgggcgctcttgaggagcgtcgtaaagtattgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctaaccatccctaacctgcctgcagatgaagtgccggtaggtaaagacgaaaatgacaacgttgaagtcagtcgctggggcaccccgcgtgagtttgactttgaagttcgtgaccatgtgacgctgggtgaaatgcactctggcctcgactttgcagccgcagttaagttgactggttcccgctttgtcgtcatgaaagggcagattgctcgcatgcaccgcgcactgtcgcagtttatgctggatctgcataccgaacagcatggctacagtgagaactatgttccgtacctggttaaccaggacacgctgtacggtacgggtcagctgccgaaatttgctggcgatctgttccatactcgtccgctggaagaagaagcagacaccagtaactatgcgctgatcccaacggcagaagttccgctgaccaacctggtacgcggtgaaatcatcgatgaagatgatctgccaattaagatgaccgcccacaccccatgtttccgttctgaagctggttcatatggtcgtgacactcgtggtctgatccgtatgcaccagttcgacaaagttgaaatggtgcagatcgtgcgcccggaagactcaatggcggcgctggaagagatgaccggtcatgcggaaaaagtcctgcagctgctgggcctgccgtaccgtaaaatcatcctttgtaccggcgacatgggctttggcgcttgcaaaacttacgacctggaagtatggatcccggcacagaacacctaccgcgagatctcttcctgctccaacgtttgggatttccaggcacgtcgtatgcaggcacgttgccgcagcaagtcggacaagaaaacccgtctggttcataccctgaacggttctggtcttgctgttggtcgtacgctggttgcagtaatggaaaactatcagcaggctgatggtcgtattgaagtaccagaagttctgcgtccgtatatgaacggactggaatatattggctaatacccaatttttctgaatctaaaaagcgcctgcgggcgctttttttgtctccctttgataccgaacaataattactcctcacttacaagtaatactactttcgagtgaaaatctacctatctctttgattttcaaattattcgatgtatacaagcctatatagcgatctgctatagaaataattacacaatacggtttgttactggaatcaatcgtgagcaagcttgagtgagccattatgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgctattccaacaaaatcagacgaaaaggttatctggagcgcctgtacagttaactgtggtagtcgctgcccgctacgtatgcacgtagtggacggtgaaatcaaatatgtcgaaacggacaataccggcgatgacaattacgacggcctgcaccaggttcgcgcctgtctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaaaatgcagcgcctgatcaaagagtacggcaacgagtctatctatctgaactatggcaccggtacgctgggcggcaccatgacccgctcgtggccgccgggaaataccctggtcgcgcggctaatgaactgctgcggcggttatctgaaccattatggcgactactcctccgcgcaaattgcggaaggtctgaactatacctacggcggctgggcagatggtaacagcccgtcggatatcgaaaacagtaaactggtagtgctgtttggtaataaccctggcgaaacgcgaatgagtggcggtggggtgacttactatcttgaacaggcgcgccagaaatctaatgctcgcatgatcatcatcgatccgcgctataccgacaccggtgccgggcgtgaagatgagtggatccctattcgtccgggaacagatgccgcactggttaacggtctggcgtatgtcatgatcaccgaaaacctggtagatcaggaattcctcgataaatattgcgttggctacgacgagaaaaccctgccagccagtgcgccgaaaaatggtcactataaagcttatattctgggtgaaggacccgatggcgtggctaaaacaccggaatgggcctcgcaaatcaccggtgttccggcagacaaaatcatcaaactggctcgtgaaatcggcagtaccaaaccggcgtttatcagccagggatggggcccgcagcgtcatgctaacggtgaaatcgcaacccgtgctatctcgatgctggcgattctgaccggtaacgttggtattaacggggggaacagcggcgcgcgcgaaggttcatacagcttaccgtttgtccgtatgccgactctcgaaaacccgatccagaccagcatttctatgtttatgtggaccgatgccattgaacgtggcccggaaatgacggcgctgcgtgatggtgtgcgcgggaaagataagctggatgtgccgatcaaaatgatctggaactatgccggtaactgcctgattaatcagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcactggatgcatcctgcgggaatatgtcttacgttattttcaatgatcaggtcattaaaccgcgctttgaatgtaagactatctatgagatgaccagcgaactggcaaaacgtcttggcgtcgaacaacagtttactgaaggtcgtactcaggaagagtggatgcggcatctgtatgcccagtcgcgggaagcgattcctgaactgccaacgtttgaagagttccgtaagcaggggatctttaaaaagcgcgatccgcaagggcatcacgttgcttataaagctttccgtgaagatccgcaggcaaatccactgaccacgccatcggggaaaattgagatttattcgcaggcgctggctgacattgccgctacctgggaattgccagaaggtgatgtgatcgatccactgccgatctacacgccgggctttgaaagttatcaggatccgctgaacaaacagtatccgctgcagcttacgggtttccactataaatctcgcgttcactcaacttacggcaacgttgatgtgctgaaagcagcttgccgtcaggaaatgtggatcaacccgcttgatgcgcaaaaacgcggtatcaacaacggcgataaagtcaggatctttaatgatcgtggtgaggttcatattgaggcgaaagtgacgccacgaatgatgccgggtgtggtcgcactgggtgaaggtgcctggtatgacccggatacaaaacgtgtcgataagggcggttgtattaacgtactgaccactcaacgtccgtctcctcttgccaaggggaatccatcacatacgaaccttgttcaggttgaaaaggtgtaaggagtaaccgatgacaacccagtatggattttttattgattccagccgttgcaccggttgcaaaacctgcgagctggcttgtaaagactacaaagatttgacgccagaagtcagcttccgccgcatttatgaatatgctggtggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtatgcattggctgccgttactgtcatatggcttgcccgtatggcgcaccgcaatataacgaaacgaaaggccatatgaccaaatgcgatggttgttatgaccgtgttgcggagggaaaaaaaccgatctgcgtagagtcctgcccgctgcgggcgctggatttcggccctatcgacgagctgcgtaaaaaacatggcgatctggcggccgttgcgccgttgccgcgagctcactttaccaaaccgaatattgtgatcaaacccaatgccaacagccgcccaaccggggataccactggctatctggcaaacccgaaggaggtgtgagatgggaagtggatggcatgaatggccgctgatgatcttcacggtcttcgggcaatgtgtagcgggtggttttatcgttctggctttggcgctgctcaaaggcgacctgcgagcagaagcccagcagcgtgttatcgcctgcatgttgggtttatgggtgctgatgggcattggctttatcgcctctatgcttcatcttggttcaccgatgcgcgcttttaactcgctcaatcgggtaggggcttcagcactcagtaacgaaattgccagcggttcgatcttttttgctgtaggcggcatcggctggttgctggcaatgctgaaaaagctttcaccggcattgcgtacgctttggctggtggtgacgatggttcttggcgtagtctttgtctggatgatggtgcgtgtgtataacagcatcgatacagtacccacctggtacagcatctggacaccgatgggcttcttcctgacgatgtttatgggcggcccgttactgggttacctgttgctgagtctggctggtgtcgatggctgggcgatgcgtctgctgccagccatttctgttctggcactggtagtgagtggcgtgatgtcagtgatgcagggcgcagagctggcgaatattcatagctctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgtggcgtattctatggtttgcatatgaccgtggggatggctgtcgcaagttaatcagtaacaaccggggtttcggccccggttcgcttttatttctgcttcgttaacgtgtcataactggtcatcaagttacgataatcaggaatgtggttagagaacaacgtcgccagtccttcaatatcattacgccagtcgcgatgcagctcgcacgccacgccgaaccatgtcatcaattgcgcaccagcttgcgacatgcgatcccatgccgaatgccgggtaatttcattaaaggtccctgacgcgtcagtcacgacaaagacgtcaaacccttcttcaatggctgaaagcgccgggaatgccacgcaaacttcggttaccacaccggcaataattaactgttttttacctgtcgctttgacagcttttacaaaatcttcgttatcccaggcgttaatatttcccgggcgagcaatgtaaggtgcatcggggaattgtgctttcagttctggaactaatgggccgttaggaccggtttcaaaactggtggtaagaatagttggtaagttgaaatacttagccaggtcacccagcgccagcacgttatttttaaacttatcgggttcgatatctcgtacaagggaaagtaaaccagcctggtgatcaacaagcaaaacggcagcatcatttttatcaagacgaacatacggtttggtcatcctcttctcctttcgagagtcagtggtacgtctaaatcggtcagacgtgatgcattgctctgaaagcatagacgggaaatatgagtttgctgtgaccatgaaatttttcgactgaacgaagcgtatgaaatttgtgttagatcaataaaaacaatcagatgagattaatcgtctcttcagcattagcgttatgaatgagtaatataaatcgataataccgccgctgcgatatgcgcgtattttcacccattgacaatgtttttggcggtggcatgatgcgcatgaaatttgaacttcctcacggttttaattcatgtccacgtatacccggcctgtcatgcttttgctgtctggcctgcttttgttgactctggcgattgcggtgttaaatacactcgtgccgctttggctcgcccaggaacacatgtctacatggcaggtaggcgttgtcagctcatcctattttaccggcaaccttgtcggtacattgctgacagggtatgtcattaaacgcattggctttaaccgtagctattatctggcctccttcatttttgccgctggctgtgccggccttggcctgatgattggattctggagttggttggcgtggcgttttgtcgctggcatcggctgtgccatgatttgggtggttgttgagagtgcgctgatgtgcagtgggacgtcgcgtaaccgcgggcggttgcttgctgcgtatatgatggtttattacgtcggaacgtttttaggccagttactggtcagcaaagtctcaaccgagttgatgagtgtattgccgtgggttacaggtttgacgttggcaggaatcttaccgctgttgtttacgcatgtcctgaatcagcaggctgaaaaccatgattcgacgtcaattacgtcaatgctaaaactccgtcaggcacggcttggcgtgaatggctgcattatctcaggaatcgtgctgggatctctatatggcctgatgccgctgtacctcaatcacaaaggggtgagcaatgccagcattggtttctggatggcggtactggtcagtgcgggtatcctcgggcaatggccgattggacgtctggcggataagtttggtcgactgctggtgttgcgtgttcaggtctttgtcgtcattctcggcagtattgcgatgcttagccaggcggcgatggccccagcgttattcatcctcggtgccgctggctttacgctatatccggtggcgatggcctgggcttgtgagaaagttgaacatcatcaactggtagcgatgaaccaggccttactgttgagctataccgtgggaagcctgcttggcccgtcatttaccgctatgctaatgcagaatttctccgataatttattatttatcatgatcgccagcgtatcgtttatctatttgctgatgctgcttcgcaacgccggtcatacgccgaaacccgtggctcacgtgtaaatgaattcaagcagagtgtgaacttactgtttcacactctgcttttctgtgcacaaaaaagcggcaacttaataaagttgccgctttacggggaaattagaacatgaccttatgaccgtactgctcaagaatgcctttcacgcgttccatggtctctttcttcggtggtttaacaccatcgagtttgtattcttcacccattgccacccatttgtgtttgcccagttcgtggtaggggaggagctcgattttctcaacgttgcccatatcacgggtaaattcaccaaggcgatgcgctgaatcgtcatcgtcagaccagcctgggacaacaacatagcggatccacaccttcacatttttgttcgccagatatttagcgaactccagcgtgcggtggttggaaactccaaccagattttggtggatctcgtcgttcatctgtttgagatcgagcattaccaggtcggttacttccagcagttcatcaatcaccggatcgtaacgacgaacaaaaccgttggtgtccagacaggtatgaatgccttcttttttgcaggcgcggaaccagtcacgaacaaactcagcttgtaggattgcctcaccgccggatgcggtaacgccgccgccggaagcgttcataaagtggcgataggtcaccacttccttcatcaaatcttcaacggtaacttctttaccgccatgcgtatcccaggtgtcgcggttatgacaatacaggcagcgcatcaggcagccctggaaaaaggtgataaagcgaatacccgggccgtctacggttccacaggattcaaaggagtgaatgcgaccaataactgacttggtagcccccgccgtagcggtattttctgttgtattacaattagttaaattactcatatcgcttcaattggctctagttaactctggtttatggacgcattatggacattcctgacaccgggttaagagtcactgcatcttgtaagaaatccggtgcaaagtgtgcgtaggtcatagtttgctgaatgttagaatgacccaggatgcgctgcaatgtgattatgttacctccattcattataaaatgtgtggcaaatgtatgcctcaaaacatgcactgcctgtccgtcaggtaaatcgggttttacttccctgagagcgttgcgcactttgtagtaactggcattaaaaagcctgcctgaatttttggtcttgatccgtttaatcaggtcctgcgaaacgggaattgtcctgcgctttccgtttttagttttcataaacgtaaccatctggttaatgatgtgttcagcttttaaattagacacttcactccagcgtccaccagtagaaaggcagaccagagtcgcatttaattcatcaccatcgagcatggataacagccgtgtaatctcttcactggacaaaaaagccatttctgtaacagcttcacgtaatcgcttaacctcacggaacgggttgtgagaatggtattcaccggcgtcaattaacttggtgaacatcccgctcattattgccagatgccgatttacgctggctggttttagaccatcgttcatcattacaacgcgataatcagttatcgttttctttgttagctggtcagctctggacactcccatttctgcaaatttggcgattattgtcgtcaaacgcccccgttcaatatctccacgctcatgtgattttccgtgatatatccaccatctgcctaacaactctgtaagagttcggcggtcggctggcttctccagccactctttgttgtggtagttaaccagtacatgacgttcgaatgcttgagcttcacctttagttttaaatttccgcctgatacgttttccatctgcaccctgcggtctgacgtccacttcataacgaccatcatcgagctttttaatagacataaagccctccgatgacgctgtttacttctactacttgaaaattaatgcaattttctttcgtacatttactgcatacatatgctgaataaatcgtcagccagtcttttggtctgagtggtgcaaggttgttgagtcttgcccaatgtgcgcgagcgccggggctatttgtccgccagcgggatcagtttcatcaaacatgaaccagtcacggtacttgcgaaatctttcaggcttgaaaaatttcatgcctgcgtcaaaagacatctttacttttccctgctcatatccagcataggtgttgtagttaattccagttaattcagcaacttgcttccttgtcattctttctgactcccgaataagtgcgagtttctctgcttgagatgtgatttgtgtatttgacatgaattgtcgtatctcgtaatttatgttgtatgcgacacaccagaacaacgcagagcggcttcaaatagctctggttgaatggcaccaaagttgaggatatcaaaatgagtattggatcagaaatgaataacgatgttggagaaaaagtatctgatctcacaaaaagtaaaaaatgtgacatcaaacttgcagccgcaccgtcggatttgctctcgaaagagggatttgctctttacatcggtaagacgcctcgtgctgttgctgaaatggcgaaagcaggcaagttaccagccttttatatgacggacccattaaagccgggcggtcatgctgagttatggattaatcgccgtgagtgggacaagtacgcagcccaactagttgatgaagctccgacagaatggcatgactggaaaaatcgcattagttacagcaaatcaagacatggccgtgcggcttaaggtggaaaggatgaacgagcctcgttgtattgctcagttattgcgtaacgaaagccccagggcgattgacttcaccattacccacggtaaggggcgtaagggaatcattatccgcaccaaaaaacagagtccgttaaaaaaggctctgacctttctgaaaagccggagggtatggaaatgacagtgatgacgctcaatctcgttgaaaaacaaccagcaactatgcgccggataattggtaagcatcttgccgtccctcgctggcaggagacatgtgattattataatcagatgatggagcgcgaacggctaacggtttgcttccatgcacagttaaaacagcgtcatgcaacgatgcgttttgaagaaatgaacgacgtcgaacgtgaacggctggtttgtgcaattgatgaattgcgtggggcattctcaaaacgccgtcaggtcggtgcaagtgagtatgcatatattagctttttaactgtcagtcagcgccgtactttatttatgcacgcacgactgacagaaaaagaatttaatcagccatactggcgaattaatgaagagtcatgttactggcgtgatgctttattccgtgcattacgtgaattattcagtctgtttgaatatgcaccgacaattctgacgtcggtaaaaccagagcaatatctgcattaagtaattaaccaaagtttttaacgcacttaatcgtgcggggcttctttttgcctggagaaagtcatgcatacagtttctgaaaatcagtgcggtaaatacgcattaatgctgcaacaggccagaaccgaagcacaggccgatgcagcaacgcgcttttcttctcatcttgatgccatgattcgccacatcacaaaggcggagttatcccgcgtggagatagtcgagttgctcagtcaggagtctgccaaattccataatctaggactcaataaataacagggaagttggagatgacaaatacaaaatggttcaggaaacgcttaacagattatcggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttcagcgcagacaatcacatcactgcccggctgtatgcgcgaggttaccgactgcggcctgagttttttaagtgacgtaaaatcgtgttgaggccaacgcccataatgcgggcagttacccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccagattatcaactttcattacttaaaaaattagatgacaagactccactacatccttcaagcgatgtcttccgctcctgtcctagtcgtgtggaaaaagcatttatagcaatggggaaatgggggcttgtgaccaaatcaagagaaggtttctgtattaccgataatggacgggaaatgattgattctgcggagagggcatatagcgaatgaaaaatatattgcttaataactggctgaagatttcagtcatgaaaaatggtgatttgtcgctagctgatattaaacgcgataaaaacactggggatatggtggaatcaactatagccatttatgcggataaattaaatctcctgtctgatgtggtcaatttacttgttaaacgcgctgtatttcataagcaaatttcatccgtggatgaactgacaaaattaacgacagaaatcgccagctattgcgctgatgaatttaagaagctgaacgacaaaaggagctggtaatgccggacaacgtagattttattcaggaacaacaggctgaattactggagcgccagattaacgcggcaagggtaaaacattgcggtgtttctgcgctggtttgcgaagagtgtgacgtgccaatacctgctgcccgtcgtgcggcttatccgtcagccacgcgttgtgtttcctgtcagtcagtctttgaagcaaaaaacaaacattaccggagaacggcatgagtattcgtattgaaattggcgaacgttatgtcgttaccagtgacagctttcagtttattctccacgagaaaaagagagcggaaagcggtaaaaacgccggtcaggaatggctgtcggtggttggttattacccgaaattaagccagctcgtttccggcatgatgcatcacgatattctgaccggaagcgcaaagtcttttgctgatttaaacgcgcaggttgagcaactcagcaagcgttgttcagaggcttttggctcatatggccgttaaagcctccgggcgttttgtccctccatcagcatttgccgcaggcaccggtaaggcgtttaccggtgcttatgcatggaacgcgccacgcgaggctgtcgggcgcgaaagaccccttacacgtgacgagatgcgtcaggtgcaaggtgttttatccacgattaaccgcctgccttactttttgcgctcgctgtttacttcacgctatgactacatccggcgcaataaaagcccggtgcacgggttttatttcctcacatccacttttcagcgtcgtttatggccgcgcattgagcgcgtgaatcagcgccatgaaatgaacaccgacgcgtcgttactgtttctggcagagcgtgaccattatgcgcgtctgccggggatgaatgacaaggaactgaaaaagtttgccgcccgtatctcatcgcagcttttcatgatgtatgaggaactctgcgatgcatgggttgatgcacatggcgagaaagaatcgctgtttacggatgaggctcaggcgcatctgtatggtcatgttgctggcgctgcacgagctttcaatatttcccctctctactggaaaaaataccgtaaaggacagatgaccacgaggcaggcatattctgccattgcccgtctgtttaacgatgagtggtggactcatcagcttaaaggtcagcgtatgcgctggcatgaggcgttactgattgctgtcggggaggtgaataaagaccgttctccttatgccagtaaacatgccattcgtgatgtgcgtgcgcgccgccaggcaaatctggaatttcttaaatcgtgtgaccttgaaaacagggaaaccggcgagcgcatcgaccttatcagtaaggtgatgggaagtatttctaatcctgaaattcgccggatggagctgatgaacaccattgccggtattgagcgttacgccgccgcagagggtgatgtggggatgtttatcacgctgaccgcgccgtcaaagtatcacccgacacgtcaggtcggaaaaggcgaaagtaaaaccgtccagctaaatcacggctggaacgatgaggcatttaatccaaaggatgcgcagcgttatctctgccgcatctggagcctgatgcgcacggcattcaaggataatgatttacaggtctacggtttgcgtgtcgtcgagccacaccacgacggaacgccgcactggcatatgatgcttttttgtaatccacgtcagcgtaaccagattatcgaaaccatgcgtcgctacgcgctcaaagaggatggcgacgaaagaggagccgagcgaaaccgttttcaggcgaaacaccttaaccggggcggtgctgcggggtatatcgcgaaatacatttcaaaaaatatcgacggctatgcactggatggtcagctcgataacgataccggcagacctctgaaagatactgccgcggctgttactgcatgggcgtcaacgtggcgcatcccgcaatttaaaacggttggtctgccgacaatgggggcttaccgtgaactacgcaaattgcctcgtggcgtcagcattgctgatgagtttgacgaacgcgtcgaggctgcacgcgccgccgcagacagtggtgattttgcgttgtatatcagcgcgcagggtggggcaaatgttccgcgcgattgtcagactgtcagggttgcccgtagcccgtcggatgacgttaacgagtacgaggaagaagtcgagagagtggtcggcatttacgcgccgcatctcggcgcgcgtcatattcatatcaccagaacgacggactggcgcattgtgccgaaagtgccggtcgttgagcctttgactttaaaaagcggcatcgccgcgcctcggagtcctgtcaataactgtggaaagctcaccggtggtgatacttcgttaccggctcccacaccttctgaacacgccgcagcagtgctaaatctggttgatgacggtgttatcgaatggaacgacacggaggtcgtgagggcgctcaggggggcattaaaacacgacctgagaacaccaaatcgtcagcaaagaaacggaagcccgttaaaaccacatgaaattgcaccatcggccagactgacccgatcggaaagaatgcaaattacccgtatccgcgttgaccttgctcagaacggtatcaggccgcagcgatgggagcttgaggcgctggcgcgtggcgcgaccgtaaattatgacgggaaaaaattcacgtatccggtcgctgatgagtggccgggattctcaacagtaatggagtggacataatggcaaaaattcacgaggtaaagctgcacgcgaaatatttcgaccttgtgctggaaggaaagaaacgtgcagagttccggaaaaatgaccgtaattatgagcgcggggacacgttgattttgcatgaatgggtgcagggtgtgtatacggggcgaaaggttgaagcccggataacagatgttactgacctgtcagactggctggaagattatgtcttgctaagtattgagcggcttaatacaggcgcatgtgagattgtgaactggaaagaacttagtgagcgtggtctggtattcagaattaatcatgaaattatgcatcagctcggccttgctgttatgtatgaaccagagacggggatgtctggcggggcaatggttgccacggatggagcatggaactattcagatgaacagatggagcgtgcacagcaaaacgggtggcttggataatgcacagaataccaggcgagataccgcaccataaaactaaaaatatcaagctgatggctattgttcagcgtttacagaggattatggtcaacgaaaatctgacgccggatgagctggtcgggtgtgccgaaatagtacgggataattacgggcagcttaactatatcggtcagtccagagttgcgccaccaccacgaagacgatagagaacgccgccagtcgtgaaacttgttttcagggctggcggggttgaacaacgagcgaagcgaggcgttagttgacagacatatttttactgcgttggtgccggtttttgacggttgaaaggagttaggttggagagctaacaacttacaaatattcaaaagtaagcatcctgttgctaacatgaggtcgattttttatgtggatgatgtaaaaaggatagctatggatactataatcgcttttctatcactcgcttttttcgttgctttcttcatcgggttaatcaagccatcactggtgcgaatgccaaaccgcaaacgtgcaagtgcggtttatctcggaggaggttttgtattgagcataattggttcaatactctatccaacagaaaaaagccagccagttgctaaaactgaaacatcaaccgttgcagaacacaaagtccaaaaaacattcgaatatggtgaaaaaacactcaaggaatatcggaacgagtcaaagaaaacacgacacgatattgtgaatagttacattgattttaaggaagttccagccaccgcgtcagatgcgttttatgcctgcatgagtgagtatacatttaccaaagatgatgagttgaaactcggtgatgttcttgggtggtgctttaatgattatgaaaatgacccgaattcactaaacaataaaatcaatcttgatacatttcagagtaattttagtggttgggatggttcttatcgtccattggaaaaactaattaaagataatatgaacgatgattcatcttataaacatgtgtcaacggtatatcatctggttttgaataaagacccgcatgccattgtgaaaaccacgtttcgcggaactaatgcttatggaggagtggtgaaacagacgattgctgcgcgtgttgatataaaaactggtaaggtgatatcaatcatagataattgatatcttacaatgccgacgctgaatatttaattgggtgtcggcattttttttgactattagagcggcagagccgagatttgttacgtatgagattagcactgcgagaatgttatgaaagttataaaccaacttaagaagtttgataagaaaagaacgccagatgatggccgtattagtttgttatatgaaaacgcgattaagtatgatatgtactctgtatatattaaagataaaaatgatacagaatacctctttgactgtttggttgatgggaagataaaggcttttaaatgggatgatgaggaacgtagatttcatataagttcatacttggatatttctgagcttacgcctgattctttttttggtatttattactaccgtgcgcatgagttgcgatttaactctttaaatgatttaacctttttaagggagttgttttttagagtgaagtctaattatgaaaatataaagtttagtcgtgaaaaatatatttatcgacagcaaaaaaaagaaataactgatgtgatgcttgttctctcaacgattataagaatgtatcgtgaacgggatgctgaaactgtgtttagtgagttttcaataatgaccgaagtcgctggtagtttatgggtataccatgacgataaaaacaggatgcgtaaagagcttcgtttatgcctgaattctcttgttcagaatggagatcttgttgaaacaagtagtggatttaggctaacaggaaaggcactgaacacaatatctacattcaataaagatgagttgcggtacagagagaatttgagcactcagaagaaaatgttttgggctacttttttcgcagcagtcggcggcgtaggaagtatgattgcagctataatagggcttctaaaatgagccaacaaaatcgtatgatgaagtattgagtgaaaagcattctttatatgcattattttgcatgcaacatatgctatacattttagctatgaattgtcagacgtggcagtacttctgtatggtaatgcaactgcattaaaaccgccccatgaagcgggcgggcgaggcggggaaagcactgcgcgctggcggtggtgctgattttattttttcagcgtctcagcgcgtcgtgatggcatttagtcggcctgctggggcgttggtgtgtctgcggggtgttttgtgcggtggtgagcgtgtgagggcgtgatggcgggttgtaaaaaagccgcccgcaggcggcgatgttcagccgttgtcagtgtccagtgagtagtttttaaagcggatgacctcctgaccgagccagccgtttatctcgcggatcctgtcctgtagcgggataagctcattgcggacaaagacctttgccactttctcaatatcacccagcgacccgacgttctccggcttgccgcccatcaactgaaaggggatgcggtgcgcgtccagcaggtcagcggcgctggcttttttgatattaaaaaaatcgtccttcgtcgccacttcactgagcgggataattttaatgccgtcggctttcccctgcggggcatagagaaacaggtttttaaagttgttgcggcctttcgacttcaccatgttttcgcgaagcatttcgatatcgttgcggtcctgcacggcatcggtgacgtacatgatgtatccggcatgtgcgccgttttcgtaatacttgcggcggaacagcgtggctgactcattcagccaggcagagttaagggcgctgagatattccggcaggccgtacagctcctgattaatatcgggctccagcaggtgaaacacggaaccgggcgcgaaggctgtcggctcgttgaaggacggcacccaccagtaaacatcctcctccacgccacggcgggtatattttgccggtgaggtttccagtctgatgaccttaccggtggtgctgtaacgcttttccagaaacgcattaccgaaaaccagaaaatccagcacaaagcggctgaaatcctgctgggaaagccacgggtgcgggataaacgttgaagccagaatattacgtttgacgtaaatcggtgagctgtgatgcacggcagcacgcagactttttgccagaccggtaaagctgaccggtggctcataccatctgccgttactgatgcattcgacgtaatccagaatgtcacggcggtcgagtaccggcaccggttcgccaaaggtgaatgcctccattttcggggcgctggcggtcattttttttgccgcaggttgcagtgttttcccttttttcttgctcatcagtaaaactccagaatggtggatgtcagcggggtgctgataccggcggtgagtggctcatttaacagggcgtgcatggtcgcccaggcgaggtcggcgtggctggcttcctcgctgcggctggcctcataagtggcgctgcgtccgctgctggtcatggtcttgcggatagccataaacgagctggtgatgtcggtggcgctgacgtcatattccagacagccacggcggatgacgtcttttgccttgagcaccattgcggttttcatttccggcgtgtagcggatatcgcgcgcggcgggatagaacgagcgcacgagctggaacacgccgacaccgaggccggtggcatcaataccgatgtattcgacgttgtatttttcggtgagtttgcggatggattccgcctgggtggcaaagtccatgcctttccactggtgacgctcaagtattctgaatttgccaccggccaccaccggcggtgccagtaccacgcatccggcgctgtcgccacggtgtgacgggtcgtaaccaatccagaccgggcgggagccgaacggattggcggcaaacggcgcatagtcttcccattcttccagcgtgtcgaccatgcagcgttgcagctcctcgaacgggaacaccgacgccttgtcgtcaacaaattcacacatgaacaggtttttaaaatcgtcggcgctgttttcgcgtttgagctgttcaatgtcgaacagcgtgcagccacctttcagggcgtcctcaatggtgacaatctgccgccactggccgtccgcacagagaagcccaccggcaagggcgttatgactgacgtcgatttccacgcgttcggcggcgctggcgcgtccccggttgaacagttcacctgaccagaacgggtaggcgtcgtgcgccagcgtggacggggtggagaaataggtcgagcgcaggtgactctgtgaggccatacctgatgccaccttacgcagtacctgaaaattcgggatccagaaaatctcgtcgacgtacaggtcgccgttatggctctgtgcggtgttggagttggtgccgagaaaaatcagttttgcgccgttattgcccaggacaatcgggtcaccggtcaggtcaacgtcaaccagccgggcaaaggcgatgatgtattcgcggaacacatacgcctgcgttttactggccgacagaaaaatctggttatggccggttttcagggcgcgcagcagcgcctcgcgggaaaaataaaacgtcgcaccaatctggcgggatttcaggatatcgcggatgcggtgctcaagcccggcgcgataccagtgcaactgatagtcgaaagactgctcaaagaaaatctgctccagcttttcgatggcctcgtcactgaaaaaattttttttcggtttgcgccgcccgcctttgttgcggttagcgacgttcggattaaggtctgcctcgttgccggtctggctgtaacgatttacccgtgccagtcgttcaatctggcgtcccagcaggtcaatttccttgaagtcaccgccggttttctgcggtttgataatgagctgggtcagccgcgcttccaggctcatttcgacacggctgatgggggcaacgttgtcccagccgtcgcgctgtttccagctctgcactgtcgggcgtttcatctgcaacatggcggcaatctgcggcacggaaaatccctgccagtacagcagcgccgcctgacgacgcgggtcgtgtaaaagagtggtgtctgtggtgatggtcatgaatacctcgccgtgatgaatacacggcaaggctactgagtcgcgccctgcgattcgctaaggtgctgttgtgtcagtgataagccatccgggactgatggcgtaggatgcgcatcgtcgggaaactgatgccgacatgtgactcctctaatcactattcaggactcctgacaatggcaaaaaaagtctcaaaattctttcgtatcggcgttgagggtgacacctgtgacgggcgtgtcatcagtgcgcaggatattcaggaaatggctgaaacctttgacccgcgtgtctacggttgccgcattaacctggaacatctgcgcggcatcctgcctgacggtatttttaaacgttatggcgatgtggccgaacttaaggccgaaaagattgacgatgattcggcgctgaaaggcaaatgggcgctgtttgcgaaaatcaccccgaccgatgaccttatcgcgatgaacaaggccgcgcagaaggtctacacctcaatggaaattcagccgaactttgccaacaccggcaaatgttatctggtgggtctggccgtcaccgatgacccggcaagcctcggcacggaatacctggaattctgccgcacggcaaaacacaaccccctgaaccgcttcaaattaagccctgaaaacctgatttcagtggcaacgcctgtttgagctggaatttgaagacctgcctgaaacagtgttcaccgcccctgaccgaaaaggtgaagtccatttttggccgcaaacaggccagcgatgatgcccgtctgaatgacgtgcatgaagcggtgaccgctgttgctgaacatgtgcaggaaaaactgagcgccactgagcagcgcctcgctgagatggaaaccgccttttccgcacttaagcaggaggtgactgacagggcggatgaaaccagccaggcattcacccgcctgaaaaacagtctcgaccacaccgaaagtctgacccagcagcgccgcagcaaggccactggtggtggcggtgacgccctgatgacgaactgctgaccggcgtcagtcagtccgggaaaaccttcacgattaacccttaatttcaggaaaaactatgcgccaggaaacccgctttaaatttaatgcttacctgtcccgtgttgccgaactgaacggcatcgacgccggtgatgtgtcgaaaaaattcaccgttgaaccgtcggtcacccagaccctgatgaacaccatgcaggagtcctctgactttctgacccgcatcaatattgtgccggtcagcgaaatgaaaggggaaaaaattggcatcggtgtcaccggctccatcgccagcaccaccgacaccgccggtggcaccgagcgtcagccgaaggacttctcgaagctggcgtcaaacaagtacgaatgcgaccagattaacttcgatttttatatccgctacaaaacgctggacctgtgggcgcgttatcaggatttccagctccgtatccgtaacgccattatcaagcgtcagtcccttgatttcatcatggccggttttaacggcgtgaagcgtgccgaaaactctgaccgcagcagtaatccgatgctgcaggatgtggcggtcggctggctgcagaaataccgcaatgaagccccggcgcgcgtgatgagcaaggtcactgacgaggaaggtcacacgacctctgaggtcatccgcgtgggtaagggcggtgattatgccagccttgatgcactggtgatggatgcgaccaacaacctgattgaaccgtggtatcaggaagaccctgaccttgtggtgattgtgggtcgtcagctactggcggacaagtatttccccatcgttaacaaggagcaggacaacagcgaaatgctggccgctgacgtcatcatcagccagaaacgcatcggtaacctgccggcggtacgcgtcccgtacttcccggcggatgcgatgctcatcacgaagctggaaaacctgtccatctactacatggatgacagccatcgccgcgtgattgtggaaaacccgaaactcgaccgcgtggagaactacgagtcaatgaacattgattacgtggtggaagactacgccgccggttgtctggtggaaaaaattaaggtcggtgatttctccacaccggctaaggcgaccgcagagccgggagcgtaaccgatgacgagtcccgcacagcgccacatgatgcgggtctcggcagcgatgaccacgcagcgggaagccgccccgctgcgacatgcaactgtctatgagcagatgctggtcaagctggccgcagaccagcgcacactgaaagcgatttattcaaaagagctgaaggccgcgaaaaagcgcgaactgctgccgttctggttgccgtgggtgaacggcgtgctggagcagggcaaaggcgcacaggatgacattctgatgacggtcatgctgtggcgtctggataccggcgatattgccggtgcgctggagattgcccgttatgccctgaaatacggtctgaccatgccgggtaaacaccgccgcaccccgccgtatatgttcaccgaggaggtcgcgctcgcggccatgcgcgcccacgcggccggtgagtctgtggatacccgcctgctgacggagacccttgaactgactgccgctgctgacatgcctgatgaagtgcgcgcaaagctgcacaaaatcaccggtctgtttctgcgtgacggtggtgatgccgccggtgcgctggctcacctgcaacgtgcgacacagctcgactgtcaggcaggcgtcaaaaaagagattgagcgactggagcgggagctgaaacctaagccggagccgcaacccaaagcggccacccgtgccacgcgtaagacccggagcgtgacaccggcaaaacgtggacgcccgaaaaagaaagccagttaacaaccgaatgcgccccgcgccagggcggcacgccggtcagtgagggtgaatcacctgacactgcaccggcgtccaccgcccgacttttcagaggtagtcatgatgacgctgattattccgcgaaaggaggctcccgtgtccggtgagggtacggtggtcatcccgcaaccggcaggcgacgagccggtgattaaaaacacgttcttttttcccgatatcgacccgaagcgcgtccgggaacgtatgcgccttgagcagaccgtcgcccccgcccgtctgcgtgaggccatcaagtcaggcatggcggaaacaaatgcggagctgtacgagtaccgcgaacagaaaattgccgccggttttacgcgtctggcggacgttccggcggacgacatcgacggtgaaagtatcaaagttttttactacgagcgcgccgtgtgtgcgatggcgaccgcgtcgctttatgagcgttatcgcggtgtggatgccagtgcgaaaggcgacaagaaggtcgacagcattgacagcaccattgatgagctgtggcgggatatgcgctgggcagtggcgcgcatccaggacaagccgcgctgcatcgtgagtcaaatctgatgaagacctttgcgctacagggcgacacgctcgatgccatctgtgtccggtattacgggcgcactgagggcgtggttgagaccgtgctcgccgcaaatccgggactggctgaactgggggcggtgctgccacatggcaccgccgtcgaactgcccgacgttcagaccgcgcccgtggctgaaactgtcaatctgtgggagtaacgcatgacagcagaagaaaaaagcgtcctgtcgcttttcatgattggggtgctgattgttgtcggcaaggtgcttgccggtggtgaacccatcaccccgcgtctgtttatcgggcgcatgttgctcggtggttttgtctcgatggttgccggtgttgttctggtgcagtttcctgacctgtcactgcctgcggtgtgcggtatcggctccatgctgggtatcgccggttatcaggtgattgagattgccattcagcgccgctttaagggcagggggaaaccgtaatgccggtaattaacacgcatcagaatatcgccgcctttctcgacatgctggccgtgtccgaagggacggcgaaccatccgctgacgaaaaaccggggctatgacgtgatagtcaccggactggacgggaagccggaaatcttcactgactacagtgaccacccgttcgcacatgaccgaccggcgaaggtgtttaaccatcgcggtgaaaaatccacggcctccggtcgctatcagcagctttacctgttctggccgcattaccgcaaacagcttgccctgcctgatttcagtccgttgtcacaggacagactcgccattcagttgatccgcgaacgcggtgcactggatgacatccgggcgggacgcattgagcgcgccatttcacgctgtcgcaatatctgggcgtccctgccgggtgccggttacggtcagcgtgagcattcactggaaaaactggtcaccgtctggcgtaccgctggcggcgtaccggcttaaacggagtaaacaccatgaagaaattatccctttcactgatgctgaacgtgtcgctggcgctgatgctggcactgtccctgatttatccgcagagcgtggccgtcagttttgtcgccgcccgggcgattctggcgacggttatctgtgtggttgccggtggtgtcggcgtgtatgccacagagtatgtactggaacgctacgggcgggagctgccgccggaatcgctggccgtgaagattgtcacgtcgctgtttttgcagccggtgccgtggcgcagacggtcggcggctctggtagtgatggtggcgacgtttatctcgctggttgccgccgggtggatttttaccgcgctgatttacctcgtggtgtcggtgttcttccggctgatacgtacggcctgccgtcagcgttttgaggggcgggaaccatgtcaaggctgatgattgtgctggttgtgttgttatcactggcggtggctggtctgtttatggtgaaacacaaaaatgccagcctgcgcgcctcgctggacagggcgaacaacgtcgccagcgggcagcagacgaccatcaccatgctgaaaaatcagcttcatgttgccctcaccagagcagacaaaaacgagctggcgcaggtggtactgcgtcaggaactggagaacgccgcgaagcgtgaagcacagcgcgagaaaaccatcacgaggttacttaatgaaaacgaagattttcgccgctggtacggcgctgacctgcctgatgctgtgcgccggttgcaccagcgccccgcctgcactgacgccagtgattgtccacaacgcctgcccgaaagtgagtctttgcccgatgccgggcagtgacccggagacgaacggcgatttaagtgctgatatccggcagcttgagaacgcgctggcacgctgtgccagccaggtaaaaatgattaaacactgtcaggacgaaaacgatgctcaaacccgacagcctgcgcagggcgctgactgataccgtcacggtgctgaaaactaaccccgatatgctgcggatattcgtggataacgggagtattgcctccacactggcggcgtcgctgtcattcgaaaagcgttacacgctcaatgtgattgtgaccgactttaccggtgattttgacctgctcatcgtgccggtgctggcgtggctgcgggaaaatcagcccgacatcatgaccaccgacgaaggccagaaaaagggcttcacgttttatgcggacatcaacaatgacagcagctttgatatcagtatcagcctgatgctgaccgagcgcacgctggtcagtgaggtggacggcgcgctgcatgtgaagaatatcccggaacccacgccgccggagccggtcacccgcccgatggagctttatatcaatggcgaactggtgagcaagtgggatgaatgagtttaagcgttttgaagaccggctgaccggactgactgaatcgctgtcaccgtcagggcgtcggcgactgagtgccgaactggcgaaacgtctgcggcagagtcagcagcgtcgggtgatggcacagaaagccccggacggcacaccctacgcaccacgccagcagcagagcgccagaaaaaagaccggtcgtgttaagcgaaaaatgtttgcgaaacttatcaccagtcgttttttgcatatccgcgccagcccggaacaggcatcaatggaattttacggcgggaagtcgccgaaaatcgccagtgtgcatcagttcggtctgtcggaagaaacccggaaagacggtaagaaaattgattatccggcgcgtcctctgctcggctttaccggtgaggatgtgcagatgattgaagagattatcctggctcacctcgaccgttagttgtgccattcccgacacctcatcgtcacattgccgccggtatgacccggcggcatccttcccgttatgaacactctcgcaaatatccaggaactcgcgcgcgcactgcgcaacatgattcgcaccggccttgtcgtcgaaaccaaccttaaagccggtcgctgccgtgtgcagaccggcggcatgtgcaccgactggcttcagtggctgacctgtcgtgccgggcgttcgcgcacatggtgggcaccttccgtgggggaacaggtgctgattctggccgtgggcggtgaactcgacacggcgttcgttctgccggggatttattccggcgataaccctgcaccgtctgcgtcggcggatgccctgcatatccgtttccctgacggggcggtgattgagtatgaacctgaaaccagtgcgctcacggtaagcggaattaaaacggccagcgtgacggcttctgattctgttactgccacggtgccggtggtcatggtgaaagcgtcaacccgcatcaccctggacacaccggaggtggtctgcaccaacaggctgattaccggcacgctggaagtacagaagggcgggacgatgcgcggcaacattgaacacaccggcggtgaactctcatcaaacggtaaggtactgcatacccataaacaccccggcgacagcggcggcacaaccgggggacctctatgactgcgcgttatctcggaatgaatcgcagtgatggcctgactgtcactgaccttgagcatatcagccagagtatcggcgatatcctgcgcacaccggtcggctcgcgggtgatgcgtcgtgattacggctcgttgctggcgtcaatgattgaccagccgcagaccccggcgcttgagttgcagattaaggtcgcctgttacatggcggtgctgaaatgggaaccccgcgtcaccctgtcatccgtcaccactgagcgcagttttgacgggcgaatgacagttacgttaaccggccagcacaacgacaccggccagccactttcgttaaccatccctgtgagttgaaaccatgccgattatcgacctgaaccagctacccgcaccggatgtggtcgaggagctggactttgaaaccattcttgctgaacgcaaggcgacactgatttccctttacccggaagaccagcaggaggcggtcgcccgtaccctgacgctggaatccgaacctctcgtcaaactgctggaggaaaatgcttatcgtgagcttatctggcgtcagcgtgtgaatgaggccgcacgggcggtgatgctggcctgtgcagccggtaatgaccttgatgtgattggtgccaattacaacaccacgcgcctgactatcaccccggcagatgattcgaccattccgccgacaccggcagtgatggagtctgacaccgattatcgtctgcgtattcagcaggcgtttgagggcttaagcgtcgccgggtcggtgggtgcctatcagtatcatggtcgcagtgccgacgggcgtgtcgcggatatctctgtcaccagtccgtctccggcctgcgtcaccatctctgtgctgtcacgtgaaaataacggtgtcgcatccgaagacctgctggccgtggtgcgtaacgcccttaatggtgaggacgtcaggccggtggctgaccgtgtgaccgtgcagtctgccgccattgttgaataccagataaacgccacgctttacctttaccctggtcccgaaagcgaacccatccgcgcggccgccgtgaaaaagctggaagcgtacatcacggcacagcaccggctggggcgcgacatccgtctgtctgccatttatgccgctttgcatgtggaaggcgtgcagcgtgtcgagctggcggcaccactggccgacatcgtgctcaacagtacgcaggcgtctttctgtaccgaataccgcgtcgtgaccggaggctcggatgagtgattcgcgactgctgccgaccggctcatcaccgcttgaagtcgccgctgcaaaagcctgtgcggaaattgaaaaaacgccggtcagtattcgtgagctgtggaacccggacacctgcccggcaaatctgctgccgtggctggcgtgggcgttttcggtcgacagatgggatgaaaagtggccggaagcgaccaaacgcgccgttatacgcgatgcctatttcatccactgtcataaaggcactataggtgcaatccggcgtgtggtggagccgctgggctatctcatcaacgtgacggagtggtgggaaaccagtgacccgcccggcaccttccggcttgatattggtgtactggaaagcggtatcacagaggcaatgtatcaggaaatggaacggctgattgctgatgccaaacctgcaagccgtcaccttattggcctgaacattatccaggacattcccggctgtctgtatacaggcggtgtggtctgtgatggtgatgttattactgtttatcccggataagtgagaaacaatgagcacgaaatttaaaaccgttatcactactgccggagccgcaaagctggcagccgccactgtccccggcgggaaaaaagtaaacctgtctgcaatggccgtgggtgacggtaatggcaaattgccggtgccggatgccggtcagacgaaactggtgcatgaggtctggcgtcacgctctgaataaagtcagcgtggataacaagaataaaaactatatcgtggctgaactggttgtaccgccagaagtgggcggcttctggatgcgtgaacttggtctgtatgacgatgccggaacactgattgcggtatccaacatggcagaaagctataagccagaactggctgaaggctccggacgtgcgcagacctgccgcatggttattattctcagcaacgtggcgtccgttgagctgagtattgatgccagcacggtgatggcgacgcaggattacgtcgatgacaaaatcgcagagcatgagcagtcccgccgccatcctgacgccacgctgacagaaaaaggttttactcagttaagcagtgcaacaaacagcaccagtgaaaagctggcggcaacgccaaaagcggtcaaggcagcaaatgacaacgcaaattcacgtctggcgaaaaatcagaacggtgcagatatccaggataaatcagcttttctggacaatattggcgttaccagcctgacgtttatgaaacacaatggaatgattccaaccactgacaatcttgactcctatggcccagaagaaaaatatcttggaacgtggtcatgtccgtcacaatccactgcaaaaccagagtctggttaccctgaagataaaggcaatggggttctggaagtattcaatgctggtcgctttcactgcacacaacgctacaccacccgaaccggtaatatttacattcggatgcttgatgcagaatggaacccagccagtccaacatggagtgcatggagagttattacaagcgggactcgaccattaagcacgtcaattgacctgaattctttaggtggcgcggaacacctgggaatatggcgcaatagcagtacatcaatagcctcatttgaacgtcatttcccggaggacgggagctttggtcagggtattctggaagtctttgaaggcggtctgtatgggagaatgcaacgttacaccacccgtagtgggactatgtacattcgcggactgactgcctcatgggatgcagagaatccacaatgggaggactggattgctgttgggtatcagtccacgggatggacttattcaggggatcttgatgaccttttaaagcctggtatttatagcgtcacgaaacaggccacaaacgcaccagtcaccgactctaaagatcttgctgttggctcaatagttgaagtgaaaaaacgttgtgatattgaatcgtatatccagacatatacgacagtttctgcaacggatgcctataaaaaccggacatttcaacgaactcgtgccagcggtgaagctgactggggggaatgggcggaagtttacaactcaaaatcattactcactaaattaggtgtcggcggtgttaccgacaggttatccagtctggactggcagacctacgactttgtgccgggcagcatgataactgtcagactctccgatatgaccaatatccccgatgggatggaatggggcgtcattgatactaacctgataaatatcactgttggccccagtgaaggtggaggtgtcgcccgttcaatgcaggtatggcgcagcacctcaaacaaaaccaactatcgtttttttacagtccgcttatatggcaatcctggggagcgtagcttcaatattcgtcggctaccaattatcgacgaagcccagacatgggaggcaaaacagacattcagtgcaggcctctctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttggatggaactggagtagcggagcctataacgcaactactggtggggcatcaacgttaattcttcattttaatatcggtgaaggaagttgtcccgcagcccagttccgcgttaattataagaacggcggtattttttatcgttctgctcgtgatggttacggattcgaggctgactggtctgagttttataccacaacgcgaaaacctacagcgggagatgtcggtgcactgtcgttatctggtggtcaattgaatggtgcactgggcatcggaacatccagtgctcttggcggtaattcgattgttttgggtgataatgacacgggctttaaacaaaatggtgatggtaatctggatgtttatgctaatagcgtccatgttatgcgctttgtctccggaagcattcaaagtaataaaaccataaatattacggggcgtgttaatccttcggattacggtaactttgattcccgctatgtgagagatgtcagacttggcactcgtgttgttcagaccatgcagaaaggggtgatgtatgagaaagcagggcacgtaattacagggcttggtattgtcggtgaagtcgatggtgatgaccccgcagtattcagaccaatacaaaaatacatcaatggcacatggtataacgttgcacaggtgtaatttatgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgacgagaataatataattgtcggcatcaccagagatgcttcaacgcttaaccctgaaggttttagcgttgtcgaggttcctgatattaccgccaaccgacgtgctgatgactcaggtaaatggatgtttaaggatggtgctgtgattaagcggatttatacggcagacgaacagctgcaactggcggaattacagaagtcagctttgctttccgaagctgaaactatcattcagccactggaacgctctgtcagactgaatatggcaacagatgaggagcgtagccgactggaagcatgggaacgctacagtgttctggtcagccgtgtggatcctgcaaatcctgaatggccggaaatgccgcaataagttgtatgatctctggagtgagctaacgtatctatagcacagagtaaagcctaatctgacagtctgctctgtgctaggagcggactgacctgctccccgatgattaatacacagctatgctagtaatgtccgtagatcgctgtgtgttgcatccatcggttgaactcacagtccaaaccagactgtcagctttgattagattctacctactcaacctgtcagataaggtctgagctaatacatctaatatatggctttgtgcaggggacggctatcgcgaacgttaggccaggtatctgaatacgcacagttcacttggttgtacttcttgcactgatctgctatcccgcacagctatttataggtaatcttcagtgtataatctgccaacttatggaagcttgtacaacaggagaaatatatgaaaaaagaattgtttggacgttgcccgtttgatcttgacgaagatgtaaaaaaaatagccgcgataaataaatatatccatgcaaaatttgaggagcataaaaataaaatagacaacctaaagggtgtggaacaaaaattgatggtcttacagtactttaatgtactgaatgaacttagtaatcaggctatctcttctttgaatataggagccttttcagcatcggaagtattagctagggttataatagaacaggctgccaatcaattttatatagcaatagatgatggcgaaaatgcacaagcattactcaaggctagtaagaaattagttcatagtaatggaaaacggtggctggagtgtttaaaatccaaaggaatgactaatccagcagcaaatgaaaggattcgcatgggaaaagaactaactgatctatttaatagattgtggccaaatacacctgaatatccaggaaccagaaaactttttgaattaattggctgggaaacacactatcatgcccattacgttcccctttgtgattcaatacatacattctctgatgatatggtaaatatagtatctctatataatgcaatccaaagtgatgaaactactgctatcgaattcattcttgcagttaaacaagaaaataaacggctggcaatttataattttgtaattgctacggcccttcggtgtgaggccttagtaaatgtatttaactctttaggttatcaggatattataacagaaatgacaccaacaatagatacagtcaaccagactataattcgatatgatgattttgatcattccagaattgatgattgtcaataattaattgacagaatacgtacatgcgcaacaactagtgatagttgacttattttcgctcttgagagacaaccatactcaaatctcccacattgcaggagatttgaatatgaaaacatcaccgtggaataaagaccgtaccatcggtcaaaaaaggccacttcagatatctcatatctgggggatccggattagacttgagttggaaggtaaataaattgtcagtcggaaaataagtgagtacaaatcagggcaggtgagcgaattgcccgccttttctttaccggtggttgtgctgtcgattagccaaccgggacaaatagcctgacatctccggcacaactgaaaataccactcacccattaaccacggagttaaacggatgagcgactatcatcatggcgtgcaggtgctggagattaacgacggcacccgcgtcatttccaccgtatccaccgccattgtcggcatggtctgcacggccagcgatgcggatgcggaaatc

SEQ ID NO: 10008 - DNA, 40842 bp, Escherichia coli
gccgcgtcgcgctcacgctcattatgcagcgcctgatacaaactgccgccaatggtactcaacagcgcaagacctgccagcatctggatccaacttacgggcagggcagccatcatcccggtaatggcactaccaaacagacctgcgatcaaataaaaaatgccggcaacggcagcggccagccaacgttgatctttatccggatgcgcttccgggctttggcaaatagccgcggtgattgccgcaataccgacggaataaacgccgaaaggggaaaaaacaagcgccagcaatccagtaaacacaatcaacggcgaaacaggagccgaatacccggctgctttcattgctgcgatacccggtgcgttttgcgatgccatcgtcaccagaaaaagggggagtgcaacgctcagactgtgagcaaacgaaaaatcagggggaatataagtggggagaacgggtttaaagacaacatcagttgtgacaacgtcaccttgcgcgataacgatcacgatcccaataatcatcgcggcaattaccgcatagcgcggcgcaacggccctggttgccagccatgccagcaacatactgccacacaacgtaaattgaccatccagactggcaaacgcctgtaaaccaaaacgtaataaaatcccggcaagcattgccgccgcaagcgagtgcggaataatgcgcatcagacgagcaaagagtcccgttatgccgcagaggactattaacacgttggtgacaataaaaacgccgatggtttcgttaagtgttagtccctgcaatccggtgaccaacaaagccgcgccaggcgttgaccatgcggtgagaacaggtacgcgataccataatgtcagagccagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttataacgtacaggtaccgtagcatttgtccgttataacgcacaagtgataaacttccgttttgccggaggagtcgcatggaaaatctcgctcgctttttatccaccacacttaaacaactacgtcagcagcgcggctggagtctttcgcgactggcagaagcgacgggcgtttctaaagcgatgttagggcagattgagcgtaatgaatccagcccgacggtcgcgacattatggaaaattgccaccgggttgaacgtgccattttcaacatttatttccccgccgcagtccgctacaccttcagtttatgatccacaacggcaggcgatggtgatcacttcgctgtttccttatgatccacaactctgctttgaacacttctcgattcagatggcacccggtgcaataagcgaatcgacgccccatgaaaagggggtaatcgaacatgtcgtcgtcattgatggacaacttgatctgtgtgttgatggtgaatggcagagccttaattgtggggaaggcgttcgatttgctgcagacgtcacgcatgtctatcgtaatggtggagagcaaaccgtacattttcattccctcatccattacccgcgcagttaagcgggaaaactatttcgcaacgtcgcgcttgtggctaaaatagccgccatttttcagctactggataagaaagtgaccgtatcttctcatcgtcttgaactgttaagcccggcacgcgatgccgccattgcccgcgaagctattttgcacggtgccgatgctgtttatatcggcggccctggttttggtgcccgtcataatgccagtaatagcctgaaagatattgccgagttggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgatattcgtacagtagaaaaagcgaagttcctctctgatgttggcttcacgcagattgtgctggcgcgagagctgaatcttgagcagatccgcgcgattcaccaggccacggacgcgaccattgaattctttattcatggcgcattgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggcgtacgctccttcaagattgaagggcgttacaaagatatgagctacgtgaagaatatcaccgcccattatcgtcagatgctggatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtgggcgaagtattgaaagtagcgaaagatcatattgatgttgccgttaccgagccactggcaaatggcgatggcctgaacgtgatgattaaacgtgaagtcgtcggttttcgtgccaatacggtagagaaaaccggagaaaatcagtaccgcgtctggcccaatgaaatgccagcagatttgcacaaaattcgcccgcatcacccactaaaccgtaatcttgatcataactggcagcaggcactgacaaaaacctccagcgaacgtcgggtggcggtagacattgaactgggcggctggcaggaacaactgattctgaccctcaccagtgaagagggtgtcagcatcacacatacgctggacgggcagttcgacgaagccaataacgccgaaaaagcaatgaacaatctgaaggatggtctggcaaaactggggcaaaccatctattacgcccgcaatgtgcaaattaatttgccgggggcgctgtttgtaccaaacagtctgttaaaccagttccgccgtgaagccgccgatatgcttgatgctgcgcgtcttgccagttaccagcgcggcagccgtaaaccggttgctgatcctgcgccagtttatccgcaaacgcatctgagtttcctcgcgaacgtatacaaccagaaagcgcgtgaattttatcatcgctatggtgtgcaactgattgacgcggcgtatgaggcacatgaagagaagggcgaagtcccggtgatgatcaccaagcattgtctgcgctttgccttcaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgatctgctgaaaacattgccgaagcgaaaagggtaaaacgccagttttcgggttactcaccactcatcaaatctgcatgatattgcctgccgggtaaggtgtcacgccgcatccggcaacacacgactcaacgctgtcccgcttctggtttgcgcgatttttgccagtaaaaatgctcgcgcaaaccttccgccgactcttccgccacagcacgcaattcatcgctgtccgcttcatgacgcaactgatgatccacattctttacccacataaattcatgtcctttgtgccctgccatgagttgtcctgagaacagtgcacacgttaataagacaaccgataacgccttcgaaaacatcccgccacctttttctaaccttttgccgctatgatgccgatcgtttcttgaggttattattcagttttgcaaattagagcaaagaaattctggaatcttccttcctgattttgcattgcattctgccgttgcggcgatttagtgctattttcgagcacattacacacggaggtaaacttcgccattaaatagtcacgatcactttattgaagtgcctttgagcgtcgcctctaaggtattgctgttaaatgcttttttacagtcagaaatcactcagcaagagttagcccggcgaattggcaaacataaacaggagattactcgcctatttaatttgcaccatgcgacaaaaatcgacgccgtccagctcgcggctaatgcgcttggcaaagagttatcgctggtgatggtttgattacagttaatgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttctggcatgagctttatgactgtcagccatgcctatcagttgctcgaaagtcagggatatattatcgcgcgaccgcaatcgggttattacgttgcgccacaggcaataaaaatgccgaaagcgacagtcattccagtcacacgagatgaagcagtcgatatcaacacctatatttttgatatgttgcaggccagtcgcgatccgtcggtagttccgtttgcctcggcctttcccgacccgcgacttttccccctccaacaactaaaccgctcgctggcgcaggtaagcaaaaccgccacggcgatgagcgtgattgaaaacttaccgccaggaaacgtagaactgcgtcaggctattgctcgtcgctatgccttacagggcatcaccatttcacctgatgaaattgtcattaccgccggggcgttagaggcattaaacctcagtttgcaagcggtaactgaaccgggcgattgggtgatagtagagaatccttgtttctacggcgcgttgcaggcgctggagcggttacggctgaaggcgttatcggtagcgacggatattaaagaagggatcgatcttcaggcgctggaactggcgttgcaggagtatccggtgaaagcgtgctggctgatgactaatagccagaacccacttggatttaccttaacgccgcagaaaaaagtgcggctggtagcgttgctcaatcagtacaacgtaacgctgattgaagatgacgtttatagcgaactttattttggacgggaaaaaccgctgcctgcgaaagcgtgggatcgccacgatggtgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcagcttgcgctggtggattacctttctactcgccgatacgatgctcatcttcgtcgcctgcgtcgccagcttgcggaacgtaaacaacgcgcctggcaggctttgctgcgttatctgcctgcggaagtcaaaattcatcacaatgacagcggttattttctctggctggagctccccgagccgttagatgcaggagaattaagcctggtggcactgacgcatcatatcagtattgcgccgggtaatatgttttctaccggtgaaaactggtcacgtttttttcgttttaataccgcgtggcagtggggagaacgtgaagaacaggcggtaaaacaattaggcaaacttattcaagaacggctgtaatagcgtttaatttaattcctctcaggttgggtaatatgaatttcgaatagcagtcatatatcctaactccttgtctatactccagaagataaccttacagacggcataatgcgcggtagctcacaacctgattaaattttctcagggccgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagagaatccggaagggcgactggatattatcgcctggccgggatacatcgaacgcggacaaactgataaacagtacgactgggtaacgcaattcgaaaaagagacaggctgcgcggtgaatgttaaaaccgccgcgacttccgatgaaatggtcagtctgatggtcaaagggggttacgatctggttacggcatccggcgatgcctcgctgcgtttgattatgggcaaacgcgtgcagccaattaataccgccttgattcccaactggaaagcgctcgatccgcgcgtggttaaaggcgactggtttaacgttggcggcaaagtttacggcacaccttaccaatgggggccgaacctgctgatgtacatcactaaaaccttcccgacgccgccggatagctggcaagtggtttttgttgagcagaatctgccggacggcaagagcaataaaggccgggtacaggcttatgatggccctatctacattgcggatgccgcgttgttcgtcaaagccacgcagccacagttgggcatcagcgatccgtatcaactcaccgaagaacagtatcaggcggtgctgaaagtgctgcgcgatcaacatagtttgatccatcgctactggcatgacactaccgtgcaaatgagcgatttcaaaaacgagggtgtggttgcttccagtgcatggccctatcaggccaacgccctgaaagccgaaggccagcctgtcgctaccgttttcccgaaggagggcgttaccggttgggctgacaccaccatgctacatagcgaagcgaaacatccggtttgcgcctacaaatggatgaactggtcattaaccccaaaagtgcagggcgatgtggcggcctggtttggctcgttaccagtagtgccgcaagggtgtaaagccagtccgttattaggcgagaaaggttgtgaaacaaacggttttaactatttcgataaaatcgccttctggaaaacgcctatagcagaagggggcaagtttgttccctacagtcgctggacgcaggattacattgccattatgggcggtcgctaacttcgctggggtgttttatgacgtacgcagtggagtttgacaacgtctcacggttgtacggtgacgtgcgcgcagtaaatggcgtcagtattgcgataaaagatggtgagttcttctctatgctggggccgtccggctccggcaaaaccacttgcctgcgcctgattgctggattcgaacagctttccggcggggctatctctatttttggtacgcccgccagcaatctgccaccgtgggagcgggacgtgaatactgtcttccaggactacgcgctatttccgcatatgtcgattcttgacaacgtagcctacgggctgatggtcaaaggcgtgaataaaaagcagcggcacgcaatggcgcaagaggcgcttgagaaagtggcgttggggtttgtacagcaacgtaaaccgtcacaactttctggtggtcagcgccagcgagtcgccatcgccagagcactggtgaacgaaccgcgtgtgttgttgctggatgaaccgctcggcgcgctggatctcaaattgcgcgagcaaatgcagcttgagctgaaaaagctgcaacagtctctcggtatcacttttatcttcgttacccacgatcagggcgaagcgttatcgatgtccgatcgggtggcggttttcaataatggacgcattgaacaggtcgattctccgcgcgatctctatatgcgcccgcgcacgccgtttgttgcgggattcgttgggacatcgaatgtttttgatggactgatggcagagaaactttgtggcatgacgggaagcttcgcactacgaccggaacatatccgcctcaacacccctggagaaatgcaggctaatggcacgatccaggcggtgcagtatcagggcgcggcaactcgttttgaactgacactgagcggcggtgaaaaactgctggtgagtcaggccaatatgacaggcgaagaactgcctgccacgctcacgcccggacaacaggtgatggtttcctggtcgcgtgatgtgatggtggcgctggttgaggagaggtgaatggcgatgaacgtattgcaatcaccttcacgtccaggtctgggtaaggtgcccggtttcttctggcgtaatccggggctggggctgtttttgctgctgcttggcccgctaatgtggtttggcattgtctatttcggctcgctgctgacgctgttatggcagggcttttatacctttgacgatttcaccatgtcggtaacgccggaactgacgctggcgaatatccgtgcgctgtttaatccggcgaattacgacatcattgtccgcacgctgaccatggctgtggcggtgactatcgccagcgccattctggcttttccaatggcgtggtatatggcgcgctataccagcggaaaaatgaaagcgtttttttatattgcggtaatgttgccgatgtgggcgagctacattgttaaagcctatgcctggacgttattgctggcaaaagatggcgtggcgcagtggtttttacaacatctggggctggaaccactgctgactgcgttcctcacgctaccggcggtgggcggcaatacgctgtcaacttccgggctggggcgctttctggtgtttctctatatctggttgccgttcatgatcctcccggtgcaggcggcgcttgagcgtttgccgccgtcattgttgcaggcgtcggctgatcttggcgcacgtccacgacaaacctttcgctatgtggtgctgccgctggcaatcccgggtattgccgctggctctatctttaccttctcactcacgctgggcgattttattgtcccgcagctggttggccctccaggatattttatcggcaatatggtttattcccagcagggggcgattggcaatatgccgatggcggcggcattcaccctggtgccgattgttctcatcgcactctatctggcgtttgtgaaacgtctgggagcgttcgatgcactctgaacgcgcaccgtttttcctcaaactggcggcctggggcggcgtggttttcctacattttcccatcctgattatcgctgcctatgcgtttaacactgaagatgcggcgtttagttttccaccgcaaggcctgacgctgcgctggtttagcgtggcagcacagcgtagtgatatccttgattccgtgacactgtcacttaaagtggcggcgctggcgacattaatcgcgctggtgttagggacgctggcagctgccgcgctgtggcgacgagactttttcggcaaaaacgccatttcgctgttactgttgctgcccattgcgctgccgggcattgtcactggtctggcgctattaaccgcctttaaaaccatcaatctggagccaggatttttcaccatcgtggtcggtcatgcgactttttgcgtagtggtggtgtttaacaatgtcatcgcccgttttcgccgcacctcgtggagtctggttgaggcgtcaatggatcttggggccaatggctggcaaaccttccgctacgtagtgttgccgaatctcagttcggcgttactggctggaggaatgctggcgtttgccttgtcgttcgatgaaatcatcgtgacgacttttacggcaggtcatgaacgaacgttaccgttgtggttgctcaatcagcttgggcgaccgcgtgatgtcccggtaaccaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggagattgccgaggcatccgcagagcaggtcaatgctgctgttcgcgcggcagatgcagcatttgccgaatgggggcaaaccacgccaaaagcgcgtgcggaatgcctgctgaaactggctgatgttatcgaagaaaatggtcaggtttttgccgaactggagtcccgtaattgtggcaaaccgctgcatagcgcgttcaatgatgaaattccggcgattgtcgatgtctttcgctttttcgccggtgcggcgcgctgcctgaatggtctggcggcaggtgaatatcttgaaggtcatacttcgatgatccgtcgcgatccgttgggggtcgtggcttctatcgcaccgtggaattatccgctgatgatggctgcgtggaaactggctccggcgctggcggcagggaactgcgtagtgcttaaaccatcagaaattaccccgctgaccgcgttgaagttggcagagctggcgaaagatatcttcccggctggcgtgattaacgtgctgtttggcagaggcaagacggtgggagatccgctgaccggacatcccaaagtgcggatggtgtcgctgacgggttctatcgccactggggaacacatcatcagccataccgcgccgtccattaagcgtactcatatggaacttggtggcaaagcgccagtgattgtttttgatgatgcggatattgaagcagtggtcgaaggtgtacgtacttttggctattacaatgccggacaggattgtactgcggcttgtcggatctacgcgcaaaaaggcatttacgatacgctggtggaaaaactcggtgctgcggtggcaacgttaaaatcgggttcgccggatgacgagtctacggagcttggacctttaagctcgctggcgcatctcgaacgcgtcagcaaggcggtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccggtagtgagtgttacgctcttcgacaacgaagaacaggtggtgaactgggcgaatgacagtcagtacggacttgcatcttcggtatggacgaaagatgtgggcagggcgcatcgcgtcagcgcgcggctgcaatatggttgtacctgggtcaatacccatttcatgctggtaagtgaaatgccgcacggtgggcagaaactttctggttacggcaaggatatgtcactttatgggctggaggattacactgtcgtccgccacgtcatggttaaacattaaggataatattgcagatcgtaagagtatgagatgatcttgcgtactgtcagagcactgatttctctgacagtacgtgctgcgtgcaaaatcactacatcaaataaaccagccaaatctcatagagataagagtaaacaaaccaacagcagcaaagacatttatcagtactacagttctactggaaacattcatttttgccaccttttatcattgcccctatgtgtatagtacgggttaagaaaatccgcaataatactcattctgaagatagataagggcaagttgctgtttgatgattttttctctaactggtgaaaaaacttgatgcacgtcaaaaaatgacgcatatttgcgcgcgttttattcatctggctggacgcccgtacatgtctctctatcaacatatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttctctgttttaaatcttatgcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcagcgtttgcgcaccgctattgctcatcacggtcgcaaacataaagaagatatggaagcgcgccacgaacagttaaccaaaggcggtaccatcctctgattaaaatgagcgtctggccaccagccaggcgccaaccacaagtaaaattgcgccacaaattgggccgatcaacgcccgaagtggtacgccatggctgcggaagatatccagcaccagaccgccaatcagctggctggcgaccagtactgcaatagttgtcgccgctcccacattctgatatccgctgatactggcgaagacaaaaaacgatcccagcaagccaggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggactaccagaccaatcccggctgcaatcaaaaaggcaagggtaagtgactgattcatccgatcgcgtccggttcagtgcgctcgtcgagttgcaactgcataaatgtcagatccagccagcgcccaaatttagtacctacctgcggcatttgcgcggtgacgacaaatcccagcgactggtgcagatgcagcgaggcctgattttgcgattcgatcccggcgaccatgacatgcttcccgcaatcccgcgcttcatcaatcaatcggcttaacaatttacgccccagacctttcccctgatgatcgggatggacataaaccgaatgttccacggtatggcgaaaaccatcaaaactacgccagtcgccaaacgaggcatatcccgtcactacgccatcttcttcactcaccagcaccggataacctgctatggtccgcgcttcaaaccaggcaatgcggttatccgcatccaccgtttggtcattccagatagccgccgtatacaacacggcgtgattataaatttccgcaattgcagcacagtcggctttgcgggcaaaacggatggacatgtctggcctcgataaaataatgatgatgatgttatcaatactatcgaaaacagcccgaagcaacggattcctctatgaaattattgcgtgttgcagaggggatgtgacggctgcaaacaaaaccaatcctgtgagcctgctactattgatggattcatgccaaaagcacaggagagcattatggggcaacaaacgcagcgtaaccgatgttgggttctgtccttgcgtccgcatggcgcgccggttccttacgtctggtttcggtaaatgtgctctttgtcgcaccagcgcaagcatttacagttccggaagtgggaaaacgtcaattaaatgaaatcaatcggatccgctacgaactggaattaatggcagttgctctggctgtcgaaaacctcactatgcaaaaaaacgttgctatgttgtgccagcaatacagccgataaataaaatacgcccggcaaataccgggcttaaagataattactcaaatcgccacgcaatatttatgccgacaccataatttcgtccgggcgcaggttcgtaatatcgcccgtttgactcattgacaatgacagaaccaacgtattctttatcgaataaattatcgacacgaccaaataaatccacggttaaattgtggtaattgtatttatacccggtgaataagccgacgagtgtataagaaggcgctttggccgtattttcatcatctgccataatatcgcccatataacgagcttccgtgcctgcataccaaccatcttccggtatataacctatcgacgcaaaggccatattacgggcgatccctggcatccggttaccgttacaatcctgttcattgcaaacattgctgcgataggtcgcatcaagccaggtccaggacgcttttacgcgaaaatctcccgcgaaacgttgatcccatgccagttcagccccttgacgacgggtctttccggcatttttgtaagtcgtacgcccaccgctactgctatcgacaacaatttcatcatcggtgtcggtctggaacaatgcgagactaagcagtccatcaccaatacgcgttttactgccgatctcaattgtatcgttggtggagggttttaacccaaagttcataccgctttgtccatcagcgcgataagacagttcattaatcgtcggcgtttcaaaaccgcgccctgctgccagatagacattccaggcatcggtcattgcatattttaacgatccggctggtagccatttgtgataactggcatcaccgctgtcgtcgccgttacccggagtaacgtaatgatcattggaatcaaaccacacggagctgtagcgcacgccagcatccagcgaaagtttgtcggtcagttgccactgggtttgtaaatagggatcgacgttccacatcaaattgcgttcgtcgcggcgcaactcacctttttgcccgtattccggcacgccgcgattcaggcggaagttattgtaacccttgcggttttcactcatgttttcgtagttcaggccggttgtgaacgtgactggaacgcccaattcaccacggtgtgtccagcggctgtctatcccctggtaatggcgttgcagggtaatcacgccgcccgcatgtgacgggttaagttgcggggccatggggattgactggtactgggtcgtttctcgctctccggcatacatcattacactcatatcatcttgcgcgctcaggctacgttcatagcgcaacccagcctgagtttgcttgatggtttttcgcgtgtcgtactgttctgcacgaggcgcttgttgtggattcgccttccattctgcttcggttagcccacctgggtcatctgctttgatatccacactattgaaaatcaggcttaatttgctggcgtcatcaatgcgtacgcccagtttggcattggctaaatttttctgtgcgccgctatggtcacgatagccatgggtcgtaaaacgtgtggttgagacggtgtaatcgacatcgccgggttgtgtgccgtcgcccgttgcgcccgtagctttcagcccatagcgccagctgccaaaactgccgtagtaactactggcttcaatggttggtggctgttgtccggtctgggtggtgacattcattacaccgccagacgcgttgccatacagagcagagaaggggccacgcagcacttccacattttgcacactgcttaaatcgatgttagatgtttgcccttgtccgtcgggcatggtagcgggaataccgtccacatacaggcgaataccgcgaattccgtaagtggagcgggagccaaatccgcgaatcgacagctgtaaatcttgcgcatagttctgccggttttgtacctgtaaaccaggcactccggtcagtgattcagacaagttaatgcgcggtgttgccaggcgcatctcctcgccatccaccacgctcacggctgctggggtatccagttctgaaaccacctgcggtgcggcactgacaatcatggtctgttcatcagcggcaaaaacaacgggggaaaggacaagcagtgcgggcaaaacggtctgtcggacggaaaaaatcttcatgaaaaaagccaggttaagaatgggaaaacaccgtcatggtaatgaaattgtaaatttatggaaaactaaacggcacaatacgttaagtaattgagaaaattgtagtcgtaacggtaagaaatgctccacatttgagaaaataatgattaccattcccatttataacaagggcgtaacgatgattacgcttagcgaagcattgtgaagcagaaaaaatatcggttcatcaaagggagtcgtcatgcatttacgtcatctgttttcatcgcgcctgcgtggttcattactgttaggttcattgcttgttgcttcatcattcagtacgcaggccgcagaagaaatgctgcgtaaagcggtaggtaaaggtgcctacgaaatggcttatagccagcaagaaaacgcgctgtggcttgccacttcgcaaagccgcaaactggataaaggcggcgtggtttatcgtcttgatccggttactctggaagtgacgcaggcgatccataacgatctcaagccgtttggtgccaccatcaataacacgactcagacgttgtggtttggtaacaccgtaaatagtgcggtcacggcgatagatgccaaaacgggcgaagtgaaaggtcgtctggtgctggatgatcgtaagcgcacggaagaggtacgcccgttgcaaccacgtgagctggtagctgatgatgccacgaacaccgtttacatcagtggtattggtaaagagagcgtgatttgggtcgttgatggcgagaatatcaaactgaaaaccgccatccagaacaccggtaaaatgagtaccggtctggcgctggatagcaaaggcaaacgtctttacaccactaacgctgacggcgaattgattaccatcgacaccgccgacaataaaatcctcagccgtaaaaagctgctggatgacggcaaagagcacttctttattaacatcagccttgataccgccaatgagcgtgcatttatcaccgattctaaagcggcagaagtgttagtggtcgatacccgtaatggcaatattctggcgaaggttgcggcaccggaatcactggctgtgctgtttaacccagcgcgtaatgaagcctacgtgacgcatcgtcaggcaggtaaagtcagtgtgattgacgcgaaaagctataaagtggtgaaaacgttcgatacgccgactcatccgaacagcctggcgctgtctgccgatggcaaaacgctgtatgtcagtgtgaaacaaaaatccactaaacagcaggaagctacccagccggacgatgtgattcgtattgcgctgtaatagatatggcgagggtgaaaacggaaagaattgcctgacttttatcacgccgcatccggcaccttcgtcagtagtctgaatttgcccggcacgtagccgggcaattttgcaattaactcgatgtttcaggcttaaacacaatttcctgtttttcttcatcttcctcgacgactggcgcagtgctgtgaatttcagcaacgcgtttgcgcacaccaaaccaacctataaccagcagaataccgataatcggcagcgccgcgatggtataagtcccgttcgggtaatcgaacgccatcagcaccaggacactcagtaaaaacagtaatgtcagccaggaagtgaagggcgcgccaggcagtttaaaactgacatccgctgctttgccttctttaatcgctttacgcaggcgcatctggcaaacgatgataaacgcccatgaagcgatgattcccagcgacgcgaagttcaacacaatctcaaatacgcgtgacggcaccagatagttgaggaatacgccgacgacatacacaaccagtgtcgccagaatcccggcatacggcacatgctgacgactcattttcgccataaaactcggtgcggaaccgcccatcgccatcgagcgcagaatacgcccggtgcagtacagacctgaattcaggctggagagggcagcggtcagcaccacaatgttcataatgctgccgatgtacggcacacccagtttagagaaaaacgtcacgaacggactttgccccgcctgatacgcgctccacggcaataacataaccagcaacaccacggagccgacgtaaaacagaccaatacgccaaatcacactgttaatcgctttaggcaccatggtctgcggatctttacattctccggccgctgtacccaccatttcaatggaggcaaaagcaaacactacgccctgaatcaacaccagcgcaggcagcaaaccgtgggggaagaagccgccattatcggtgattaaatgaaagccagtggtgttgccatccagcggctgaccactaccgaggaacactgtacccacgaccaaaaaggttacaatggcgagcactttaataagcgcaaaccagaactccatctccgcaaaccatttcacaccgatcatattcatggtgccaacgatggtcagtgcagcgagcgcaaagacccactgcggcacgccgccaaacgcgccccagtaatgcatatacagagcgacggcggtaatatcaacaatccccgtcatcgcccagttgatgaagtacatccagccagcaacataagcggccttctcacccaaaaactcacgggcataagagacaaaactgccactggaagggcggtgtaacaccagctcacccaatgcacgcagaataaaaaacgaaaacaggccgcagatcaaatagaccagtgccagtgcgggccccgccatttgcagtcgcgctcccgcgcctaaaaacaaacccgtaccaatcgcgccgccaatggcgatcatctgtacctggcgattgcccatcgctttgtgatacccctcttcgtgggcattaagccagcggcgtttcgcggcgtgttgatctgaagtgtcggtgttgtgtttactcattgctctccctgattgctttaatgaaaaagtcatataagttgccatgaacaatgtttattcatcctggcgatgatagttatcaccattattctttatgggtataaaactatcggcgcagcatcctacccgttatcgataaacgatgcaaaacatccccttacaatcctgaaggggatttatacaactgacgaaaaaatgataaatccttttgctggataacctgtgtgctgtcctacacttaatctttaaaagattgtgaggggcatatgattaaggtgtatggcgtacccggctggggctctacaatcagtgagctgatgctaacactggctgatattccttatcagttcgttgatgtcagtggttttgaccacgagggaacttcacgcgatttattaaaaaccctgaatccgttgtgtcaggttccgacactggcgctgtaaaaataacgagattatgacggagacagcggcgattgcattgatggttctcgatcgtcgcccggaccttgcgccacctcttgggcgcgccgaacgtcaacagtttcaacggctattggtctggctggttgctaatgtctatccaacgttcactttcgccgattaccctaagcgttgggcatctgacgcacctgtaattgaatatcgcaaatcgctttatatctggctgaattcgcaattgactgctgaaccgtatgtgtttggagagcaactaacgctggtggactgttatctctgcaccatgcgcacatggggaccgggacacgaatggtttcaggataatgccccgaatattaatgcgattgctgatgctgtatgtcagataccgaaattacaagaagtattaaaaaggaatgtcattatttaacaataatgccggaggttaatgttaatgaatcactggcgtagttaactggacgtccatttgtttgctatgaatagcaattaatgttggcacaactattcatatggttgatgtgatttcggtttttatattaaatatcaatttaatataatctgaaaataaaacatcttttcgcatgtagagaaacatgtcgatatgatagcgcagtgcagatcatgttatcagggctgggcggtagcgtatttaatcagggaaagattacgtaacactgcttttttgtactggacgattctcattttatgtttaaaaattgagatactccttatttcctgaaactgtttttcattgcttatacatgatcaaatactccttacataattaaggagaacaaaatgaaacttaatacacgccaacaatttgtattacttaaatagaccagtgaaggtacgtatcagaatatccggtgaagtgattaatatttcgttgaatatttctccggatttttgaaacctgctgctgtagaaattctgaacaggaggaattatgcctttagcagccaaacttaccgacaaaggcacccagcacgacggttattacgagaccgtcatcaccgccgggtcatccaccgtttttatcgatggtctccccgcagcccgtcagggagatccgctgacgccgcatgctaaaccgaagcatccacctcatccccgaaaaatcgccagaggctcgtcaaccgtctttattgacggcctgcccgccgccagaaccggtgatgctattgactgcggcggcgtggttattggtggcggcacggtaaatataggctgatatgtctgagaggtatttatgtccttaaaaggtcttcgctttacgctggaggttgacggccaggagccggacacctttgcagtggtgagcttccggttaatccagaaccagtcttatccgtttgtgatgagtgtggatgtcgccagcgattcttttatgcagacggcggagatgctgctggagaagaacgcaacgctgactatctggcagggtgtcatcccgctgcgttatgtcacaggcgtggtggcagggtttggtatgcaggagaacaacggctggcagatgcgttatcacctgcgtattgagccgccgttatggcggtgcgggctgcggcggaacttccgtatcttccagcagcaggatatccggacgatatcggccacattactgaacgagaacggcgtcacggagtggacgccgctgttttatgaggaccatccggcgcgggaattctgtgtccagtacggggaaagcgacctggcgtttctggcgcggctgtgggcggaggaggggattttcttctttgagcggtttgcggcggacagtccggagcagaagctgacgctgtgcgacgatgtggcggggctgtcacaggcgggggagcttccgtttaacccggacacatcggcaggagcggagacggagtgtgtcagtatgttccgttatgaggcgcatgtccgcccgtcatcggtgcagagccaggattacacgtttaaggtgccggactggccggggatgtatgagcagcagggtgagagcctgaacggacagcttgaacagtatgaaatatttgattatccgggaaggtacaaggatgaacagcacggcaaggatttcacgctgtaccggatggagagcctgcgcagtgatgcggaaaaggccacagggcagagtaattcgccgaagctgtggccggggacgtggtttacgctgacggggcatccgcagaagatgctgaaccgtgaatggcaggtggtacagagcattctgtcaggagaccagccgcaggcgcttcacggcagccaggggagaggaaccacgctgggaaatcagttagaggtgataccggcggaccggacgtggcgtccacggctgcaaagcaaaccgaaggtggacgggccacagagcgccattgtcaccgggcctgcgggagaggaaatcttctgtgatgaacatggccgggtacgggtgaagtttcactgggaccgttatcacgggatgacggaggagagttcgtgctgggtgcgtgtgtcgcaggcgtgggcggggccgggatttggtaatctggcgataccgcgggtgggccaggaggtgattgttgattttctgaacggggacccggaccagccgctggtcatgggccggacgtaccatgaggacaaccgttcgccgggggacctgccgggaacgaagacgcagatgacgatacggtcgaagacctataaaggaagcggttttaatgagttgcgctttgaggatgcgacggataaggaacaggtctatatccacgcgcagaagaacatggacacggaggtacttaacgaccggacgacggatgtgaaacatgaccatacggagaccatcgggaacgaccagaagataacggtggtgaaggggcagacggttcaggtcgggaccagaaaagaagggggccacgaccagagtatcacggtggcgaacgaccggtgcatcacggtacgtaatgaccagacgctgcaggtgacgaatgaccggacggtgagcgtgagtaatgatgacggcctgtacgtcagaaatgaccgtaaagtgacggtggaagggaagcaggagcataagacgacggggaaccatgtcagcctggtggagggaaagcacagcctggtggtgaagggggacctggcgaggaaggtgagtggcgcgctggggataaaggtcgacggggatatcgtgctggagagcagcagccggataagcctgaaggtgggtggctcgtttgtggtcatccattcagggggcgtggacatcgtcgggccgaaaatcagtctcaatagcggcggtagtccggggacgccggtgccggcgctgcaaccgacggtgctgaagacactgggggatgagaagagtggtgatggcagtgattccggagaagaaaatgaagactctggagggaactgcgtgaccggaagtggtggtgatgatcgaggtgacgatgaggatgaacctgaaaaatatactctccagttccattttacagacgatgacgggataccgtattcagaaacccgctacattgccttctttgaggatggcacgcagacccacggagaaacggatgaagaggggtatacagagcgtttttttgtatctagcaaacatgaaattaaagtgaagttgctatttgcgaatgatgattttctctcaatggaaggacactatggacgataataatcaaacttctggacaaccaaagccagagccagaagaatgtgtgaaagagcaaaaaataacagatcattttaaaataatgattgataaggctcgtaaggcacaaaagttggttttgataaaaagagcagatgatcttttgagatggggagcacaggaggaatatgatttcagtaagatctttggtgttaaaggaaataaggaggttaatataagaaaatatggacataatacaggtaggcgcatgaatgctagatttcttatgatggatggtgtgagaagattaatgattatagctaatgatttaacaatgagcagttttataaattatacaggttgtaatgaatttgcagcattcgtcagcccaagtaaggatatgccctatataattaacataggcgcaaaatttgagtatagagatggcaaaaaaaatccagtaacgggaaaggattctcatgttgctactttatgtcatgaaatgtctcatattcagtggtattatggggataataaaaaaggtggtatgtggtcacaggattatacaactactgataaatattcaacgtgcaaagaggatgaagtttcatatgacgaacatatccgtattgcaactaaactgatctctaaacaaaaagatcaaatatttgagaatgcatataacatagaaagatattttgaaataagattaattgaaagtgagatagactcgattgatgatgaaatattaagcaattcagttaagaaaaaatagcggaattagaaaaagcacttctccattaactaataagtcgagaaatatattaatgctgcaagctataaaaaaaatcataataatgacaatcgtaaatattatatttttctattcctttcaatcgactgcggatgaaatggttttaataaaaaaatacgggtttgggcttgagagagatatcaaaggaaggccattaatttatcctatcgaaaattatgatgagtgtaagaaaaaatgcaatcatatgaattatatagcggatgtcaatgctcaattagctatgagtaaaaaaaataacaggatttttgctaacataacctttactaacaatagctctaccacgtattttttttctaaatattatctacctatgaaagtaaaagatggaaaaggagatgaatatgatgcgatatgcaaaaaaccattcagaatcaactctgggaatatcacgttggactacttaggtggttcatgtccttttgaaattaatacgaatcctgaacggtggaatactattaaaccaggtcgtagttttttgttgagtataaccttaaatgatatgtatgcctttataccaggagataattattattttataaaatcatctggctataaatttgttaatgacaagtggtttacactcaaatcaatcaataatatttttctttattttttaaatttaaaaattaattgtgctgatgatttttttgatattaataattttactacatgtaataatttgttattggatgaaaaaaacacttttttattaatcagttatgggcaattgaggatgaaaaaaattctatttacgtcacccctgatgaaatttctataagtatagacggcgataacttaaagttgccatattaggaatatgggaaagaacacggtgcgccgcttttttgcactaaataatttacattttatgttcaataattgatactaacatgttggatattaaaggtgaaattatcacaactgatgcgatgggttgccagaaagatattgcagagaagatacaaaaacagggaggtaattatttatttgctgtaaaaggacataaggagcggattaataaagcctttgagtgaaacttccgctgaaaattcaggttaaccgcgttccatgcaaacaattttcaaatattcatcaataaataaggagttccatgtttatacgaccagtcaaaccttcagatgttgaaccattaatggatatgctgcttgacagggatcaatttgatcaagatggccttcatcatgtacaaaaaacactaacacattatttctcaggtcaatctgccgatttatggtttagtgcagaacacttgggactggcagggattgcctactgtgcttctgaaatgatgacaaatgatgtctgaaatttattaatgctctggatcagtccttcccatcagcgccagggagtgagacatctgctgattaacgaaatagaaaagagctcacaattaaacaggcaagactactattagtagagaccgccagccatatcgattttagtgccgcccgcgcattttatacaaaacagggctttatcaatgaggcgataatacgcaattactatgatgttggtgaggataaattaatcttcactaaaaatatgcaatcgtgagataaaatatgctttaactcatatggaaacattgcttaaacaacttggttgctgcatatgattctttagcccgccgtaactcgcttaccactggtaacaaacgtgccagcacctaaatgatgcaacgtattgagcttatcatcatcaaactgccagcggccttcgacaaatacccgtgcgtctgccgctgctgataccacttcgccaaatagcgtatcgtatttttcttgcgcggaagttgcaggtagcaggcgacactccatccacgccagacatttttcctcgaccagcggcaaaccaagcaccgggcctctcactaccggaatgccgtagcaattaaatttatcttcttcacgacccgacacacttcccaccgcccacgtccagttagtcgccgcaacgcccgggataacgatgccaaacttaccgttacgttcaatcaactccctggtccatgtcgatttatctaccacaatcgccacgcgtggcggttcaaactctacgggcatcgaccaggctgctgccataatgttacgccgctgggattgctcatcgaaactggtgatcatgacagttgggccatgatttaacagacggctggcatggtgtaattcgacgggaatgaattggctcacgatatcgcctcgctatgaagggtgttttaaaagcgtagctcgtaacgcaataagtaacgaaattaacgggattggcgatttgcgaacgtgatgcatgtccgcgatcgcacaaaatagccagtgcggcgtctattccaggttataagttgagaaaaccactaagggaaacgcctgatgacgcccattctgaatcattattttgcccgtattaactggttgggagctgctgcggccaatattgatacgctgcgtgcattgcacctgaaacacaattgcaccattccgtttgaaaatctcgacgttttgctgccgagggaaatacagcttgatgatcaatcgctggaagataaactggtgatagcccgtcgtggcggttactgttttgagcagaatggcgtgtttgagcgggtgttacgcgagctggggtttaacgttcgcagcttgttaggtcgcgtagtgttatcaaatccgccagcattaccgccgcgcacccatcgtttgctgttggtggaactggaaggggaaaaatggattgctgatgtcggtttcggtgggcagacgctaaccgcgccgattcgtttaatgccggatatcatgcaaaccacgccacacggagagtatcggttgttgcaagagggtgatgattgggtattgcagtttaatcatcatcagcactggcagtcgatgtaccgttttgatctctgcgagcagcaacaaagcgattatgtgatgggcaatttctggtcggcgcactggccgcagtcgcattttcgccatcatttgctgatgtgtcgccatttgccggacggtggcaagctaacgctgaccaattttcattttacccattatgaaaatgggcacgcagttgagcagcgaaatctaccagatgtggcgtcgttatatgccgtgatgcaggaacagtttggtctgggcgtagatgatgcgaaacatggctttactgtggatgagttagcgctggtgatggcggcgtttgatacgcacccggaggcgggaaaataatttatgtcaggttgccggatgtggcgtaaacgccttatccggcctacattagcccggttgtagacctgataagcgaagcgcatcaggcaacggtttcagagttcaattgcccattcggcatgaaacaaaatcaccgccgcgccagaaatggtgactttctccggttggttatctcgaattgtcaccgtcacatcaattacaccatcacgccccaatgcgcgcccctgatggcctttaacacgcaacacgttgccatcgtgggataatacgttgtgatgtactaaccatgcgcccatcggaccattggcattcccggtcaccggatcttccacaataccaatcgcaggcgagaacatgcgaccgtcggtttcgcttttgcctgggcggatctggaacgggaagaaaccattgcagccaatctgcttgctgattgcggtcagcgcagcaaggtcaggcgaaagggcgtcgatatccacttccggcttcagtggaatcatcacttttgagtgtccggtggtagccacctggattggcaagccttgcaaaatatcgtcttcagtgagatgaagcgcgttgataattgccgctcgtgtttcacctgtcagtggtggctcaaagcctggagtaccttgttccagcgaaatacgataatcatcattttgcttttcgatagtcacacgatgttttcctgccagcgatgtttgccagaccgtgcaatttcctaaacctaacacctttgcacgtacatagtgcgcagctactgtcgcgtgaccacaaatcggaacttcaaccgttggcgtaaagtagcggatgcgcacatcgctgtcgtcgctgtgcagcagaaaagcagtttccgaatgacctaactcgcgggcgataagctgcatttgcgcttcactgagattatcggcggggaaaacaacaccggcagaattgccgcgaaatggttgagaggtaaaagcatcgacgtggtaaacctgcggtttcattaatgttctcctgtggctggagaactatcatagcctgcaagtggccggagagcgaagggctatccggcccgcgtgagaattaacgccgcgaacgcacaatctgataccgacgagtaaagtactcaaacggcgcgctccagacatgcaccagtcgggtgaacgggaagagcaggaagatggtcattccaagcaccagatgaacgcggaatataaaggcgacaccatcaagatgcgtagatgcaccgccctggaaagtgacgatgctttgcgcccagcccaccaacttcatcatttcactgccgtccggatgttgtgctgaaaaaggaatggtggttaacccaagaatgcactgaattaacaaaatggcgaggatcaggatatccgcaccagaagacgtcgccctgatacgcggatttgttaaacgacgcaccagtagccccgcaccgccaatcagcgtcaataccccgcatattccgccgaggatcatcgccatctgctgttttaccgccaccggcagaaaccacgcgtacatccagtgtggcgttaacatgccgaacaggtgcccgaagaaaatccccaaaatgccgatatggaacaagttcgaccacagcaccatcccgcgtttatccagcatctggctggaggcggcgcgccaggtgtactgcccgtggtcgtagcgcagccagcttccaaggataaaaaccgtgccgcacaagtacgggtagatatcgtaaaaaaagacgttcagatactgaatcatttcccacctcccgcactgatgtcgacatactgcggcgcgacatcctggctaaagcgtcgctgatattgattaagcggcgagctgtcacacgccgtggcgttatcttcaataaacttcacctgttcttcttcccacaccgcatccagcgcctggtgggtgtcgtcacgctcttcactgcgaatctgttttatgacactgtcacttgacagagggcttcctgccagttgcaacagggcgtcaaataacgcgtaccacggtgcctcgcgttgttttaagcgtccgccaagcagggcgaggatcggcgcaacgttgagtaatccttctttcgcctgatcgtccggaagtacgcttaaatactccagatacagcggtagataatcgggcagttccctacaattcagttgcagaccgaccttttcatactccgccagcaggtccaccattgcctggccgcgatcgcgggactcggcatgaacatgttcaaacagcagcagcgacgtggtgcgcccgcggtcaaacacttcacaccattcggcctgtttatccagcagcggggcgttgagcaggtcgagtgcaaaatcggtgagcatcggcgcgtcgcggcggataagcgccagcgcgtcgtccttacactcccacaacaactcgtctgggtactccatcaacaggccgatcactttgaggatctgcattattcgccctccgctttgtcgcgcacttcggtgatgttgatggcatcgatacggctactgttgaacaggttgaatttgctgtccgaaccgtggcaaccgtcgccaaaggtaaaaccgcagccgttgcgttctgcgaaggcatcgcccgccatttcccgatggcttgtcgggatgacgaaacgatcttcatagttggcaatggcgaggtaacgatacatctcttcgacctgggcgacgctcaggcctacttcgtcgatggcacgagtatcagtaacgccttccacggtttgtgaacgcatatagtggcgcatcgccatcatccgtttcagcgcccgcagtaccggaccggtatcaccggcactcaacatattggcgagatattgcaccggaatacgcaggctttcgatggcgggcagcacgccttcgcttttcggcaagccgcccgcatcagcgtaggactgaatcggtgacagcggaggaacgtaccagaccatcggcagggtgcggtattcagggtgcagcggtagcgccagtttccagtccatcgccattttgtagacaggcgaacgctgggcagcgtcaatcacgttttgtggaataccttgtttcagggcttcttcgatcaccgagggatcgtgcggatcgaggaacacttcgcactggcgttcatagagatcgacctctcgttcggtactcgctgcttcttcgatgcggtcggcgtcgtagagcagcacgcccagataccggatgcgacccacgcaggtttcggagcagactgttggctgaccggactcaattcgcggataacagaaaatacatttttctgacttaccgcttttccagttgaagtagatttttttgtatgggcaaccgctaatgcacaaacgccagccacggcatttatcctgatcgatcagcacaatgccgtcttcttcgcgtttgtagatagcgccgctggggcaggtcgctacacaactggggttaaggcagtgttcgcacaagcgcggcaggtacatcatgaaggtgttttcaaactgcccgtacatctccttttgcatggcctcgaagttgcggtcgcgggctcgtttttcaaattcgccgcccagcagttcttcccagtttgggccccagatcactttgtccatccgtttgccgtcaatcagtgaacgcggacgggcggtgggaatatgtttgccttccggcgcgctatgcaaatgttcgtagtcgaaggtgaaaggttcgtagtaatcgtcaatctgcggcactaccgggttggcgaaaattttggtaatcacgcccattttgctgcccagacgcgggcgtatcttgccattcacatcacgcacccagccgccttgccattcttcctgatcttcccagtttttcggataaccaatgcccggtttggtttcgacgttgttaaaccatgcgtactccatgccttcgcgtccggtccagacgtttttacaggtcaccgaacaggtatggcagccgatacatttatcgaggttaagcaccatgccgacttgcgaacgtattttcattttttcgcctcctgtacctgatcgcgaccttcatcatccagccagttaacgttcttcatcttgcggatcatgatgaattcgtcgcggtttgagccgacggtgccgtagtagttaaagccccaggccagctgcgcgtaaccgccaatcatatgcgttggtttcggacaaacgcgggtgaccgagttatgaatgccgccgcgcatgccagttacttccgaaccaggaatattcataatgcgttcctgagcgtgatacatcatggtcatgcccggcggtacacgctggctgaccaccgcgcgggcagtcagcgcgccattggcgttaaacacttccacccagtcgttatcgacaatggtcagttcacgggcatcggtttcgctgagccagacaatcggtccaccgcgagagagcgtcagcattagcaggttttcactgtaggttgagtgaatgccccatttctggtgcggcgtcaggaagttaagggctttctccgggaagccgtttggcggtatctggcgcatttcactgacgctacgggtgtcgataggcgggcgataagccaccagactttcaccaaaagcacgcatccacggatgatcctgatagagttgctggcgtcctgacagcgtgcgccacggaattaactcatgaacgttggtgtatcccgcgttataggaaacgtgatcgctttccagaccagaccatgtggggctggagataattttacgcggctgcgcctgaatatcgcgaaagcgaatcttctcgtcctctttgtgcagcgccagatgggtatgttcgcgtccggtgatctcgcccagcgcttgccacgctttgactgcaacatggccgttggtttccggtgccagtgccagaatcacttctgatgcgtcaatggcggtgtcaatcagcggacgcccctttgccgggccatcacgcttggtgtaattgagtttaccgaggaaatcaatttcatcctgggtattccacgaaatccctttaccgccgttgccaagtttgtccatcaatggcccgagtgaggtaaagcgttcataggtagcagggtagtcgcgctccaccgccacaatattcggcgcggttttgcctggaatcagatcgcactcgcctttgcgccagtcgagcacttcacacggctgtgaaagctctgccggggagtcatgcagcagtggttgtaataccacgtcggtttctttgccgagatgccctatgcacacttgcgaaaaggctttagcgatacctttgtagatttcccagtcgctgcgtgattcccacgccggatcgaccgccgcagaaagcggatgaataaatggatgcatatccgaggtattcatatcgtctttttcgtaccaggtggcggtgggcagaacgatatcggagaacaggcaggtactggacatgcggaagtcgagcgtcaccagcaggtcgagcttgccttcaatcgccgcagtttgccactcgacttcttctggttggattccctccgtcggtccaagttcttccccctgaatgccacttttcgtacccagcagatacttctgcatatactcgtggcccttgccggaagagccaagcaggtttgaacgccagacaaacaggttacgcggatggttgctgccgttgtccggctgttcgcaggccatgcgtaattcgcctgacttcagtgcctggacggtaaattcggcgggtgacaatccggccttgtcggcttcggctttcagggagagcgggttacgccccagctgcggcgcagaaggtagccagcccatacgttcggcgcgaacgttgaaatcaatcaggtgaccgctgtatttactggcatcggcgagcggtgagagcaattcctgcgcggtgactttttcatagcgccactggctggagtgattgtagaaaaacgaggtgctgttcatctggcgcggtggtcggttccagtcgagcgcaaaggccagaggcagccagccggtttgcgggcgcagtttttcctgaccgacatagtgtgcccagccgccaccgctttgcccgacacaaccgcagaagatcagcatattgatcatcccgcggtagttcatgtccatgtgataccagtggttaacacctgcgccgagaataatcatcgagcgcccatgcgttttatgggcggtatcggcaaattcacgggcgatggtttcaatatactggcgcggaacgccggtaatttgctcgccccaggcaggggtataaggtttgatttcagcgtaatctttcgcgctgttttcatcttccagcccgcgatcgaggccgtaattcgccagtaccaaatcataaacgctgaccaccggacaggtgctaccatcggctaatgtcaggtttttaacgggcaattggcgcaccaggacaggattgtgttttacgctgcgaaaatgtggattttcaatgccgccaaagtaggggaaggccacgcctgcaacggcgtcatgttgaccgagcagggttaacgacaattcggtttccgtaccggcggcaatggattccaggttccatttgcctttttctccccagcgaaaaccaatcgaaccgttcggcactaccaattcacctgcggtattaactgccacggttttccactgcggattattgctttcgcccagtccatccaccaggtcagatgcgcggaccatgcgcccgggaacgtagctgccgtcgtcgcgaggttccagcattaccagcatcggcatgtcgctgtagcggcggcagtagttgataaaataatcgctgggattatcgagatgaaactcttttaaaatgacatggcccattgccattgccagggcactatcagtgccttgtttcggtgccagccactggtcgcacaatttggccacttcagagtagtcaggggtaatggcgatggttttagtgcctttgtagcgtacttcggtaaagaaatgggcgtccggcgtacgtgtctgcggtacgttagacccccaggcgatgatgtaactggagttataccagtcggcagattccggtacgtcggtttgctcgccccaggtcatcggcgaggcgggcggcaggtcgcaataccagtcgtagaagcttaaacaggtgccacctaacaacgacagatagcgtgttccggcggcgtaagaaaccatcgacatcgccggaatcggcgagaaaccggcaacgcgatccgggccgtaagttttgatggtccagacgttagcggcggcaatcagctgatttagctcctgccagttggagcggataaagccaccgcgtccacgcacttgtttgtagctcaggctcttttgcggatcgttcataatcgatgcccacgccagtaccggatcgctgtgttgtttgagggcttcgcgccacagttcaatcagtcgtttacgaatgagcgggtatttcaggcggttagcgctgtagagataccaggagtaacttgcgccacgcgggcagccgcgaggttcatgatttggcaggtcagggcgagtgcgcgggtagtcggtctgttggatttcccaggtcaccagaccatttttaacgtagattttccagctgcaggagcctgtacagttaacaccgtgggtggaacgcacgattttgtcgaactgccaacgctggcgatagctgtcctcccagtcgcggttgctatgcatcacctgtccgtgaccatcggcaaaggtttcgcccttttgtttgaagtagcgaaagcgatccaaaagtttactcatgacataactcctgctccaggaatgaattgggatctgatgccttgtcggatgagacacggttgtagcctgataagacgtgtcaggcatcgatctcttatttttggctgaacttccgccgaccataaaccagccaggtcagtagcacacaaacgatgtagaagattaaaaacactttcatcgcgcccaccggagagccggtcatattgagcgacatgccaaacgcctgcggaataaaaaagccgcccactgcgccaatggctgagataaagcccagagcggctgccgtttcggtgacggcttctctttgagcttgctcatcactaccgcctttcatcttcacccgataaattgttatctggcgaaagatgacggcgatcatctggaaagtagaaccacttcccagacccgcggtcagaaacagccccataaatacggcgtaaaatgcgatgaaattaccggagcctgtgcccggtaaggtaaggaacagcagggcgctgaaaatcgccataaaaatgaagttgatcaacgtcacccgcacgccgccgaatttatcggaaatagcaccaccaaccgatcgcgcgatggcaccgataaatgggccaaagaacgccaggcgcagaatattcacatccgggaactgggtttttgccagcatggcaaaacccgcagaaaaaccgataaacgaaccgaaggtggcaagataaagcaggctcagcagccagagatgcaggcgttgtaagacagggagctggtcggcaattgaggcgcgtgaactggcgatatcattcatccctgaccaggcggcgatcgtggcaatcgccagtaatggcacccaaatccatgcggcattcgccagcgacatcaccgaaccgtcggcctgcggtacgccattgacgccgagaaaggcaaatacgggtacaaaaatgaccagcggtgcaaccagctgcatcacacttacacctaagtttcctaatccgccattaatcccaagagcgctcccttgtttggcttttggaaagaagaaactgatattgcccatgctcgaagcaaagttcgcacctgcaaaaccgcatagcaaagcgataacgataaatatcccaaaaggggtattcggattttgcacggcaattccgagccagacgcaaggaataatcaggattgcagtactaaaaaccgtccatcggcgtccaccgaatataggcaccataaaggagtaggggacacgcaataatgcgccagaaacggagggtaatgcggttaataaaaagagttgatcggtagtgaaattaaaaccgattttattgagattaacagtaactgcgctaaatagcatccagacacagaaggcaagaagtaggcaactgactgatatccagaggtttcttcgtgcaatatgctttcctttattttcccagaaggccggattttctggtttccagtcgcgtaaaagataacgactatttttctcattttgcagtgccatattgttcctcacatgcacacattggtaatgaaaaaaagacaaaacaggaggtaaggcgcaatagccagttattagaattaaggatgaatcaggtgaagtgctgattagaagaatagataagaaagcgtaactgcgggggcagaatgtggattaaacagacagatatgtgttactaaatgtaactaaaatggctttctggtatttgaaatttattttttaatattgtcagaatttatctgattaactgccgggccgtagacccgacaattattttagccacgacgtgtcgccagccagcagagcagggaaccgccgcagaccattagcgcgccttgccagaacgagaacgacagcggggcgctgagcagcacggctgcaagcgctgaggaaaggacgggcgtaaaatacgaacctaccgccattatggtgacgttgccatgtaatataccgacattccatgcagcataagcaaatcctaaggtaaatgccgcagagatgagtttaatcatgacgggcgtgctaaataccatttctggttgtggcgtaagaaaatagtaaacccacagacttgctcccgttagcaggacaaaaacggtaattccgttaaatccgcgtgcgtatttattcgttactgtgcagtaggctgcccagataaacgccccaatgaacgccaggaaataactcaatgggctggtggtgatattattaataatttgatcataatgtaacccattgtcaccgcctaacacccagcagacgccgaccagggctaataataatcctggtacaatcagccagttggttttctgaccattaaacagaatggcaaagagaattgtcaggctgggccacagatagttcaccatacccacttcaatcgcctgatgacgggtcgccgcataccctaaggaaagcgccagacagatttcatagctgacgaataacagactcccggcgagtaaatagcctttcgggatctgtcgaatacgcggaaatccaaccgtgaagattaacagcagcccgcttaatgaatagatagcagctgcgccgccgaccgggccgagtccctcactgacaccgcgaatcaatcctaccatcgtgctccacaggacgatcgctattagccctatgagcgttgctttttgtcgtgtcatgctcgctgttttgtctctcttgccgttaaaaattaagctgaattttatagcatttttttaactgccctgtcaggcagtggggcgtttttctaccgctattgaggtaggtcaatttgcgcaggcggattattttgtggcaaacacgtgttctttttgatttcgcgcaaaaagattcagaattttactgttagtttcctcgcgcagtaatacccctgaaaaaagaggaaagcaatggacgtcagtcgcagacaattttttaaaatctgcgcgggcggtatggcgggaacaacagtagcagcattgggctttgccccgaagcaagcactggctcaggcgcgaaactacaaattattacgcgcgaaagagatccgtaacacctgcacatactgttccgtaggttgcgggctattgatgtatagcctgggtgatggcgcgaaaaacgccagagaagcgatttatcacattgaaggtgacccggatcatccggtaagccgtggtgcgctgtgcccgaaaggggccggtttgctggattacgtcaacagcgaaaaccgtctgcgctacccggaatatcgtgcgccaggttctgacaaatggcagcgcattagctgggaagaagcattctcccgtattgcgaagctgatgaaagccgaccgtgacgctaactttattgaaaagaacgagcagggcgtaacggtaaaccgttggctttctaccggtatgctgtgtgcttccggtgccagcaacgaaaccgggatgctgactcaaaaatttgcccgctccctcgggatgctggcggtagacaaccaggcgcgcgtctgacacggaccaacggtagcaagtcttgctccaacatttggtcgcggtgcgatgaccaaccactgggtggatatcaaaaacgctaacgtcgtaatggtgatgggcggtaacgctgctgaagcgcatcccgtcggtttccgctgggcgatggaagcgaaaaacaacaacgatgcaaccttgatcgttgtcgatccccgttttacgcgtaccgcttctgtggcggatatttacgcacctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataagtcgtcctggaactatcagttcgatgaaaacggctatgcgaaacgcgatgacacgctgactcatccgcgctgtgtatggaacctgctgaaagcgcacgtttcccgctacacgccggacgtagtagaaaacatttgcggtacgccaaaagccgacttcctgaaagtgtgtgaagtgctggcctccaccagcgcaccggatcgcacaaccaccttcctgtacgcgctgggctggacgcagcacaccgtgggtgcgcagaacatccgtacgatggcgatgatccagttactgctcggtaacatgggtatggccggtggcggcgtgaacgcattgcgtggtcactccaacattcaggggcctgactgacttaggcctgctctctaccagcctgccaggttacctgacgctgccgtcagaaaaacaggttgatttgcagtcgtatctggaagcgaacacgccgaaagcgacgctggctgatcaggtgaactactggagcaactatccgaagtttttcgttagcctgatgaaatctttctacggcgatgccgcgcagaaagagaacaactggggctacgactggctgccgaagtgggaccagacctacgacgtcatcaagtatttcaacatgatggatgaaggtaaagtcaccggttatttctgccagggctttaacccggttgcgtccttcccggacaaaaacaaagtggtgagctgcctgagcaagctgaagtacatggtggttatcgatccgctggtgactgaaacctctaccttctggcagaaccacggcgagtcgaacgatgtcgatccggcatctattcagactgaagtattccgtctgccttcgacctgctttgctgaagaagatggttctatcgctaactccggtcgctggttgcagtggcactggaaaggtcaggacgcgccgggcgaagcgcgtaacgacggcgaaattctggcgggtatctaccatcatctgcgcgagctgtaccaggccgaaggtggtaaaggcgtagaaccgctgatgaagatgagctggaactacaagcagccgcacgaaccgcaatctgacgaagtagctaaagagaacaacggctatgcgctggaagatctctatgatgccaatggcgtgctgattgcgaagaaaggtcagttgctgagtagctttgcgcatctgcgtgatgacggtacaaccgcatcgtcttgctggatctacaccggtagctggacagagcagggcaaccagatggctaaccgcgataactccgacccgtccggtctggggaatacgctgggatgggcctgggcgtggccgctcaaccgtcgcgtactctacaaccgtgcttcggcggatatcaacggtaaaccgtgggatccgaaacggatgctgatccagtggaacggtagcaagtggacgggtaacgatattccggacttcggcaatgccgcaccgggtacgccaaccgggccgtttatcatgcagccggaagggatgggacgcctgtttgccatcaacaaaatggcggaaggtccgttcccggaacactacgagccaattgaaacgccgctgggcactaacccgttgcatccgaacgtggtgtctaacccggttgttcgtctgtatgaacaagacgcgctgcggatgggtaaaaaagagcagttcccgtatgtgggtacgacctatcgtctgacggagcacttccacacctggaccaagcacgcattgctcaacgcaattgctcagccggaacagtttgtggaaatcagcgaaacgctggcggcggcgaaaggcattgccaatggcgatcgtgtcactgtctccagcaagcgtggctttatccgcgcggtggctgtggtaacgcgccgtctgaaaccgctgaatgtaaacggtcagcaggttgaaacggtgggtattccaatccactggggctttgagggtgtcgcgcgtaaaggttatatcgctaacactctgacgccgaatgtcggtgatgcaaactcgcaaacgccggaatataaagcgttcttagtcaacatcgagaaggcgtaagggggcgaacagatggctatggaaacgcaggacattatcaaaaggtccgcaactaactccatcacgccgccttctcaggtgcgtgattacaaagcagaagtcgcgaaacttatcgacgtttccacctgtatcggctgtaaagcctgtcaggtggcgtgttcggagtggaacgacatcc

SEQ ID NO: 10009 - DNA, 37671 bp, Escherichia coli
tttgctgcgctcgttgattatgccgcgtttaagcgttgagtggatgaacgaactttcccactggcctaatctcaatgtgttgttaacgcgccagccgcgactgcctgtacgtctacatcgcccttaccttgcggcgaatcttagccgtaagcaattgctggaggcgttacgttaccattatgcgttactccgcgggtgtatgtcggcggaagaattcagcttatatttgaatacccccgggctgcaactggcgaagctggaaggcaaaaacggcgagcagttcacgcttgagctgaccatgatgatctcaatggataaagaaggtgacagcaccatcctgttccgcaacagcgaaggtattcctctggcagagctcacttttaccctgtgtgaatatcaggggaaaaggacgatgtttattggcggactgcaaggcgcaaaatgggaaattccacaccaggaaatccagaatgcgacgaaagcctgccacgggctatttcccaaacgcctcgtgatggaagcggcctgtctgtttgcccaacgtttgcaggtagagcagattattgccgtcagcaatgaaacgcatatttaccgcagcctgcgttatcgcgataaagagggcaagatccatgccgattacaacgctttctgggaatcggttggcggcgtatgtgatgctgaacgccattaccgccttccagcacagatagcacgaaaagagattgccgaaatcgccagtaaaaaacgggctgaataccgtcggcgctatgagatgctcgacgctattcagccacaaatggccacgatgttttgtagttagtcggcccgaccgcgcgccagccacagcacgcgtgagaacatttttttcagcagcgtcggtacggagtccacaccacgacgtccggcctccattgccacttcaatggcaagatcgggtttggaagagcgatggatcgctttcgagataactttgcgcagattcatcggtatattttccgggatttgcgccacgcggtggaacacatcggaaaatccctggcgatacataaaatgttccatatccagcgccggtaacgccgttaaatgttctcgttcggcttcccgatcgttattcaacaggctgcgtaccgtagcggcatatttcttccctgcttcatcgccatcgaccagtacatgccattcaatccccattcgccgggcaaatttaaccagtggctttagtccggactgggcaaactcaatgaccttgatcccttcggcatcaaaatgatgtccgcactgacgcgccagttcattgataacccaggtttccgtttccccttccaccagcagccaacagcgggcaaacagcgatgacggacggttaaaacgaatgtgaaaggagatgcgtcggctatcttcggtactcaagccactcggtcccagacgccaggcggcaacgcgcgaggactcacgtaccagtcggcaaacatgctctaccggcgttaacgaaagcagctcgccagagttggtggtggcaatgcgctgcaatggcagaagattcaacagatgccaggcaactgaaagcataatggggtgtaaacgggtttctggatcttcgatcagcaacaatggacgggcgtctttatccagtcgcaatgtgccttttgcctgcaataaagtagcaaacaggccgagcaaaataacccgatacgagcgccctccaggtcggtcaatcatccggttgatgatatccagatagcgccagcttcgttgctcattgctggctcgccgccgcattaaacgatatcgcgcctgtccagctccctgctcagaaaaataatgctcaagaagttgcaccattgcggaaagtccctgacgaatctgcccatcagagagattttgcggatgtgaggataattcacgggcgaggaaatcgagctggcgcgcggtgacttccacattggggacatttggcaccgtgccgttacgaatacggcgcataaaacgggcatcacgcaagcgcagcaccggcattaaacgcaccagatgacgagcctgatcgttaatatcctcaacatcaatcggatgtccgtctttatcgagaaaactgcgcagtgtcatcacgctgccgtcttccgcactctccccttccagacgataaaaaatacggtgataaccatcggtgcatggcgtccagcacgcttccagcggccgatagcggcgaacccgatgtcggcctggcagcgattcgcggaaggtcaaaataatatgcagatgatgttctcgcccgttgatatctcccggcgggaaccagaaatcatcgcgctcaaaatggtagagatctgattctggcgatagcagcagggttaaggcgtccagcaagctggatttaccccacgcgttctccccaatcaggacgttgttttgttccagcatcaacgacaaacggttgataccgcgaaaacccacaatttcaacgcgctcaagaatcatatcccctccagaaatatgtgacttatcctttacgctggcagtataacgggaaaggccatgctaatacgtgatgacatcacatttaagcatggcaaatgtctgaaaaatgagcgaataatcgcgttatactccctcttgctgataagcctgcaaaaacaacaaaatcaaataattagcatgataaattattttttattacgcctaaaggattaaatctttcgcttgcactacactgtcaatcagacaaatgactatatggggcaacccgctgttgccttaaatcaaatttactggatttatttatctggtgaatgacttgccttcgtttttaaaatagccgcgcattatttccgtcgtcacttttttacgacgaccctataaaacgaccatatttttcacagggtcaatttttaattgaggtggatatgttcagaaaattagcagctgaatgttttggtactttctggcttgtttttggcggctgtggtagtgccgtactggccgcaggcttcccggaattaggcattggttttgccggcgtggcgttggcgttcggtctgaccgttctgacaatggcctttgctgttggtcatatttctggtggtcattttaacccggcggtcactattggtttatgggctggcggacgtttcccggcaaaagaagtcgttggctacgtaattgcccaggttgtcggcggtattgttgcggcggcgctgctgtatttaattgccagtggtaaaacgggttttgacgcggcagccagcggttttgcttctaacggttatggcgagcattcaccaggcggttattccatgctttccgcgctggtagttgaactggtattgagtgcaggtttcctgctggtgatccacggcgcaactgacaaattcgctcctgctggttttgcgccaattgccattggtctggccttaaccctgattcacttaatcagtattccggtgactaacacttccgttaacccggcgcgcagtactgcggttgctatcttccagggcggctgggcattagaacaactgtggttcttctgggtggtgccaattgtcggcggtattatcggtggtctgatttaccggactctactggaaaaacgcgattaattagcattggcatgttgtctgccctggtggttttatcttcgacgttacaaaccgcacgggtgttggtggcgttaaaatcgccgaggcgttccccgaaggccgggggtgcagggggcggcggcgactggccgctccctgcgccagtggctttatatggcattgcacatgaaaggagcgcaacaacgctaaacactcatatagaattaaaaatccccctctgatgcataacatttccttttaattgcaactttactcgtccttctgctttcagtagtgtgtcatcgcgcatttcgaatcttctttgcaaggactgggttttcatgttttctgggctgttaatcattctggttcccctgattgtgggttacctcattccgcttcgccaaaaagctgcattaagagttattaatcagctattaagttggatggtttaccttattctcttttttatgggtatcagtctggcgtttctcgataacctcgccagtaacttgttggcaattctgcattattctgccgtcagtattaccgttattttactgtgtaatattgccgccctgatgtggctggagcgcggcctgccatggcgcaaccaccatcatcaagaaaaactcccgtcgcgtattgcgatggcgctggagtcgctaaaactgtgcggcgtagtagtgattggttttgccattggtctgagtggactggctttcttacaacacgcgaccgaagccagtgaatacaccttaattctgctacttttcctcgtcggtattcagttgcgcaataatggcatgaccttaaagcagattgtccttaatcgccggggaatgattgtcgccgtggtggtggttgccagttcattaattggtggtttaattaacgcctttattcttgatcttcccatcaataccgcgctggcaatggcctccggtttcggctggtattctctttccggtattttattgaccgaatcttttggtccggtaatcgggagcgcggcgttttttaatgatctggcccgtgagctgattgctattatgttaatccctgggctgattcgccgtagccgctctactgcactgggcttatgcggtgcgacgtcgatggatttcaccctgcccgttcttcaacgtacaggcgggctggatatggtcccggcggcgattgttcacggttttattcttagtctgttagtgccgattctcatcgcctttttctctgcataatacctctctggcggtagatctctgccgccaaaattgcgctaaatcaatctcccttaaagttgcattaaaaatctcttttatccccgcgttaagcgtcttaaccttaaacatgtatattaaatataactttaaaaggtgtgatcatgttttgtgtgcaatgtgaacaaactatccgtactccggcaggaaacggctgctcatacgcgcaggggatgtgtggtaaaacggcggaaacctctgaccttcaggatttactcatcgcggcgctgcaagggctttcggcctgggcagtgaaagcacgtgaatacggcatcatcaaccacgatgtagacagctttgcgccacgtgcctttttctcaaccctgaccaacgttaacttcgattctccgcgtattgtcggctacgctcgtgaagcgattgccctgcgcgaggcgctgaaagcacaatgcctggctgtagatgccaacgcccgcgtcgataacccgatggctgacctgcaactggtgagcgacgatctcggcgagctgcaacgtcaggcagcagaatttacccctaacaaagataaagcggcgattggcgaaaacattctcggcctgcgtctgctgtgcctgtatggcctgaaaggtgcggcggcctatatggaacacgcgcatgttctcggtcaatacgacaacgatatttatgcccagtaccataaaatcatggcgtggctggggacctggcctgccgatatgaacgcgcttcttgagtgttcaatggaaatcggccagatgaatttcaaagtgatgagcattctggatgcaggcgaaaccggtaaatacggtcacccgaccccaacccaggtcaatgtcaaagcgacggcgggtaaatgcattctgatttccggtcacgatctcaaagatctctacaacctgctggaacagaccgaaggcacgggcgttaatgtctacacccacggcgaaatgctgcctgcgcatggttacccggagttgcgtaaattcaagcatctggtcggtaactacggcagcggctggcagaatcagcaagtggagttcgctcgtttcccaggccccatcgtgatgacctcgaactgcatcatcgacccaaccgtaggcgcttatgacgatcgtatctggacccgcagcatcgttggctggccgggtgtgcgtcatctggatggcgaagatttctctgcagtcattgcccaggcgcaacagatggcgggcttcccgtacagcgaaattccgcacctgatcaccgtgggctttggtcgccagacactgcttggcgcagccgatacgctgattgatctggtgagccgtgaaaaactgcgtcatatcttcctgcttggcggctgtgacggcgcacgcggcgagcgtcactacttcaccgatttcgccaccagcgtgccggatgactgcctgatcctgaccctcgcttgcggtaaatatcgctttaataaacttgagtttggcgatatcgaaggtctgccgcgtctggtagatgctggtcagtgtaacgatgcttactcagcaattattctggcggtaacgctggcagagaaactgggctgtggggtgaacgatctgccgctgtcgctggtgctctcctggtttgaacagaaagcgattgtcattctgctgacgctgctttctctgggtgtgaaaaatatcgtcaccggcccgactgcacctggtttcctgacaccagacctgctggcggtgctgaacgagaaattcggcctgcgttctatcaccactgttgaagaagacatgaagcaactgttgagcgcgtaaggagtttgtcgatgacgatgccaacgaatcaatgcccgtggcggatgcaggttcatcacattacgcaagaaacgccggatgtgtggacgatttccctgatttgccacgattactacccatatcgcgccgggcaatatgcgctggtcagcgtgcgaaactcagcagaaacgctgcgtgcttacaccatttcctccacgccaggcgtgagtgaatacatcaccctgaccgtgcggcggattgatgacggtgtcggctcccggtggctgacgcgcgatgtaaaacgcggtgattatctctggctttcggacgcgatgggggaatttacctgcgacgataaagcagaagataaattcctgttgctggcggcaggctgcggcgtcacgccgattatgtcgatgcgtcgctggctggcgaagaaccgtccacaggccgatgtgcaggtgatctacaacgtgcgtacgccgcaggatgtgattttcgccgatgagtggcgtaactatccggtaacgctggtggcggaaaataacgttaccgaaggctttatcgctggtcgtctcactcgcgaactgctgactcgcgttcctgatttagcctcacgtaccgtgatgacctgtggccctgctccatatatggattgggtagagcaggaagtgaaagcgctcggcgtgacgcgtttctttaaagagaaattcttcaccccagtagcggaagcggcgaccagtggtctgaaattcaccaaactgcaaccggcacgagaattttacgctccggttggcaccacgctactggaggcgctggaaagcaataacgttccggttgtcgccgcctgccgtgcgggtgtttgcggctgctgtaagacgaaagtgatttccggtgaatatacggtgagcagcacaatgacgctgaccgacgccgaaatcgctgaaggttacgtactggcctgctcctgccatccgcagggggatttggttctcgcataatcgcctgatgcccgatgatattcctttcatcgggctatttaaccgttagtgcctcctttttctcccatcccttccccctccgtcagatgaactaaacttgttaccgttatcacattcaggagatggagaaccatgaaacaaacggttgcagcttatatcgccaaaacactcgaatcggcaggcgtgaaacgcatctggggagtcacgggcgactctctgaacggtcttagtgacagtcttaatcgcatgggcaccatcgagtggatgtccacccggcatgaagaagtggcggcgtttgccgctggcgctgaagcacaacttagcggagaactggcggtctgtgccggatcgtgcggtcccggcaacctgcacttaatcaacggcctgttcgattgccaccgcaatcacgttccggtactggcgattgccgctcatattccctccagcgaaattggcagcggctatttccaggaaacccacccacaagagttattccgcgaatgtagtcactattgcgagctggtttccagcccagagcagatcccacaagtgctggcaattgctatgcgcaaagcggtgcttaaccgtggcgtttccgttgttgtgttaccgggcgacgtggcgttaaaacctgcgccagaaggggcaactacccactggtatcatgcgccacagccggtagtaacaccggaagaagaagagttacgcaaactggcgcaactgctgcgttattccagcaatatcgccctgatgtgtggcagcggctgtgcgggggcgcataaagagttagttgagtttgccgggaaaattaaagcgcctatagtccatgccctgcgcggtaaagaacatgtcgaatacgataatccatatgatgttggaatgacgggattaatcggcttttcgtcaggtttccataccatgatgaacgccgatacgttagtgctgctcggtactcagtttccctaccgtgtgttctacccgaccgatgccaaaattattcagattgatatcaacccagccagcatcggcgcgcatagcaaggtagatatggcgctggtcggcgatatcaaatcaaccctgcgcgcattgctgccactggtggaagaaaaaaccgaacgcaagtttctggataaggcgctggaagattaccgcgacgcccgcaaagggctggacgatttagctaaaccgagtgagaaagccattcacccgcaatatctggcgcagcaaattagtcattttgccgccgatgacgctattttcacctgtgacgttggtacgccaacggtgtgggcggcacgttatctaaaaatgaacggcaagcgtcgcctgttaggttcgtttaaccatggttcgatggctaacgccatgccgcaggcgctgggcgcgcaggcaaccgagccggaacgccaggtggtcgccatgtgcggcgatggcggttttagcatgttgatgggcgatttcctctcggtagtgcagatgaaactgccagtgaaaattatcgtctttaataacagcgtgctgggctttgtggcgatggagatgaaagctggtggctatttgactgatggcaccgaactacacgacaccaactttgcccgaattgccgaagcctgcggcattacgggtattcgtgtagaaaaagcgtctgaaatcgatgaagctctgcaacgcgccttctccatcgacggtccggtgttggtggatgtggttgtcgccaaagaagaattagccattccaccgcagatcaaactcgaacaggccaaaggtttcagcctgtatatgctgcgcgcaatcatcagcggacgcggtgatgaagtgatcgaactggcgaaaacgaactggctaaggtaaaaagggtggcatttcccgtcataataaggacatgccatgattgatttacgcagtgataccgttacccgaccgagccgcgccatgctcgaagcgatgatggccgccccggttggggacgacgtttacggagacgaccctaccgttaatgctctgcaggactatgcagcagagctttccggtaaagaagccgccatttttctgccgaccggcactcaggccaacctggtcgctctgctcagtcactgcgaacgcggcgaagagtatatcgtcggtcaggccgcgcataactatctgtttgaagccggtggcgcagcagtgctgggcagtattcagccgcaacccatcgacgcagctgccgacggcacgctaccgctggataaagtggcgatgaaaatcaaacccgacgatatccatttcgcccgcaccaaattactcagtctggaaaacacccacaacggcaaagtgctgccgcgtgaatacttaaaagaggcatgggaatttacccgcaagcgcaatctggcgctgcatgttgacggtgcgcgcatctttaatgccgtggtggcttacggctgcgaactgaaagagatcacgcaatattgtgactcgttcaccatttgcctgtcgaaaggtcttgggacgccagtcggttcattactcgtcggtaatcgtgattacattaaacgtgccattcgctggcggaaaatgacaggtggcgggatgcgccagtccggcattctggctgccgccgggatgtatgcgctgaaaaataacgtcgcacgtttgcaggaagaccacgacaatgccacctggatggcggagcagttgcgtgaagcaggcacggatgtgatgcgtcaggacaccaatatgctgtttgttcgcgtcggggaagaaaatgctgccgcgttaggcgaatacatgaaagcgagaaacgtgctgattaacgcctcgccgattgtccgcctggtgacccatcttgacgtctcgcgtgcacaactggcggaagtcgccgcccactggcgcgcattcctggcgcgttaaggagggagacgtgccgcaacgcattttagttctcggtgccagtggctacattggtcagcatctggtgcgcacactcagccagcaagggcatcagctcctggcggcggcacgtcatgtcgacaggcttgcaaagctgcaactggcaaatgtcagttgccataaagtcgatctcagctggccggataaccttccggccctgttgcaggatattgatacggtctattttctggtgcacagcatgggcgaaggcggcgattttatcgctcaggagcgccaggtggctctcaacgtccgcgatgcgctacgtgaagtcccagttaagcaattaatctttctcagttcgttgcaggccccgccacatgagcagtcggaccatctgcgcgcccgtcaggctacggcggacattcttcgtgaagcgggtgtcccggtgaccgaattgcgtgccggaataatcgttggtgcaggttcagcggcgttcgaggtcatgcgcgatatggtctacaacctgccagtgttaacgccgccacgctgggtccgttcacgcaccacgcccatcgcgctggaaaacttgctgcactatctggtggcgctgttagatcatccagccagcgaacatcgcatcttcgaagccgccggaccagaagtgctcagttatcagcaacagtttgaacattttatggcggtgagcggtaagcgccgctggttgctccccatcccctttcccacccgctggatttcggtgtggtttcttaatgtgattacttccgtaccacccaccaccgccagggcgttgattcaggggctgaaacacgatctgctggcagatgacaccgcgttacgtgcactcattccacaaccgctgattgctttcgatgacgcggtacgtagcacgttgaaagaggaagaaaaactggtcaactccagcgactggggatatgacgcgcaggcttttgctcgctggcgaccagaatacggttattttgccaaacaggcggggtttaccgttaaaacgtctgccagacttcaggcgctatggcgggtggtcaatcaaatcggcggtaaagagcgttatttctttggcaatattttgtggcagactcgagcgctgatggaccttgcgatcggtcataaactggcaaaaggccgcccggagcgcgaatatttgcaaactggcgatgcggtggatagctggaaagtcattgtcgttgaaccggaaaaacaacttacgctgttatttggcatgaaagcgccggggctgggacgactgtgttttaccctggaagataaaggtgactatcgtactatcgatgttcgcgcattctggcatccgcacggtatgccagggttgttttactggttattgatgatccccgcgcatctgtttatttttcgcggaatggcaaaacgaatcgccagactggcagaacaaagcacagattaatcgacaaaacctgcgttattctttcatgtttcccattgcatcatgggggaaatcacggaagaatgcgcacgttattttctcaacaacagtggattgatatgaaggtactggttaccggcgccaccagcggcttaggtcgaaacgcggtagagtttttatgccagaaaggcatcagcgtgcgagcgaccggtcgcaacgaggcaatgggtaaattgctggaaaaaatgggcgcagagtttgttccggcggatctgaccgagctggtttcatcacaagctaaagtgatgctcgcgggcattgatacgctgtggcactgctccagctttacctcgccctgggggacacaacaggctttcgatctggctaacgttcgcgccactcgccgcctgggtgaatgggctgtcgcctggggtgtgcgtaactttattcatatctcttccccctccctgtacttcgattatcaccaccatcgcgatattaaagaagattttcgccctcaccgcttcgccaacgagtttgcccgcagcaaagcagccagcgaagaggtgatcaatatgctttcgcaggcgaatccacaaacgcgctttactattctgcgcccacaaagtctgttcggaccgcacgataaagtctttatcccccgtctggcgcatatgatgcaccactacggcagcattctgttaccgcacggcggcagtgcgctggtcgatatgacctactatgaaaatgccgtgcacgccatgtggctggcaagccaggaagcctgcgataagctaccttccgggcgtgtgtacaacatcaccaacggcgagcatcgcacactgcgcagcatcgtgcagaagctgatcgacgagttgaatattgactgtcgtattcgttccgtcccttacccgatgctggatatgatcgcccgcagcatggagcgtttaggccgcaagtcagcaaaagagccgccgctgacccactacggcgtctccaagttgaattttgactttacgctggatattacgcgtgcgcaggaagagttaggttatcaaccagtcctcaccctggatgaaggtatcgagaaaactgccgcctggctacgcgaccacggaaaactgccgcgctaatcctgcccgtatttctccagcaacgcttcggcaatcgcctgagtttctgcatccgcttcgccgttgtataacgtcgggcggaaatgcatctggaacgccataatcacgcgccgctgctcgcgcggagtcatatcaggctttacgtcataaccataacgcgccaaaagctccagcaatgacgcggtctctaccggtgtgtgcggcgcgcgcccggcaaggtaaaagttcacccgctgcgcatccggccaggcaccaatcccctgctgcgccagttgcttccagggaaataatggccccggatcgtctttgcgctgcggcgcaatatccgcatgtgctactacgttttccggcttgatgtaataacgggcaataatatctttcgccagcggaataagcgcctgaatctgtgccggttcaaacggggcaaaatatttcactcccgccgatttttgccagccacggttttccagctcaatgccaatagaggtgtcgttaaggcgcgttgccccgcgccaggcgctaatccccgcatgccaggccagttcttgttccggcaccagttgccagatgcgcggtttaccgttgtatcgcggtggcaccgcagggaccagataatgcgagctgacctgcttatcggtcagtgtcgccagcgagctatcaaaatcatctgcggtgtagtggatcaccagcactttaatgcgcggatacgccgcctgcgcctggcgtcgggtatcaagctgatatccctctttctcgacaatgcctttttcgcctgtgcaccctgccagtaacagagcggcagcgaccagccagaagactcttctcatcgacgcgttttcaccgccgtaccgctgacgctaaccatcagcatactgccgttttgcccgaccgtttcgtagtcgatatcaataccgacgacggcatcagcccccagcgctcgcgcctgggagccgagctcctcaaaggcaatctcccgcgctttacgcagttctttttcgtaggcaccggagcgtccgccaacgatatcgcggataccggcaaagaaatcacggaaaatattcgcgcctaaaatcgcttcgccagtcaccacaccgcaatattcaacgatggtctggccttccagagttggggttgtagaaaattgcatgatcgatctccttgtttgctaagccttcgatcttcaaagcattatcggactgatacgctattattgaaaggatatcattattatcgtagaacgctttcaaggtgttcgcttataaggaaatcatcatgcgctatagcaaattgaccatgcttatcccttgcgcactgctactcagtgcctgtaccaccgtcacgccagcttataaagataacggcccccgcaccggttcctgtgtccagggggggcctgatagcgtggctcaacagttctatgactaccgcattcaacatcgcggcaatgacattaccgctctacgcccctatttgagtgacaaactggcaaccctacttagcgatgccagccgcgataatagtcatcgtgaattgttaagcagcgatccgttctccagtcgaaccaccttgccagacagcgcccacgttgccagtgcatctactatccctaatcgtgatgcccgtaacattccattgcgcgtggatctcaagcagggtgaccagggctggcaggatgaagtgttaatgattcaggaaggccagtgttgggtcatcgacgatgtgcgctacttaggcggtagcgttcatgccacagcgggtacgctccgtcagtccatcgagaatcgctaacgtcttgatcaaccaataaaccccgtaaattgtacggcatttcgtgaggaatgccgacatttatgctcgccgaccaccgcccccgttattttgtgctatgtttattgaataatgcgctttgcttttaacttttaaagcagaaatattgcataattattctgtcaaaggtattatcttcgacctcaatagctatcagactgccagtatacgagtgtcaatgagtattcaattaaacggcattaattgcttctacggcgcgcatcaggcgctgttcgatatcacgctggattgcccacagggcgaaacgctggtgttacttggccccagcggcgcgggtaaaagctcgctgctgcgtgtactcaatctgcttgagatgccgcgctccggtacgctcaacattgcaggcaaccatttcgatttcaccaaaaccccctctgacaaagcgattcgcgatttgcgtcgtaacgttggcatggtgtttcagcaatacaacctgtggccgcatctgaccgtgcagcaaaacctgattgaagcgccctgtcgtgtactggggttgagtaaagatcaggcgctggcccgtgcagaaaaactgctggaacgtctgcgtctcaaaccttatagcgatcgttacccgctgcatctttctggaggtcagcagcagcgtgttgctattgcccgtgcgttgatgatggaaccgcaggtactgctgttcgatgaaccgaccgccgcactggaccccgaaattacggcacaaatcgtcagcatcattcgtgagctggcagaaacgaatattacccaggtgatcgtcacccacgaagttgaagtggcgcgtaaaaccgccagccgagtggtgtatatggaaaacggtcatatcgtagaacaaggcgacgcgagctgctttaccgagccgcaaaccgaagcatttaaaaactatctctctcactaagattcgggataacaacaatgaaaaaagttctgattgccgcgttaattgcaggttttagtctttccgccacagcagccgaaaccattcgttttgccaccgaagcctcctatcctccgtttgaatcgattgatgcaaacaaccagatcgttggttttgatgtcgacctggcgcaggcattgtgtaaagagattgatgcaacctgcactttctctaaccaggcgtttgacagcctgatcccaagcctgaaattccgtcgcgtagaagcagtgatggcgggcatggatatcactccggagcgtgaaaagcaggtgctgtttaccaccccgtactatgacaactctgccctgtttgtgggtcagcaaggcaaatacaccagtgttgatcagctgaaaggcaaaaaagtcggcgttcagaacgggacgacacaccagaagttcattatggataagcatccggaaatcactaccgtgccatatgacagttaccagaacgcaaaactggatctgcaaaacggtcgtatcgacagcgtatttggtgacaccgcagtggtaaccgaatggctgaaagataacccgaaactggcggcagtgggcgataaagtgaccgataaagattacttcggtactggcctcggcatcgcagtacgccagggcaacactgaactgcagcagaaactcaacactgcgctggaaaaagtgaagaaagatggcacttacgaaaccatctacaacaaatggttccagaagtaattcctgatgaatgaattttttcctttagcaagcgccgccgggatgaccgtcggccttgccgtttgtgcattgattgtcgggctggcgctggcgatgttctttgcggtatgggagtctgcgaaatggcgtcctgtcgcgtgggcaggttcagcgctggtaaccattctgcgtggcctgccagaaattctggtggtgctgtttatctattttggctcctcgcagctgctgctgacgctttcggatggcttcactatcaatcttgggttcgtgcagatcccggtgcagatggacattgagaacttcgacgttagcccgttcctttgtggtgtcatcgcactgtcactgctgtatgccgcctatgcctcgcaaacgctgcgtggtgcattaaaagcggtgccggtgggtcagtgggaatccggtcaggcgctggggctgtcgaaatcggctatctttttccgtctggtgatgccgcagatgtggcgtcatgcgctgccaggtctcggtaaccagtggctggtgctgctgaaagataccgcgctggtcagtttgattagtgtgaatgatttaatgctacaaaccaaaagcatcgctacccgtacacaggaaccgtttacctggtacattgtggcggcggtgatttacctggtgatcaccctgctcagtcagtacattctcaaacgcattgacctgcgcgcgacacgttttgagcggaggcccagctaatgtttgagtatttacccgaactgatgaaagggctgcacaccagcctgacgctaaccgttgcctcgctgattgtggcactgattctggcattgatttttaccatcatcctgacgctgaaaacgccggtgctggtgtggctggtgcggggctatatcacgctgtttaccggtacgccgctgctggtgcagatcttcctgatttattacggaccgggccagttcccaacgttgcaggagtatccggcactgtggcatttgttgtcagaaccgtggttatgtgcgctgattgcgttgtcgctgaacagtgcggcgtacaccacgcagctgttttacggtgcgattcgcgcgatcccggaaggtcaatggcagtcctgtagcgccctgggaatgagcaaaaaagatacgctggcgatcctgctgccgtacgcgtttaaacgctcgctctcttcttattccaacgaagtggtgctggtgttcaaaagtacctctctggcttacaccattacgctgatggaagtgatgggatacagccagttgttgtacggacgcacctacgatgtaatggtatttggcgcggcggggattatttacctggtcgtcaacggcctgctgacgctgatgatgcgtctgatcgagcgtaaagcactggcattcgaacggcggaattaatgtagctgcatgctgatgccggatgcggcgtggacgccttatccggcctacatagtgcataaattcttattatgaagacggacaacccactaagctgtccgtctttttttatttcatataaattatttactcatatttattgcatataaattcacttgatggcattgttatcccatgccgcagacacggccaaaaatcataagattgacagacgggagttccatcatgaaaaagttagttcttgccgctttacttgcttcttttactttcggtgcttctgccgcagagaaaatcaattttggcgtttcagccacctatccaccctttgaatctataggtgctaataatgagattgtcggctttgatatcgacctggcaaaagccttgtgcaaacaaatgcaggcagaatgtacttttactaatcacgcgttcgacagcctgatcccgtcactgaaattcagaaaatatgacgccgtaatctccggaatggatatcacgccggagcgtagcaaacaggtatcgtttaccacgccctactacgaaaactcagccgtcgtgattgccaaaaaagatacctacaaaacgtttgccgatctgaaaggcaaacgtattgggatggaaaacggcaccacgcaccagaaatatattcaggatcagcacccggaagtaaaaactgtctcctatgacagttatcagaatgcctttatcgatctgaaaaatggccgtattgatggcgtatttggtgacaccgcagtggtaaacgaatggctgaaaaccaatccgcaactgggcgttgctactgaaaaagtgaccgatccgcaatacttcggcaccggcctgggtatcgctgtacgtccggataacaaagctctgctggaaaaactgaataacgcgctggcagcaattaaagctgacggtacatatcagaaaatcaatgaccagtggttcccacagtaagattcagaaagccgcacctgcggcttttttattgcttcaccagcagcgtcagcacttcatagtgcgcggtgtgcgggaacatatcaaaaagctgtacccgttcgatgcgataaccaggcagttcgcggatatctttcgccatagtttgggcgttacagctggagtagataataaaacgcggtgccatcgttgagagataatcacacagcggtttaccgatgccgcggcgcggcgggttaaccagcaccagctccggcacttccccctgagcggtggcaaactgcgtagagtccagcgcctgaaattgcaaacgcgttaagcccagttcagcggctgactgcttcgcacaggcaatggcctctggtgcaatttcgatcccggttaactgcatgtcaggcgtcgcgcagtgtaaaccaaagccacccacaccgcagaacagatcccacatatgtttaaccggcagctgtcgtacccagtcgcgcgcggtggcgtacagctggctggcgaccgccggattagtctggaagaaactttgcggacggatccacagcggtacgtcattaaaacgctctgccagtgcctgttgttcggtcaggtagatctccgtctccccttccataatcgccatatgtaccggctgaatattgacggtaataactttcagctgcggtaattgttcctgtaaccacggcagcgccttacgcagttgcgccagtttggtatcagaacgcagtacaaaacgcagcatcatgccgccatcgctctggctttcagtcagcagaatgtatttcagttcaccacgtttacgcgccacgttgtaaggcgttaaacccgcacgggcgataaacggttttagcgccgcaaaaacgggcgcaaatgaggctggataaagcgggcagtcacaaaggtcttccggtgtaccatcccgatgcagcataccgagcagtggtttttcaacgctaccactcaccaccattttggctttattacgaaacccttgttccgggcctgacaccggcgcacaccattcctcaaccggaaaatcggcgagcagatttttaagatcgacggttttagcggagagttgctctggaatcggctgcgttatccactgacaggaacgacagcgacccgcgtcgtaaagtgcgcactgcatacattgaccttcacatcatcaggggcgacgattatacacattattgcaactggaagaaccgccgactggtcgagggaacgaacagcagcatcaggatgagcatatccggcagcttctgcagcatcaggctatggaagatttcacgttttgattcaccgggaatgctgaacagctccggataaccataccccagcgaggccgcccacaagtaacttgcggctgtgatttgtgtcaacagatacagccagcgcgcccagcgacgccctttcaccagtgaaaacgcacaccagatctcaatgaaaaccagcaccagactgctcaaaaagaccagcgttaaactccaggtttgtacgctgcgatgaatgaactcgccaataccgcgcacgcccagcgtattgaaaatcatcagcacgtcgaggccacggatcataataatggcgagcgccgccacctgcaccagcgcaggcacattcaggcgagcatgagatgaagatgttttcttaaaaaatcccaacgtttcgtcttccatgaaaacaatgccgcgacatgcgcggcattatgtagccaggttggcaaattttagtgtcttcagccacgtcttgcacgctggatgtcgcgtatccgctgtttttctgcgcgcgccatcagataccaggcgataaatccgacaattccgaccgcgccgaggatcaatgttgccagggcgttgatttccggattcacccccatccgcacgctggaaaagaccagcatcggtaaagtggtggctcccggcccggaaacaaagctggcgatcaccagatcatcaagcgacaaagtaaaagccagtaaccagccagaaatgatcgcgggcatgatcatcggtagcgtaatgacaaaaaacactttcagcggcgtcgcaccgagatccatcgcggcttcttctatcgagcgatccagttcccgcagacgcgacgaaataacgactgccacataagccgtacagaaagtgacatgcgccagccagatggtgagcataccgcggtccgcaggccagccaatagcatgagcaagcgcgacgaataacaacaacagcgacaaacccgtgatgacatctggcatcaccagcggcgcggtgatcataaaggcaaaaccatttgatccgcgaaacctgccaaaacgcaccaacaccaccgccgcaatcgtcccgaggatcgccgctgccgttgccgcacaggctgcaattgtcagacttaaaccaaccgcactcatcatcgcgtcatcgcgcaataattcgccataccagcgcgttgaccagccggcccacaccgtcaccagtttcgagctgttgaatgaatagataaccagcatcagcattggcgcgtagagaaaggtgaagcccagcagcaaaatcacaatccgccagggcgaacgaacaaccggtaaattattcatccgtgttctcccacgcttttttgctggtgtttgtgaaaccacattatcggcacaattagcagcagcaacatgatgatcgctaccgccgaggctaccggccagtcgcggttgttaaagaactcctgccacagcacgcgcccgatcatgatgctgtccgggccaccgagcagttccgggatcacaaactcgcccacagcagggataaacaccagcatcgatccggcaataatcccccctttggtgagtggcatgatcacggtaaagaacgttttcagcggtcgtgcaccgagatccagtgccgcttctaccagcgaataatcaatacgaatcaacgcggtgtaaatcggcagcaccataaacggcacgtaggcgtaaacaatgccaatataaaccgcaaagttggtatgcagaatggtcagcggttgatcgataacccccagccacagcagaaaattattcagcacaccgttgttttttaatattcccatccaggcgtagacacgaatcagaaacgaggtccacgacggcaggatcaccagtagtaataagatattacgggtcgaaggcttactgtgcgccaccgcccacgccagcggatagccgatcagtaaacagcaaatagtcgaaatcgccgccacctgtaacgactggagataagcatcaaaatagagcggatcgtcggtcagttgcagaaaattaccgagattaagagtgatagaaagttgcccgtcagcccactccatcaattcggtataaggtggaatagcgcgcgccatctccgccaggcttattttaaagacgatcagaaatggcagcagaaacagcaagatcaaccagatatatggcaacgcaatgaccagtttgcgcccatgcttcatttgcagctgcgacaaccacagcttaaatccgcccggcggtttcgactgggcagcaggttcaagtgtactcatctttgctccttaaaccgtcagcaccacacagctgtccacttcccagcacaaacgtacttcgtcgccccaggtcggtaaccctttacgatgacgatgggcgttttgtagctgggcgctgatcatctgcccacttttcagacgaacgtgatacaccgaaagatcgccgagataggcaatgtgtatcacctcccccaccgcgaagttacaaccattggcgggcggctcttcgcaaagcatgattttttccggacgcagcgctacgtgtaccggcacgttatcaaccactgaagcatctgcatcgactttcagtgggtgcaccagtcccggcgaataaagcaccagaccatcttcctgacgctctttgagtacaccttcaaagacattaaccgaaccgataaattcagcgctatagcgggtggtcggatgctcgtagatctcttccggttcgccaatctggacaaatttcccacgattcataatggcgatacgccccgccatggtcatcgcctcttcctgatcgtgggtgaccatcacacaagtcacaccgacacgctccagaatatccaccacttcaagctgcatccggtcacgcagctttttatccagcgcgcccatcggctcatcgagcagtaatagtttcgggcgcttggcaaggcttctggccagggccacacgctgacgctgaccaccggaaagctgatgcggtttgcgtttggcgaactcctgcatatgcaccagcccaagcatctcattgacccggctggcaatttccgctttcggtagtttgtcctgtttcaggccaaaagcgatgttctgttccacggtcatatgcggaaacagcgcgtaagactgaaacatcatattgatggggcgcaggtaaggcggcacctgtgacaaatcgacgccatcgagcataatctgcccggcagaaggttgttcaaaacctgccagcatacgcagcagcgtggacttgccacagccggatgcgcccagcagcgcgaagatttcacctttgtagatggtcaggctgacatcatccaccgcatgttgaccatcgtaggatttggtcaggttacggatttctaatagcggcgtcagcgccttacgggttttcgcctgcgggcgagggatagcgtcattcacggctgctctccggcattgaatgtgtgcaagcgcaccatgatggtgcgaattgccggcgggtgtggtgcgcccgtccggcatctacggctgcggattattttccgctcttcactttggtccacgcgcgggtgcgcacacggtcgattttcgggtcctgcactttcagagtgaacagcttcgcacgaacatccgcaggcggataaatacccgggttatcacggacttccgcactcaccagcggcgtggctgctttattggcgttagcatagaacacatggtcagagatatgtgccaccacatcaggacgcagcaggtaattcaggaactgataggcttcgtctttgtttttggcatccgcaggcatggcgaatacatcaaagaacgccatcgccccttcttttggaatcgagaacgagacattcacgccattcttcgcttccttcgcgcggtttgacgcctgccagacatcgcccgcccagccaatagcgacacagatgtcaccattcgccagatcattgatgtattgggatgaatggaaataacgaatgttcgggcgcagctttaacagcagatcggtagccggtccggtgtaatcatccgctttagtgctgttaggatctttgccgagataattcagcacggtagcaaacacttcttctggcgcatcgaggaaagagacaccgcagcttttcagtttttccagattttcaggtttgaggatcaagtcccagctatcgacgggcgcgttttcgcccagcaccgctttaactttatcgacgttatagccaatcccggtcgtcgcccacatatagggcatagcaaatttattgtcgggatcgtgtttggcgaccaacttcagcagctccggatcgagattcttccactccggcaatttgcttttatccagcggctggaaaactcccgctgtcagctggcgctcaagaaagcttgctgacggcaccaccagatcaaagccggtgctccccgccattaatttgccttccagtacttcgttagaatcgaaaacatcgtagacgactttaataccggtttctttttcaaagttggccaccgtgtccggggcgatataatcagaccagttataaatgtggagtgttttttgttcagccgcgagcgtgctgacagagacggccatcagagcccccgcaaccagacccgatagccattttttatttaaggcggtcatatctctttccttctgaaaattcgttaacaaacgaacaaaagttgtcacactgaaagatatgcaataaacgtgcatatttttatcggcgcggtgtaagaaaagagaactctctcccggcctgcactgctcactatataaaagcatcgcaagaataactttagccagggtttgagactatagctcggattaaaaaacggtatttaacaaatttttatgcgtatttgctctatgtgataaagccaaatcggcacaagagaagtgaattaatctttaataaaaggttaaaaacagcggataattttgcggcacgcagtcactgcggcagcgactgcgtgctcgaaaggagttatcagtggaggaaatagttttcggtaacgttattttgcccttcatcgtcagtcggtaacagcagttgatgggcattagcttcaagaatgaccatcgaaatctgctcttcgctctgacgcacgaaccatgcaaactgctcataggttacgccctgcataacggataaagactggcaaaccaccagctttggcagattatcatcctgcatatcaagaaatgctttcacggtcagcgaactggcattgatggctgataaatccgccgccagcggcaatacggctgaaggtcggacttccgccatggcagaaaacaggatcgtgttatcgatcagatcgattttagcatcaaagacaccgtcgaaattctgcatatggggcagatgcagagcctgacagttatcacattcaaaaaaactcatccccaggtcatcgagccattgacgcaacgtatccagaccaggaacgaccagcgatgtcataattttgtacaacctcttccgataaaaagaccggcacagcttacgcaaaaagcgcaggcaaaaccatgatcagtaatgtgattgcgactaaccacccgttttcaggcaatattctgtcgtagcgtggcgttcgatccagcggatcattttacccgcgatgtcgataccggtggttttttctattccttccagccctggcgacgcattcacttccatcaccaacggcccgcgattagcacgcagaatatccacaccagcaacgtccagcgccatcgttcgcgcggcttttatcgcgatttcacgctcctgtggtgtgatactggcgacgcttgccgcgccgccacgatgcaaattggaacgaaaatcgccctctttcgctcgccgttcaatcgcagcgactacttcatcgccaacaaccagacagcggatatcgcacccttgcgcctctttgatatattcctgcaccagaatatgcgcgttcagaccgcggaaagcgtcaatcacgctttcggccgcctgacgcgtctccgccagcacgacaccaattccctgcgtgccttcaaccagcttgaccaccagcggcgcaccaccgaccatgtcgattaaatcgctggtatcatccggcgaatgcgcaatgcccgtgacaggcaggtcgatgccctgacgcgccagcagttgcatggaacgcaatttgtcacgcgcccgggcaatggcgaccgactcattgagcggatagctccccagcatctcgaactggcgcagtgccgccgtcccataaaaggtaatggcggtgccaatacgcgggatcactgcgtcaaaatggggtaacttgcggcctttgtagtgaatagaagacgccgcaggatttatgttcatgtagcaagaaagcggatcaagaatttcaaccaggtgaccgcgctgtatagcggcttcacgcagccgcttacacgaatagagcgttccatcccgggacaatatggcaattttcactctgcacctctctgtcagacctggtcaaaagcccgcgtatcatacatcgacgtggcagttttagcgcgtcgcccaaccctgtttgtgcaaataatccagaataaatgggcggctttctttaatgattgttcggcggatatgatcgctccaggtatcccggcgattattgctgccacgggtgaggtaatattccgccagttgctcgtcatactgcgccagtgcgtctttatccagcggttgatagctgttttcatgcaccaaaatggaggccggtaaacgcggcttaagatccggattatccgcaggccagccaaggcacagcccaaacagcggcagaacatgctgcggtaatttcagcagttccgtcaccgcttcaatattattgcgcaggccgccgatatataccccgcccaatcccagcgattccgctgcggttaatgcattctgtgccatcattgccgtatcaacgacaccgagcaacagttgttccgccaggccgagctgagcatccggacagatctgtaaatggcggttaaagtcggcacagaacacccaaaactccgccgcttgcgctacgtgtttttgcccgccggtcagcgtcaccagttcttcacgtaacgctttgtcggtaatgcgaataatgctactgcactgcaaaaaactggaactggacgtcgcacgggcgctgttaataatcgcctcacgctgcgcttcggaaatgggttcatcagtgaaatggcgaatggagcgatggccacaaataagttcaatggttggcgtcattatctttttctctttctgaacgtgaatattgcggtggatggttcatcagctgtggggcaagacgttttgccacctgaagaataaccaccaccgcagcgggaagcatgagcaaaacaccgagaaaaatcatcagaatctgcacttctggccgagaaaatggctcaggtagcgacagggagtcgcttaccgacagcagcgccaccgccagcaacatcattccgataaattccagtatcaacacgcttttaggcaatttaccgatcgcgcgcatacgcttccctctgcaaagtgagccttcagtctaaaacttttcactgtattgtgtttaacagttatagcttttatcaattaatgcaacaggttaaacctactttcagcgaatacattttagcgtgatcattacaggcataaatctatgaggagagaaataatgcaaaccgttatttttggtcgtccgggttgcccttactgtgtgcgtgcaaaagatctggctgagaaattgagcaatgaacgcgatgatttccagtatcagtatgtagatattcgtgcggaagggatcactaaagaagatctacaacaaaaggcaggtaaacccgtagaaaccgtgccgcagatttttgtcgatcagcaacatatcggcggctataccgattttgctgcatgggcgaaagagaatctggacgcctgatcgtctgacaagccctcgcgttgagggctttattgattttttctgtgctgtggtttaaacaaactactgataaataagaaacacaatgcccccagcgcacaccagaacaccgcacttaataaccatgccagctcttgccagaatgagcgcgtcggtgaaaaaaacagccgcataatgagcatcgaacagggtgccgccagcattgcgccaaacagaggtttcaggacttctctacgatgtgaaaagaagctggcaactgcaccaggaagaatgaaaaatagcaaaccgatttcaggatgcccggcagcccgaaaagcgcctttcatgtgcgtcgccagaaaaagacacaccacaatgaagaggacaaaacagcagattgcccccgcccaacgttgtttatgtttcactcgttcctcctgacactgcgtctatcgaacacatttttcgccagtgtggcgttcagtaagataaagccgcttcgcattccatgctaatataggccaacgcaattcatatagccgttgatacctaatgtgattacactagtaaaatatattgttactttactatcttttaggtgcgctgaatgaatctgcgccctgaattctggtaaaaaacattatcgtaaattaccatttctttcaacagcttactagtaaacaagaagttagcctccgtgaatataaacgtcgccgaattgttaaatgggaattacattctgttattatttgtggtcctcgcgcttgggctatgtctcgggaaattacgacttggttcgatccaactgggtaattccattggcgttttagtcgtatcgctgttattaggccaacaacatttcagcattaacaccgacgcgcttaatcttggctttatgctgtttattttctgcgtcggggtcgaagccggaccgaactttttttccattttttttcgcgatgggaaaaattacctaatgttagcactggtgatggttggcagtgcgctggtgatcgccttagggttaggtaagctgtttggctgggatattggcctgacggccggtatgttagctggctctatgacgtcgacaccggttctggtcggtgctggcgatacactgcgtcattccggcatggaaagcaggcagctctcactggcactggataatctgagcctcgggtatgccttaacctatttaatcggtctggtgagtttgattgttggtgcgcgttacttgccgaaattgcagcatcaggacttacagaccagcgcccagcaaatcgcccgcgaacgtggcctggacactgatgccaaccgtaaggtttatttaccggtgatccgcgcctaccgcgtcggcccggagctggtggcctggaccgacggcaaaaatctgcgtgaactgggtatttatcgacaaactggctgctacattgaacgtattcgacgtaacgggattctggcgaatccagacggtgatgctgtgctacaaatgggcgatgaaatagcgttggtaggctatcccgacgcccacgcacgactcgatcccagcttccgtaacggcaaagaagttttcgatcgtgaccttctcgacatgcgtatcgtcactgaagaagtggtcgttaaaaaccataacgccgtgggcaaacgtctcgcacaactgaagttgaccgatcacggttgcttccttaaccgcgtcattcgtagccagattgagatgccgatagatgacaacgtcgtgcttaacaaaggtgacgttttacaagtcagcggcgatgcccgtcgcgtaaaaaccatcgccgatcgcatcggctttatctcgattcacagccaggtcactgacttgctggcattctgcgccttctttgttattgggctgatgatcgggatgatcaccttccagttcagcacattcagtttcggcatggggaacgctgccgggttgttattcgccggaattatgctgggatttatgcgcgctaaccacccgaccttcggttacattccgcagggtgcattaagcatggtgaaagagttcggcttaatggtgtttatggcaggcgttggtctgagcgccggtagcggtattaataacggcctgggcgcgattggcggtcagatgttgattgccggattgattgtcagtcttgtgccagtggttatctgtttcttgttcggtgcttatgtattgcgaatgaaccgcgcactgttgttcggcgcaatgatgggcgcacgcacctgcgcgccggcaatggagatcatcagtgatacagctcgcagtaacatcccggcgctgggctatgcgggcacctatgcaatcgccaacgtcctgctgacgctggcagggacaatcatcgtcatggtatggccaggattaggataaaactgaagttgccctgaaaatgaaatttttttgcacaaccgcagaacttttccgcagggcatcagtcttaattagtgccactgcttttctttgatgtccccattttgtggagcccatcaaccccgccatttcggttcaaggttgatgggttttttgttgcctgaaatttatctactacccagcaatcctctcaaccatcctcaaaatctcctcgcgtgatagcggcttacggtcggtgacaaaatgcagcgtcattccctcaataaacgcatcaagcgcgcgggcggttccgggttcaaaccattgttcgagcgtttgttgactgcgctgcatccagttttgcattaccgtttttaagagcggttttcggctagccagcgcgtagagctggtacatcagctccatattatccggcgttgcgacctgtgagctgtagatcatatcggtgatagcctggcatgcgcctggagcatcactaacatcgctaaaaaatgcctgatattgccgggacatgatctcagtaaaacggctgaacgcctccagcaacaactcatcaattcctgaaaaatagtaggtcatcgatcccaacggcaccccggcaagggtagcaattttgcggtgtgtaacagcatgtattccgtaaagtttcaccgcctccagcgtggcctggataattttttctcgccgttgcggatcgttagcgcgacgcatgtcatttcctctctctgcaattgtgtacaaatgtacacagtcttgctaatgttgtcttccctcttcttattttgacgtggtctatgaccgtaaattcttcacgtaatgcattgaaacgccgaacctgggcgctgtttatgttcttctttttgccaggcctgttaatggcgtcctgggcaacccgtacgcctgctatccgcgatattctctctgtctcgatcgctgaaatgggcggtgttctctttggtctgtcgatcggttcgatgagcggtattctctgctcggcgtggttagtgaaacgctttgggacgcgtaatgtcatccttgtgacgatgtcctgcgcattgattgggatgatgatattaagtctggcactctggctgacatcgcccttgctctttgccgttggtctcggcgtctttggggctagttttggttctgcggaagtggcgataaacgttgaaggtgccgccgttgagagagaaatgaataagacggttttaccgatgatgcacggtttttatagcctgggcacgctggcaggcgcaggtgtcgggatggcactgacggcctttggcgttccggcaacggtgcatattttattggcggcgctggtaggcatcgcacctatttatatcgccattcaggcaatccctgacggtacgggcaaaaatgctgccgatggcacccagcatggtgaaaaaggcgtacctttttatcgggatatccagttgctgttgattggtgttgtggtgctggcgatggcctttgccgaaggttctgccaacgactggttacccttattaatggttgatggtcacggttttagccctacttccggctcgctgatttatgccggttttaccctggggatgaccgttggacgctttaccggcggttggttcattgaccgttacagtcgcgttgccgtggttcgggccagtgcactaatgggggcgttgggtattgggctgattatttttgtcgatagcgcctgggtcgctggggtgtctgttgtactttggggactgggtgcctcgttgggcttcccgctgactatttctgccgccagcgataccggccccgatgcaccaacccgcgtcagcgtggtagctacgaccggttatctggctttcctcgtcgggccgccgctgctgggctatctcggcgaacattatggattacgtagtgcaatgctggttgtactggcgctggttattctcgcggctattgtcgcgaaagccgtcgccaaacccgataccaaaacgcagacggcgatggagaatagttgatgagcattaaattaattgcggtagacatggatggtactttcttaagcgatcaaaaaacctataaccgtgagcggtttatggctcagtatcagcaaatgaaagcacaaggcattcgctttgtggtcgccagcgggaatcaatattatcagttgatctctttctttcctgaaattgctaatgaaattgcctttgtggctgaaaacggcggctgggtagtgagcgaaggcaaagatgtttttaatggcgagctgtcgaaggatgcgtttactactgtcgtagaacatttgctgacgcgcccggaagtggaaattattgcctgcggaaaaaatagcgcctataccctcaaaaaatatgacgatgccatgaaaacggtggcggaaatgtattatcaccgtctggaatacgtcgataactttgacaacttagaagatatcttctttaaatttggccttaatctctctgacgaactgatcccacaagtgcaaaaagcattacatgaggccatcggcgatatcatggtaccggtccataccggcaacggcagcatcgatctgattatccccggtgtacataaagccaatggccttcgccaactgcagaaattatggggaatagacgacagcgaagtggtggtctttggcgatggcggtaacgatattgagatgctgcgtcaggcaggctttagttttgcaatggaaaatgccggcagcgcggtcgtcgcagcggcaaaataccgggcaggctccaataaccgtgaaggcgtactggatgtgatcgataaagtgcttaaacacgaagcgccatttaaccaataaaacggcagcacgcccggcaacacaatgcctgaatgaagattgcataattcgcggaaattaacccgctgcattatttcaggcgaaatgattatgaaaaattgtctactgttgggcgcgcttttaatgggctttactggtgtggcgatggcgcaaagtgtcaccgtcgatgtgccgagtggatacaaagtggttgtggttcctgattcagtcagcgtcgcgactgtgccgcaaaccgtctatgtggctcctgcgccagctccggcttaccgcccgcatccttatgttcgccatcttgccagcgtaggtgaagggatggttatcgaacaccagattgacgaccatcaccattaattcgagaatgcctgatcgcacaaagcaatcaggcatttttttacccttcgtgcgaatttcccatctgtttatcttttaaaaagataaccatcagcgacagccacaaaatgccgttgacaaggttgaagagattaaacagtccgttgcccccgttcagccaggcatgtttgctgatttcaataccgacggtaaagatcagcatttgcagcatccccatcgccgcagaaaccgtacctttactcatatcgctggcaaacagggttaatcgcaccagtcccgcattcgccagaccaataccgaaagcataaatacttaacccggcggtcatccataaatacgcgtgcgatgagataaccgttgccgcagcagcgaccaacagaccaatcataatcggccagccgcccataataatcagcgaacgtacggtgcggcgcgaggtcagacgcgctaacagcaagttacccgcaattaacgccccgaaaataggcacttgcagcaagccatattcatagctgctcaactgctcaccggtaataatgataatcggcgactgggcgatccacgccaacaacggcaggctaacgaatcccagcgccagcgcccccgccacaaagcggccgttcttcagcaccaacttatagtcacgaccgagttctttcagcgacagtttctcgcctatacgcgtggcggtttcaggcatagctcgttgcagaccgaaaaaggagatcgctgccaatgcggcaaacaagacaaacatcccttcccagggcagcacatggatccacgccgcgcccaccagcggaccaagtagtggagcaatcagcgccacgttcgccattagcgcggtgatcttgatacaaacggcctcttcgaaggattcctgaattgcggcgtatcccacagcgccaatgaaacagaggcttatgccctgcaagaagcgcaacagggtgaattgttcaatgttttgcgccagtaatattgccagacaggtgacgataaaccacaccactcccgccaacatcaccggacggcggccaatacgatccgacaacggccccaggagccattgtaaaaacatcccgcccgccagatacgcagtcatcgaagtaggaacccaatcaatgcccgcctgatattgttccaccacggccaacataccgggttgaatcatatcgttgccgatataggttgaaaattcgtaaagcaccagacagagagggaaaagtaacgcctgacgtccaagcctggcaccggaagctaatttattttgcatgcaatttcttcgccaataataatcgcgcaaagtttaataaaagcgcagctaacgagaaagcgaattttgtagctgaaaccacggttaagcacattcttacattattgcgagtatagctacgctttctttaagttttatttaacctttgcccgttacaatcacctaccgtaaacaggccgcttgagggaaataagacgatgccgctttacccagtttaacctgcactttattctcaacgacttgcctgtattggctcccttttaatcactttgcgtcgggaagttatgctggaaaatttgaatctctctctattctctcttattaacgcaacgccagactctgcgccgtggatgatctcgttggcgatttttattgctaaagatttgattaccgtggtgccgttgctggccgcagtactttggttgtgggggcttacagcacaacggcaactggtgataaaaatcgctatcgcgctggcggtcagcctgtttgtgtcctggacgatgggacatctttttccgcacgaccgaccctttgtcgaaaatatcggctataacttcctgcatcatgcggcggatgactcattcccgagcgatcacggtacggtgattttcacctttgcactggcatttttatgctggcatcgcctgtggtccggctcacttttaatggtgctggccgtcgtcattgcctggtcgcgcgtttatcttggcgtccactggccgctggatatgctcggtggattgctggcaggtatgattggctgccttagcgcccagattatctggcaagcgatggggcataaactctatcaacgtctgcaatcgtggtatcgcttctgttttgcattaccgatccgcaaaggctgggtgcgtgactgatctctgctaaaaagtgtagtattgagcggctcgcttcaataactattcagagggattatggaaacacgtcgcgaagagcgtatcgggcagctgctgcaagaattaaaacgcagtgataagttacatcttaaagacgccgccgccctgcttggggtttcggagatgacgattcgtcgcgatctgaacaaccacagtgcgcccgtcgttttgctcggcggctatattgttctggaaccacgcagcgccagccattacctgttaagcgatcaaaaatcccgcctggtggaagaaaaacgccgggcggcaaaactggctgcgacgctggtagaacccgatcagaccctcttttttgactgtggcaccaccacgccgtggattattgaagcaattgataatgaaatcccttttaccgccgtttgttattcgctaaatacctttctggcgctgaaagagaaaccccattgccgcgcgtttctttgcggtggtgaatttcacgccagcaacgccattttcaaacccatcgattttcagcaaacgctgaataatttttgcccggatatcgctttttattccgctgcgggcgtgcatgtcagtaaaggcgctacctgctttaatcttgaagagttgccggtaaaacactgggccatgtcgatggcgcaaaagcatgtgctggttgtcgaccacagtaaatttggcaaggtgcgtccggcgcgcatgggtgacctgaaacgctttgatattgttgtgagcgattgttgcccggaagatgagtatgtgaagtacgcgcagacgcagcgtattaagttgatgtattaatgacgtataaccggatgacgtttcgcgccatccggttatcagaagattaagagaaccagctgccgaaccactgatggaatttcatcatcacgaaatcccacatccgaccaaagaatccgccctcttccacattttccatcacgatcagcggacgctgctcaatggatttaccgttaagctggaaatcaatggtgccgacaacctgaccttttttcagcggtgcggtaagctgcggttccattaacgtataactcgccttcaggtttttcagctgcccacgcggtatggtcactgagcccgcttcgcctgccccgagattcacttcgctcttatcaccaaaccagacgcgctgagtcacaaatgtggcatcaggtttaattggcgtcacggtttcaaagaagcggaaaccccaggtcaataatttctcagactcattaaaacggatacggtcagttttcgcccccagcactacggagattaaacgcatatcgccctgggtagccgaagcaaccagattatatcccgcgcctgccgtggttcctgtcttcatgccatcaacattcagattgctgctccacagcagacgattacggttaggctgacgaattttgttgaaggtgaactctttctctttatgaatggcgtactcttccggcacatcgtggatcaatgctttacccagcaatgccatatcgcgcgcggtactgaactgccccggcgcatccaggccgtgcaccgtctggaaggtagtgttggtcagacccagttttttggcataaccattcatcaaaccaataaatgactcctggctcccggcaacgtaatcagccagcgcaatacaggcgtcattaccggactggataatcacacctttgttcaagtctgccaccgaaacctgatcgcccggtttgaggaacattaccgatgaaccacgcagtgccggatttcccgtcgcccaggcatctttaccgaccgtcaccatatcggtgagtttaatcttatcggccttaagcgcctgcccaaccacatagctggtcatgattttagtcaggctcgcgggatccagtttctcatccgcattgccttctgccagcactttaccgctggcgtaatccattaaaatccatg

SEQ ID NO: 10010 - DNA, 30487 bp, Escherichia coli
ttatgctataacaccaccctatatatgacccgaaccgggttgaagcaccaatcaaacggaacaggatgcaaaaatggttactttccacaccaatcacggcgatattgtcatcaaaacttttgacgataaagcacctgaaacagttaaaaacttcctggactactgccgcgaaggtttttacaacaacaccattttccaccgtgttatcaacggctttatgattcagggcggcggttttgaaccgggcatgaaacaaaaagccaccaaagacccgatcaaaaacgaagcgaacaacggtctgaaaaatacccgtggtacgctggcaatggcccgtactcaggcaccgcactctgcaactgcccagttcttcatcaacgtggttgataacgacttcctgaacttctctggcgaaagcctgcaaggttggggctactgcgtatttgctgaagtggttgaaggcatggacgtggtagacaaaatcaaaggtgtggcaaccggtcgtagcggtatgcaccaggacgtgccaaaagaagacgttatcattgaaagcgtgaccgttagcgagtaatcgtggcgacactctttattgcagatcttcatctctgcgtggaagaaccggcgatcaccgccggttttctgcgttttttagcgggggaggcccgcaaggccgatgcgctgtatattcttggcgatctgtttgaagcctggatcggcgacgacgatcccaacccacttcatcaccagatggccgcagcaatcaaagcggtatccgattccggcgttccctgttatttcattcatggcaaccgtgattttctgctcggcaaacgctttgcccgtgaaagcggcatgacgttattgccggaagaaaaggtgctcgaactttatggtcgtcgggtgttgattatgcatggcgacacgctgtgcaccgatgacgcgggttatcaggcttttcgcgccaaagtccacaaaccctggctgcaaacgctatttctcgccctgccgttgtttgtgcgcaaacgcattgccgcgcgaatgcgcgcgaacagcaaagaagccaacagcagtaaatcgctggcgatcatggacgttaaccaaaacgcggtggtcagtgcgatggaaaaacatcaagtgcaatggctgatccacgggcatacccatcgcccggcggtgcatgaacttatcgccaatcagcaacctgcttttcgcgtggtactgggtgcctggcatacagaaggttcgatggtgaaagtcacggcggatgacgttgagctgattcattttcctttctgaccacgaatggacagattctgaaaaagcaccgaactaacgcaacctgtatatcttttttaaaatcagcaaggtaataatctctgagtgaaataacaacagggaatattattatgcaacgctgcaacggatttttgatttctggcatcgcccttacggcaggagcgccactgtgtattagctggttcggtcttgtcggcttctattttggcgcattgtcactggtagctgcggcggtcatttcctggatagtctatttctggctcatttatttagtactcacccgcccccataaccaacgttttgtagaaagatttatattgattgtcggtatttgcttttttccatggagcattgtgttgatatgggcattctttgccagttcagccagagcgcataatcaacacgcagaacaaattaaaaactcaacaactgacggttaattccgcctacgcaaccgttttccttgcactctttccgtgctattctctgtgccctctaaagccgagagttgtgcaccacaggagttttaagacgcatgtcttcccgcaataatccggcgcgtgtcgccatcgtgatggggtccaaaagcgactgggctaccatgcagttcgccgccgaaatcttcgaaatcctgaatgtcccgcaccacgttgaagtggtttctgctcaccgcacccccgataaactgttcagcttcgccgaaagcgccgaagagaacggttatcaggtgattattgcgggcgcaggcggcgcagcgcacctgcctggcatgattgccgccaaaacgctggtgccggtgctgggcgtgccagtacagagcgccgcactgagcggtgtcgatagcctctactccatcgtacaaatgccgcgcggcattccggtgggtacgctggcgattggtaaagctggcgcggcaaacgcggcgttactggcagcacaaattcttgcgactcatgataaagaactgcaccagcgtctgaatgaatggcgcaaagcacaaactgatgaagtgctggaaaacccggacccgcgaggtgcggcatgaaacaggtttgcgtcctcggtaacgggcagttaggccgtatgctgcgtcaggcaggcgaaccgttaggcattgctgtctggccagtcgggctggacgctgaaccggcggcggtgccttttcaacaaagcgtgattaccgctgagatagaacgctggccggaaaccgcattaacccgcgagctggcgcgccatccggcctttgtgaaccgcgatgtgttcccgattattgctgaccgtctgactcagaagcagcttttcgataagctccacctgccgaccgcaccgtggcagttactttccgaacacagcgagtggcctgcggtgtttgatcgtttaggtgagctggcgattgttaaacgtcgcactggtggctatgacggacgcggtcaatggcgtttacgcgccgatgaaaccgaacagttaccggctgaatgctacggcgaatgtattgtcgagcagggcataaacttctcaggtgaagtgtcgctggttggcgcgcgcggctttgatggcagcaccgtgttttatccgctgacgcataacctgcatcagaacggcattttgcgcaccagcgtcgctttcccgcaggccaatgcacagcaacaggcgcaagctgaagagatgttgtcggcgattatgcaggagctgagctatgtgggcgtgatggcgatggagtgttttgtcacgccgcaaggtctgctgatcaacgaactggctccgcgtgtgcataacagtgggcactggacacaaaacggtgccagcatcagccagtttgagctacatctgcgggcgattaccgatctgccgttaccgcaaccagtagtgaataatccgtcggtgatgatcaatctgattggtagcgatctgaattatgactggctgaaactgccgcttgtgcatctgcactggtacgacaaagaagtccgtccgggccgtaaagtggggcatttgaatttgaccgacagcgacacatcgcgtctgaccgcgacgctggaagccttaatcccactgctgccgccggagtatgccagcggcgtgatgtgggcgcagagcaagttcagttaacctggtgcacaaacctgcttaaaagctaatgcgcaagcagttttccccctcaccctaaccctctccccacaggggcgaggggactgtccgcgttcttatttggggtttggaatctttctcagagccttaattcttgccaaataccccaatcactacagcgaaatacaagtccccgcttcgcccgccagcgtctcttcaatccgcgataacgccccaatccacgcgggtttaccacggcttctgacataaccactcaccgccgttaccttcggccccatcgaaccatcggctttggcaaatggcgctaactcatccggtgtggcacggcgaatggcacgttgctgcggcgttccccagttttcatataccgcatcagcatcggtgaggatcaccagtccatcggcattaatctgctcggcgagcaacgcagcggcgagatctttatcaatcaccgcttcactccctgccccgtcttccgccacaggcacaccgccgccgccactgcaaatcaccacatgcccctctttgagcaacaactcgatggcttcgctgtcgagaattttacgcggttgcggagacgctaccacccggcgtaaatatttaccatcacgtttcatctgccagccgtaagccgcttccagtgcctcttgttcttctggctgataaaccggaccaataaatttctctggctgtaaaaacgccggatcatcaggcgaaacctcaatgcgcgtcagcaccgtcgtgacaggcggcatctgcggctgtgcgctcaagccctgcgccagcatatagccaatcatcccctggctttccgccaccagtacatccagcggatacggttctacctctttccacgccagattctgtaacgccagcagccccacctgcggcccgttgccgtgaacaatcgccagccgataagaacgggccaggcgcgccagcgcgggtacagcactggcaatattgcgatattgattttttgccgtcagcgcctcaccgcgctggagtaaggcgttgcccccaagagccacaaccagtgttttcatggtttcccttgtaataattgttggccaagccagaaccccagcagcgtatcggcccctgacgtatgccccagcgccagcagcgaatcgatcgccgctgcggtacgtttcgggcaactcagagcatgaacaaagtgcaggagtggcgaggcgaaatatccttgcgcggcataacgtaaataactgacgctcaccgcagtggtaacgagttgaagattgtcggaacaggcaaaaaacgggcgaccggagcgcgcatctaaagcgccataataccaggccgccagcagcattccgctcagcgtgtcatcatgacttggcgttaatccggggcctttacccagccagtgccgccagtcggtcttaacgccattgagcgcggcctgaaaacagtgacgaaactggcgtaattcagcaggcagcggatcgcttgccgccaatgccagtggcccgaaaagcccggtttcctccgcgcgttgcatccatgcaacggcaagcggttgaggatgcgcaggcggcgtaatacgtagcaaacaataacgctgtggctgtttaaccgtgaaacgcccgagacgaatcccttgtgccacaacctgtggtcgttcattgccgcataatccaccgcataacgcatcgaattgcgcgcggcgaagcacccatccgccggggccgaaaccactcccctgacgatgcagcgttaacagttcgccgctttccgtcatcaggttaatcgcccgccgccacactcccgctaaccgccaggactggcgataattcggtgcgctacggctggcaagtagaggatggatgatcgtcattgtgcgttcctcaaccaatccccatgctttcagccagtgcttccagcgcctgttcaaagcacgccagcggtgcccgcacggtgcctgcgccaatctgcccgatccccgcctctttatgggcgataccggtattgatgagtggcgtaatgccggtttctaccacgcgacgaatgtccagccccaggcacgccccctggaaatcccagccggggatctgcaattgcatattgcgttcaaggtaaatttccgccatctcttcagataccgctctggccgcttccatgccacccgcaccgacaaagcgcgttacgccaggtgcggcgatcattgccgcacctccgataccaaaggtttcggtaatcgcgctatcgcccatatccgggttcgcctgctcctgcgagaagccggtgaaaaacagaccttgcggagtgtttacaggcgccgtaaaccagcgttcacccagcccgctgacccgaatcccgaacatattgccgttgcgggtcatagccgtaacgatgctgcctgcgcggatcatcgcgcctgcatccatcgccgccttgcagtaggccatcgcgaggttgaggaagaactgatcggtcacgctgaggaaatccatcacttccgcaatgtgctgtttatcatgatcgaggcgagcaatttgtggagccagcgcacgcattaacagtgcagaggaagcaatattgcgttgatggaactcatcgcccatggtaatgccctgcgccatcattgccgtgagatcgataccgcgctccatgcgccccagcgccgcgcttaatactggcattaacacatcgcgcatccagcgatggcgagtcaggacatcttcgccgtaagcgccaaaacgcatcacttttccgataccttcgttgaggttgcagtacgcccggttgccgtcggtcacgttctcgaccaccagcatcggcatactggcagaagtaatgccacccattggcccgacagcattcacatggtgacaaggaatgaagttcacttccccctactccagcattgcctgtgcctgcgcttcatctttcgcccagccttcgaacagacatgcgcccacgcacgcccctttcattggcccggtcatctcctgccagcgcattggcggcccggcgtgaagcagtgttttgcccttgtttagttcgctgataagtgaagaagccggttgcacatccagccagtgtggacgagcgcgacgaatttgttcgataaccgcagcattggcttgcgccactgatgtaaacatgggaaccccttattgcaaacgttctaataaacgagccagttttttattgccgccggcgactggcgaccattggtaatgcacaaccggtttgctggcgctttgtagctccagcgcaaagctgcgtaatccgatgttaatcacggcgacgttttccagtaatgacggtgtgtgttgctgtgtggctgacgggagcggatgaattaacgccgcagccagcaaggtggcttccggtagcgaactcactaccgcgatccccgcatcttccagcgtggcgatttgctgcgagcggcattgcgggtcacgttcagtgcctgtcaccgtggcaatggcatacagtggttgattgtctgaacgcgcggcacaggctttttgccaggcgctcaccagcgaggcggcaggatcggcggtcgcaccgaagccaatcacgacatcaagcagcaacacgcgcacttgcggtttagcgccgagatcggcaattaacaggttgcgtaaggtcgggtcgatcatcggatggggacgcccgacggtgtaaaaatcatcgcccaggtcgaggatctgatgtccgtcggcgtccagcatcatgccatgttgatgggtatcgtcggcttccacgccaaggtgtccggcaagtaatcccgccgcttcagcagccagcgtaccgccggtatacaaaccgcaaataaatccgctgctgacaggcgctatcgcgttacgtcgcgcagtgacgcgtgaaagcagacaagccagacgagcggcctcatccagcgaggaggcaaaccagacattctcgtcgcgggccaccgccggggtataacctaaaaacagcgccaccgtcggtttgccagttgctttcatggcattaacaattttcagacgcacagtttcggcaggtggttttgaaacaaatgccagcacttcgcttttctcgtctgcactgagcatttccagcgccgttagcgcactgatgccgcccacttcacggctgagatcgcgcccgccaagaccaatcgcgtgagtaattccctcccctgccagcgcaatctgtgagcacagctcctgaatcccggtaccggaagcgcctatgacgccaatgttgccttccggcatcacgttagcaaaagccagcggcgtggcggcaatcatcgacgtaccgcagtctggccccatcaccagcaagcctttttcccgcgcgcgggttttaagttggatttcatcttccagcgtgacgttatcggagaacatcatcacgttgaggttgcgatccagcgcctggttcgccagctccgccgcatactcaccagccactgaaatcagcgccagattggcatcgggtaatttctgactggcactgtcccagcgacgcacctgcgtcaacgcctggctgctgcctgaaccctgcgccagttgttttagcgcctcttcaagctgctgcataaccgcctgcgcgatccccgcatccgccgcttcgctacgaattgccacgcaaatatcgttcggcgtggcgtgattaaaatcgtcatgccagaaacctgtagtatctaataacgctttattggcgggcgtacccatcattacggaaacatcatcaacattttctgattcgctgagttttcgtgaaataatcattaaactgaccgaatcctgaaaacacccttttttaataaaggcgtggatcataacaactccttaaaaattgcacccatggcaattgcacgagcagtgttaatgtggcgattacggtatcgatgacaacgagtaaataaggtgatgaatatcacacagggattattaacaaaagaattcaaataaccgccgggctattacgcgttattttttaataagcgtggttgttttaaaaaccaggttaaaagcgagcggattatcaaataaattctaactatatttttttgcctgtctggatcacataatccagatattttccctgtatgttaattgcagtcatgcttcacatcgtcgttaaaaaggaagacagatgaaaatcagtcgggaaacactccaccagctaatcgagaataaactctgccaggctgggttaaaacgtgagcacgctgcaaccgtggctgaagtattggtttacgccgatgccagagggatccactctcatggcgcggtgcgcgttgaatactacgccgaacgcatttcaaaaggcggcaccaaccgcgaaccggagtttcgtcttgaggaaaccggaccgtgctcggcaattttacatgccgacaatgccgccggacaggtcgcagcgaaaatgggtatggaacatgccatcaaaaccgcccagcaaaaaggcgttgcggtggtcggtatcagccggatgggtcacagcggcgcaatctcttattttgtgcagcaggcagcccgcgccggattaattggcatttcgctgtgccagtccgatccaatggtggtgccgtttggcggcgcggaaatttactacggcactaacccactggcctttgccgcgccgggagaaggcgacgagatccttacctttgatatggcgactaccgtacaggcatggggaaaagtgctcgacgcccgctcgcgcaatatgtctatcccggatacctgggcagtcgataaaaacggtgcaccaacaaccgatccgttcgcggtacatgctctgctccccgccgctgggccgaaagggtatggcctgatgatgatgattgacgtcctctcaggcgtcttactcggcttaccgttcgggcgacaggttagttcgatgtatgacgatttacacgccgggcgtaatttggggcaattacatatagttattaacccgaactttttctcctccagcgaattattccgtcaacatcttagccagaccatgcgcgaattaaataccattacccccgcgcccggttttaatcaggtttattatcccggacaggatcaggatattaaacaacgaaaagccgccgtcgaaggcatcgaaattgttgatgatatttaccagtatttaatttccgacgcgctttataacacgtcatacgaaacgaaaaatccctttgcgcaataattattgagacaggactttcttatgattacacatttccgtcaagctatagaagaaacgctgccctggctttcctcttttggcgctgacccagcgggtgggatgacccgtttactttattcgccggaatggctggaaacccagcagcagtttaaaaaaagaatggcagcaagcgggctggaaacacgtttcgatgaagtggggaatttatacggtcgcctgagtggcaccgaatatccacaggaagtggttctgagcggttcgcatatcgataccgtggttaacggcggtaacctcgacgggcaattcggtgcgctggcggcgtggctggctattgactggctgaaaacgcaatacggcgcgccgttacgtacggtcgaagtggtggcgatggcagaagaagaaggcagccgcttcccgtatgttttctggggcagtaaaaatatttttgggctggcgaatcctgacgacgtgcggaatatctgtgatgccaaaggaaatagttttgtcgatgcgatgaaggcttgcggatttactctgccgaacgccccactaactccgcgtcaggatattaaagcctttgtcgaactgcatatcgaacagggctgtgtgctggaaagtaatgggcaatcaattggcgtggtgaatgcaattgtcgggcagcgtcgttatacggtgacgctgaatggcgaatcaaaccatgcaggcaccacgccgatgggttatcgtcgtgatacggtttacgctttcagtcgcatttgccatcagtctgtcgaaaaagcgaaaaagatgggcgacccgctggttctgacctttggcaaagtagagccgcgcccgaatacggtgaatgtagtgccgggtaaaaccacgttcaccattgattgtcgtcataccgacgctaccgtgctgcgcgatttcacccaacagttagaaaacgacatgcgggcgatttgcgatgaaatggatattggtattgatatcgatttatggatggacgaagaacccgtgccgatgaataaggagctggtcgccaccctgacagaattgtgtgaaagcgaaaaactgaattaccgggtgatgcacagtggtgccgggcacgacgcgcaaattttcgcgcctcgcgtgccgacctgcatgattttcattcccagcatcaacgggatcagccataacccggcggaacgcaccaatattaccgaccttgccgaaggggtcaaaacgttggcactcatgctttatcaacttgcctggcagaaataaggagttataaatgggatatttaaataacgtcaccggttaccgcgaagatttactggctaaccgtgcgattgttaaacacggtaatttcgcactgttaacaccagacggtctggtaaaaaatattattccgggctttgaaaattgtgacgcgacaatcctctccacgccaaagctgggtgcctcttttgttgattatctggtcacactgcatcaaaacggcggcaaccaacagggcttcggtggcgaaggcattgaaacgttcctgtatgtgatctctggaaatatcactgccaaagccgaagggaaaacatttgtcttaagcgaaggtggctatctttattgcccgccaggctccttaatgacgtttgttaacgcccaggccgaagacagccaaatctttttatataagcgtcgctatattccggtagaaggtcatgcgccgtggctggtttctggcaatgccagcgaactggaacgcattcattatgaaggcatggacgatgttattctgctggattttctgcccaaagagttaggttttgatatgaacatgcatatcctctcttttgcaccaggtgccagccacggttatatcgaaacccatgttcaggaacacggtgcctatattctttccggtcagggggtttataacctcgacaataactggatcccggtgaaaaaaggcgattacatctttatgggcgcttattctttacaggctggttatggcgtagggcgtggtgaagcgttcagctatatttactcgaaagattgcaaccgcgacgtagagatttaagtcataccactcgcctgattatttttagctatgttggattttgccacggtttataccgtggctttttttgtagtcaattcaggtaaaaaaagatgcgatataaatcgcatccgctttaaaggtaatagtcagtttttaattccctgacctattttaatggcgcaggcaatatttcgcgcactgttgaagagattggtttcaccgctggcgagcacttcggctaaaggtgccagacgtggcaaaatgctgaataccgcatcaatgccgtactggtgcaccacttccacgccatcacccaatacgccagcaatcccaatcaccgggacattaaactgcttcgccaccgacgccacgcccagcggagctttaccgcctgccgtttgcgagtcgatgcgcccttccccggtgatcaccagtgctgcaccctgcaccgcctgcgccagattgaccgcattcaacacaatctcaatacccggtttaatatccgcattgaggaataccgccgccgcaatgcccataccgcccgcagcgccgccgcccgccatctggcagacattaatttcagtttgctgttgtaaaacacgggcgtaattttgcagcccctgttccagttcttcgaccatttccggcgttgcccctttttgcggaccaaacaccgccgccgcgccgcgtgcccctaccagcgggttatcaacatcacatgctacttcaatatggcagttcgccagacgcggatcgcattcatccatctcaatgcttgccacgcgcgctaaattgccgccgttagccgccagcacctgaccgtcagcatcaaggaaacgcacaccgagcgcctgcgccatgcccataccgccgtcgaccgtcgcactgccgccaatgccgagaataatatggcgaatgccgttatccagcgcatgacgaatcagctctccggtgccaaaacttgacgccagcaacggattacgcttttcaggcgcgaccagcatcaggccgcttgccgccgccatctcaatcaccgccgttttcccgtcgccggtaaggccataaaaagcattcactgtttcgcccatcggcccgcagacttcaagcgtcacgatgttgccgcccgtcgcggcgaccatcgcctccaccgtcccttcgccgccatccgctatcggcaaacagatatagtgcgcatcgggaaatatggtcgaaaacccggctttaattgcctgacaacatttttctgcacttaaactctctttaaacgagtctggcgcaatgacaattttcattatcaatcctttttcaacaaattattcgatgcgttcccacggaataagattatccataagaacagccagtaaaatcccgaccagtaagccgttactgagcagaggacgcagcgttaatggaaggtcttgcagatacacaggcggtaatgccattaaaaatatgccgacaaataacggcaatgcgagtcgataaatattgcgagcggtaaaggttatttgctggctaaacaccagcgcggaaaagagtaaaggcagataagaaaccagcatgaccgcactactcacgggtaaagggatactgcaaaacagtcgcgtgagtgccggaaccagtgccaccagcaggcaaataacgctgccataaataaacgaacgccgcgtgtaatcgcctgtctgggttaataaaccaatggatgaaacaaacggtgaaaatggaattaccgccagcggcacagttatcagtgtcataaatccggtcgccacaaagctgcgacgataacgcgtattccccgcgccctgctgcggataaaaaacatccgtgccccgaatcgcaccgtaggtattgctgatatttaccagacctgtaatcaccgccgtcagaataatccccggcgacaaagcaccgccactgccgagcgggaaccactgccagtgcaactcaccggagagcgaatgcgaagaaggaaagcaaaagtaccacaacaaccagccggttatcgtaccgaccagcaggccgtaacgggcaaaacgttgtggcaggaaaataatcatcgccagtaccaggcacatcaccgccaccgagagcgcgaacggcggtaattgaattttaaaattcgggtcggctatgccaaacggcagcccgagcatacctttgaaaaagatagtggtcagttgcgcacccagcatcaacataaacaagaccatcaccgacggcgtaaataaccgtgccaggcgatggcctaatccgctaaaaccaatcaacatcgtcagcacgccggagagcgcaatccccaccgccagactggtagcgatatcgttgatcggtgtcccgcgcgatgcttcgccaagggtgatagtcaggatggttccccaccacaggccgcccggcccctccataatagcgcgacgatgaccgcagaacgcctgagcgaagcaggccagtgcggtagcaagaaaagcatattgcgtgagcgtaagcaggctactttgcggcaactgaaaagcagaaagtagcgtaggaggaaccacaaccgtgttgcaaaaaataaagaaaaaccactgaaatcctgataacaggctttcgcggcccactgcaaaattgaacataaacacaccttaaccggagaatgcccgccacaaggacgggcattgcagggccagattactgctgatgtttaaggataaattgacctttcggcgcaacagggaagccctgttcgatatcgtaaatcacatcaccacgtaagatggttttcgtgatacgcgcgccaatagtacggccaacatacgggctgactttgtggcgatattccagatcgtcattggtaagaacatagctgctattcggctgaatgaagacgaagtcggcatcttttcctggggcgatacggcctttttgctgcagaccgaaaatatctgctgcgttagtcgccattaatttgccgaacattggcagagacattccgcgtttctgtaccgcttcatcgaacatcacgtccatgcagctttgcagaccagcgataccgccccacgctttcattatgttaccggctttcatttccggcgggcatggagagtggtcggaaaccaggcagtctatttcaccgttaaacagtttttcccacatgcctttctggttttccagatcgcggatcggcggtgaacacttcgccagagtaccgatttcttcgaactgatcggtatccagcacaaagtaatgcgggcaggattcacaagtaacatcctgaccttcctgacgtgcacgagtcacttcctcaacaccttccgggctgctgacgtggcaaacgtgcagacggcaaccagcgactttcgccaggtacagtacgcggcgaatcgcttccacttcggtaaataccggacgcgaagccacatagtcatgggcagttacgcgaccttcacgcttcgcttcttcgcccagtgcgtcacagatcagcgcgttttcgcagtgcaccagcaccggctggcctagttcacccagcttctgcgcgcctttgaagaattgccagtcattgacgtcacggaagtcgttgtcgataccgcgatcgccacaggtcgcaacgaagcatttgaaaccgacaacacccacttcatccaactcatgcagacggtcaatgttgtaagacaccaggccaccgagttgtgccgcatcgatagtcagctttcctttagcggcatcgaacttcaattcaattgaggcgcggtcaaccgttgcaggcagctggttgagcggcatttcgatcatggtggtgataccaccttttgctgctgcgcgagtaccggtttcataaccttcccagtggctgcgacccggttcagaaatatgggtgtgcgcatcaaccatgcccggcgaaaccaccagaccagacgcatccataacgtcttttgcatcgcccagatcctggccgatagcagcaatttttccgtctttaacggcgatatctacaacgcgagcttcgttttctaaaataacggtgccgtttttaatgattaaatcaaaagacataacaaactccttgtaaaatacagattggtttttaactcaatgttcaatatcgtgattaattaacctatggttttttgttctcctgttttttctgctgttgtacgtttctttaataaggcgtaggccgcaaaggcgacgatgacgccgacaaaccatgaaacacgtgataacggttccataaagggaataaacttaccgccaagagataaaataacggccaccagagttactgaaaacgcggtgaggttaaaaccgttatcgtaatatttataatcgccaggtgcggtgtacagttcatcaagattaatttgcccacgcatcacgacaaaataatgcgccatcatcacaccaattaccggaccaagcattccgccgataatatcgaggaacagataaatactgtcctgattttccattaatttccacgggcagatcagcaggctgataatactggcaatcagtacgccgtttttataggtcagtttcgtcggtgcaatggcggcaatctgataaccagccggaataatattaccggtggcgttagtagagatagtcgtcatcagaataaccagtaccgcaaagaacgaggcgaacaggctgtcccaacgctgaacaatatccagcacgttccaggtgtcagcgccgtaatgaatactggctccggcaataatacataccccggcgaccgcaaacagaatataggccacaactaaacccagcgtttgccccagcgcctgctcacgaaacgagtgggcgttttgcgtaaagtcggatgcgctcaccgccggtgccgcccagaccgcaaccaccgcgtttatcaccaccagaaacaggaagccactgttttctgctttctgaataccgcccggaatgtagtcaaagattggaccgatcccgaccagcgaaatcgcccaaatcgccataccgccgaaaacgatatagatgcacgggttaagaatggcagtgaatttatttaaaacttttccgccgccaaaaccaataccaacgttaaccagccagaagagtaaaaaagtaattaatcccggtagagaaaggcctaacagcgtgaaatcgccaccgagagtcaaaaatcccggccagattttgccaatcagaatcaagcaggccagtgaccccgcgtaacattgcaggccaaaccacataatggcagcaataccgcctcttaataatccgggaaacagtgcaccacgtacgccgtaagaagcacgcaggatcatggcaaacggtacgccgtatttactgcccgcagcaccgtttaataccattaccgcggcaatgaaaaaggcactgaggataattgccagcataatactaaaggtagacaagccgagaataaaaaagccgccaaccatcacataattgggaacgttatgaaccgaacccatccataaggtaaaatagttaaatgttttccaggtccgctgactttgcgttttcggcagtagatcttcgctatagccgcgttgctggaatagttttctctgatgttccataaatccctcttaatttcacgtatcgaataacgttgttttaatctagctatgaggaacaaataaaataaaaatattatttttaatactgaagcaacatctttggctgctttctttttttaatattgctggccgattcattttctgatatcggccatttttattgcgggtatcaggccagtttatggttagccattaattccagcgcctgcactaacgcagagtgatccaactggctgccaccgtttgccgcacaggtattaaacaattcctggcaggtcgcggtgtttggcaggttcagcgccagtgctttcgcactttgcagtgccaggttgagatctttctggtgcagcgcaattttgaaacctggattaaaggtgcgtttaatcatgcgctcaccgtgaacttccagaatacgtgaggaagcaaagccgcccatcagcgcctggcgcacacgtaccgggtccgcaccggcttttgaagcaaacaacaaggcttcagaaaccgcttcaatattgagcgccacgataatctgatttgccactttgcaggtttgaccgtcgccgttaccgcccacgagagtgatatttttaccgagcagttcaaacagcggttttacacgttcaaatactgcttcatcaccgccaaccataatcgataacgtcccttcacgcgcgccgatttcaccgccggagactggcgcatcgagataatcgccgcccagttcattcacctgacgagcgaaacgtttagtttcaatcggggaaatggagctcatatcaacaatggttttgcccttcagcgaggctttggtacaaccattttcaccaaacagaacgtcttcaacctgtggcgtatccggcaccataataaaaatgatgtccgatgcatctgttacctggcgcgcagtttcaacactaacggcgcccagtgacagtaattcatcagcaaccggaccaatggttgtgacatgcagttgatgaccggcacgcgccagattaatggccatcggtgtacccataatgcctaagccaataaatcccagtttcataattaacctcttttaaatttcgcttttcctgaattcagacaacacgatcccctgccaacttagcggcctaaaaaagcattgtctgaatagcgttacgttttaacggtacggatccatccagcgtaaaccggcttccgtggtggtttggggtttatattcacagccaacccaaccgttgtagtcagaattttcaattaccgtaaagagatattcgtaattaatttctccggttcccggttcgccgcgatgcggattatcagcaatttgcaggtgaccaattttatcggcccactgagtcatggtattagttaattcaccttccatccgctgcatgtgataaatgtcatactgaattttcaaattgcagcaaccaacatcgtcaatcagtttcagtgcctgccgggttccggtgagatggaaaccaggaatatcaaaatggttaataggttcaatcagtaataaaatatcttctttcatcagcatattcgcagcataacgtaggttttctacaagcgttgtgtgaatctgttcactgctgaaaccagtcggcgttttaccgaccagacagttaatttttttattacccagagcacgagcataacgaatcgctgctgctacgccatcccgaaactcttcttcacggccaggaatacaggcaataccccgctcgcccgccgcccagtcacctgccggtaaattgtgcagcgtatgttcgagtttattactcgccagcacctgttttaattcttcaatgtcgtagtcataagggaacataaattcaacgccgcgaaaaccacactgcgcagctttctcaaaacgggcgagaaaatcatattcaccaaataacatcgataaattagcagagaaacgtaacattatttatctcccttattcatagtgcatgaaacaggtttcagtcggtgcatccgctgcgttatcggcgatatcttcaaattccatgacgttatccagttcactgcccatcgaaatattggtcacacgctcgagaataacttccacgactaccggtacccgatattgcgccattaagattttcgcctgttcaaaggctggtgcaatatcttccggtttgaaaacgcgaattgctttacaacctaaaccttccgctacttttacgtggtcgacgccataaccgttcacttcgctggagttaatattttcgaacgcgagctgtacgcagtaatccatatcaaaggcacgttgcgactggcgaatcagacccagataggcgttattgaccagtacatggatgtacggaatgttgaactgtgcgccaacggctaattcttcaatcaggaactggaagtcgaagtcaccggaaatcgccaccacattgcgctctggatcagcggcacaaacccccagcgccgccggaatcgtccagcccagcgggcctgcctgcccacagttgatccagtggcggtctttaaagacatgcagcatttgtgccgcagcgatttgtgacaggccaatggtggtgacataacaaacatcgcggccaaaggctttgttcatctcttcatacacgcgctgcggtttcaccggcacgttgtcgaagtgggttttgcgcagcaaagtgcgtttgcgctgctggcagtcggcgacccactctttacgacacggcagacgaccggctttttgcatctcctgcgccacttcaaccagcagcgtcagcgccgctttagcatcagagacaatgccaagatccggacacagtacgcggccaatttgcgtcggctcaatatcgatatgaacgattttgcgcccttcggtgtatttctctaccgaaccggtatgacggttggcaaaacggttaccgataccaaataccatgtcggaagccagcagcgttgcgttaccgtaacgatgcgcggtttgcagacccaccatcccggccatcagttcgtggtcatccgggatacaaccccagcccatcagcgttgggatcaccggaacgctggtcagttcagcaaactgttgtaacagtgcagctgcgtcagcattgattaccccgcctccggcaacaatcaccggacgttcggcctggattaacatttctacagctttttcgatctgcatacggctggcagcaggtttgtagaccggcagcggttcgtacatatcaggatcaaactcgatttccgcaacctgtacgtcgaacggtaaatccaccagtaccggacccggtcgaccagaacgcatcaggtgaaacgcctgttgcagcacacgaggcaccagcgccgcttcacgaactgtaaccgccattttgctgaccggtttagcaattgcttcaatatcaacggcctggaaatcttctttatgcagacgggcgcgcggagcctggccggtaatacacagaataggaatggaatcagcagatgcggaatagagcgcggtgatcatgtccgtgcccgcaggaccggaagtccccagacatacgccgatattccctgccgttgcgcgggtataaccttccgccatgtgcgaagcaccttccacatgacgcgccagaatgtgacgaataccgccgtgcttacgcatcgctgagtagaacggattgattgcagctcccggaacgccgaaggcggtggtgataccttctttctccagcacatacattgccgcgtcaacggctctcatttttgccattttattcctacctctattaattggaaaatttttccaactttcaaattttgtcaaaaaaacccgctccgcagagcgggatacgacagacactatagatgtgctttcagtcccaacgccgtgctgatatcgcgggcggtgtctctgaccagctcaccctgactgacaaaacgatcttctgtcagtcttgatgaaggcccggagatggagatagcggcaacaacactacctacatcatcgtaaattgctgaagctatgcaattcaggccgacaacatgctcttctttatctacggtatagcccagttcacgcgcttgttccaggtccttcagcaaggtgggcatatccacaagcgtcgttggcgtaaactgctgcaaaccggtttgcagaatgatgctcatcaactcttcttccgccagcggataaagcagcgccttgcccgcaccggaagcatgcagcggcagacgactgcccagcggcgcacacattctgaccatcgatttacactctaactgaccaattaataccgcttcattgccgttacggatcgcgacattgaccgtttcgccggaaagtaacatcaggcggcgcataaacggcccggcgacggagaggacatcgcggttatggatgtacgctgcaccgacgttaaagacacctaatcctatatgccaccaacctaactgactgtcctgatagacaaaatccgctgcctgtaaaaccttcagcaagcgaaaggtcgtggagagcggcaaatccagattgagagagatatcgctaaccgacgaacttcccccacttttttccagatattgcagaatcgcaattccccgctctaacgcctgtgcacccttctgtgccacaggctccgcctgtcctggcctgccgcgccgtctaacttccgtcatacctacgttaactccgacctacaaatgagcataaacaatgaacaattcgtttatcttatgcaagtcggttgcaggcgtcacgcaaaacagagttcctgttcaggaatactttcaacatcacagttgtcactgccgccgcgatcgatggtcagaaaatcggtgacgcgctgccaggcgaaaagtgggtgatgccagacgttacgatggtaattcactccctgttcgccattggtaataaacgcccgcagggttgacaggtctggtttgtcgtcacctaacgccaccaccaccacaaacacttcacctttcatcgggataaaggcctgtgtacccagcggatgacgttcgagttcgtgaatagtcagcggcagattcgccggttgcgcgcggttaatgctgataagcgtacggtcttgctcaagaatctcaaccagcgccaaatcgtggtaacgctccaccagtccattgttaatatggaaaaaatcccgtttctgcgtttcgattacgtcgccataagcactaaaggcttcctgacttaacggtaatacctgaagtttcatctttttgtccttgtaacataattccgttcaaccaccgccgaccggtcagcttggtttcaataacaggcaatctaaaaccttaagagaacaacatcaacacaaaagttggaatatttttccaaaactggatttagtccacaaattgaacagggttatcatgtaaaaatactgataaatcagaggataagaaaatcacgcaacttgcggatttaaaaggggatacctgaagatgttcgatccagaaaccttgcggactttcattgcggttgctgaaacaggaagtttttcaaaagcggcagaacgattatgtaaaaccacggcgacgatcagttatcgcattaaacttctggaagagaataccggagtggcgctgtttttccgcacgactcgcagcgtgacgttgacggcggctggcgagcatctactttgtcaggccagagactggctgggctggctggaaagtatgcccagcgagttacaacaggtgaatgatggcgtggaacgccaggtgaatatcgtcatcaacaacctgctctataacccccaggccgttgccaggctgctggcgtggctaaatgaacgttacccgtttacccaatttcacatctcccgacaaatctatatgggcgtctgggactcgctattgtacgaaggtttttcactggctatcggcgtcacgggaaccgaggcgctggcaaatacctttagtcttgatcccttaggatcggtgcaatggcgctttgtcatggcggcggatcatccgctggcgaacgttgaagagccgctaacagaagcacagttgcggcgctttccggcggtcaatattgaagacagcgcccgcaccttaaccaaacgcgtcgcctggcgattgccggggcaaaaagagattattgttcccgatatggaaacgaaaatcgccgcccatctggcgggcgttggcattggttttttgccaaaatcactttgccagtcaatgctcgataatcaacaactggtcagccgggtaatcccaacgatgcgccctccttcgccattgagtctggcatggcgcaaatttggcagcggcaaagcggtagaagatattgtgaccttgtttacccagcgcaggccggaaatcagcggatttttagaaattttcggcaacccacgcagttaaaaatcaagtttccttgcgcgttggcgcgtaaaatagcgcgcaagctgatttgaggttcactttttactatgcaagagagacacacggaacaggactatcgtgccctgctgattgctgatacgcccattattgatgttcgcgcccccatcgagtttgagcaaggcgcaatgcccgccgctatcaacctgccgttaatgaataacgatgaacgcgccgccgttggcatctgctataaacagcaagggtcagacgcggcgctggcactggggcataaactggtggcgggtgaaattcgtcagcagcgcatggacgcctggcgggcagcgtgcctgcaaaatccgcacggtattctctgctgcgcccgtggcggtcagcgctcgcatattgtgcaacgctggctgcatgacgcggggattgattatccgctggtggaaggcggttataaggcactgcgccagaccgcgattcaggcgaccattgaactgtcacaaaaaccgatagtgctgattggcggttgtaccggctgcggcaaaacgctgttagtgcaacaacaaccgaacggtgttgatctggaagggctggcgcgccatcgcggttctgcttttggtcgcacgttacaaccacaacttagccaggcgagttttgaaaacctgctggctgccgaaatgctaaaaaccgacgcccgtcagaatttgcgcttgtgggtgctggaagatgaaagccggatgatcggttcgaatcacctgccggaatgtctgcgcgaacgaatgactcaggcgacgattgcggtggtagaagatccgtttgagatccgtcttgaacgcctgaacgaagagtatttcttgcgtatgcatcatgattttacccacgcttatggcgacgaacagggctggcaggagtattgcgaatacctgcatcacgggctttcggcgattaaacgtcggctgggactacaacgctataacgaactggctgcaaggctggatgcggcgctgacaacgcaactcaccaccggcagcaccgacggtcatctggcctggctagtgccgctgcttgaagaatattacgacccgatgtatcgctatcagcttgaaaaaaaagcggaaaaagttgtctttcgcggtgagtgggcggaagtggcggaatgggttaaggcgcagtgatgggggattctgtgcacgctgttcatgctacctggtagaaataaacggctttatcacatcaccccgcaaactgcctgaacagcgccttacccttaagcagtcgcgcacccagccagccgccgcaaagcgacagcagtagcgcaccgctgcacggcagaacaatccacaatcgccagtctggctcccacgggaaatcaaacactttcgattgcagtaccgccagtgccgtttccgcaccaattgcggccaccaggccggatacaaacccgagcatggcgaactcacaccacaatgtcgtgcgcagcagttttttccccgcaccaagtgtgcgccacaccaccagctcctgatgacgctgacgcattcccacctgcacctgcgccagcaacagcaacatgccgcaggcggtgaccagcaccaccatcacttccagcgcccgacttacctgctccagcacctgaccgacctgttttaaaatcgcgccaatgtctaacaggctaatggtcgggaactggcggttgagttgcgtcaacatgccgttgccattctcccagcggaaactggtaagccagctctgcggttgcccgtctaatgccccttccgggaaaataaaatagaaattaggccgcagactttcccagtccactttgcgcaggctggtcactttagcgcggaactcctgggtatcgcccataaaagtcacggtatcgccgagggcaacgtttaagcgtttcgccagcccctcttccatcgacacttcatcggcttttggcggccagttaccggcgacgatcgggttatgatcaggccgcgcattttgccaagtgagattcagctcgcggttgagcgcctcatctccattgccttctgtcggcttgtcgttaatcgccgtcaaccgcgcccgcactaccggataaaacgattccgggactatctgatgttccgcgagaaacgcttttagcggcgtaacctgttctgtggcgatgttgattaaaaagtagttcgggctttctggcggtagctgctgttgccagcgatcgagcagatcgccacgcaacaccaacaacagtgccagcagcataaaggagagcgaaaatgccgaaagctggcttaacgttgaccacggctgacgtaacaggcggctaaccgccaggcgcagaggtagcgatttcagcgtcatgcggcgaagtacattcagcagcatccagcccagcacaccgcacagcaaagccagtactaccgcgcccgccagcaccgcccagagcagcatactgccgcccatcagtccggcgagcagtagcacaaccaccacactgacaatcggcagataaaacttcagcggccagacgtttgcaaccacatcattacgtaacacgcgtaaaggctgcgttgccaacaacaggcggtatggtcgcagccccaccagcagcgagatgactgtcatggtgccgagcgcccacagccacggccagaggctggcaggaggtaaagcggcaggtagcacgggtttgagcagcaccatcaacacgttttcgaacaacagacctatcgccccaccggtaacggctgaaagtaccagcaccatcaaccactgaccgacaattaacttacgcagttgcgctcgccctgcccccagcgttttgaggatcgccaccaagtcgtagcgactgcgacagtaatgattcatcgccaccgcgaccgccgccaccgccagcagcaaggtcagaagcgccgaaagcagcaggaactgttgcgaacgttctatcgatcgccccagcgcgccttcgtcctgttccagaccgtaccagcgttgttcgggtttaagctggggtaacaaccatttctcatagccgtcgagctggttctcgctaccgccgaatttatagcgccaggtgacccgactccccggctgcacggctccggttttatcaacatccgccagattcatcatcaggcgtggggctatctggaaaggattaaaaccggaatccggttcctgaatcacttctccggcaatccgcaaggtggcatcgcccacgtcaatggtgtcgcccgttttcaggttaagcagtgccatcagacgtggggccagcaatacgctgcccgcctgcggtttcaggccagggggattagtttgcagatcgccatacatcgggtagatatcatccaccgctttgacgttcgccagctgcggcgtgtcgcctgcaaaggtcatggtggcgaaagtcagctgcttgccaactttcaggccgcgcttttgcgcttcctccagccatgcttgcggcacttcgcgcgaactgcgcaacgcccgatcgcccgccataaactcacggctttgctggcttaagcccttctccatgcgatcgctgatattgcccagcgccagcacgcaggccaccgccaggctaagcgccagccagacaattaatagcgacggcgagcgccattcgcgccagaaccaacgtgcaatcatgcttcctcctgcaactgcccgttcaccagccgtaagcagcggtcacagcgtgccgccagttgcaggtcatgggtcaccataatcaacgtggtgccatgctcacggttgagggaaaaaagtagatcggcaattttatcgcccgtctggcggtcaaggttgccggtgggttcgtcggcaaacagcacatcaggtcgaccattaaaggctcgcgccagcgccactcgttgctgttcgccgccagaaagctgtgccggaagatgatcaagacgtttacacaaccctaactgttcgagcaacgctttcgccccgttacgactttctgcgctactctcaccgcgcagcagcgccggaagctcgacgttttccagcgcgttaagggtaggaattaacataaatgactgaaaaacaaagcctacgtgcttcgcgcgcaactttgcccgcgcttcttcgtccatattatgtagcggttgtcccaccagtctcacttcgccactgctgccgtcatccagcccggcgaggatcgccagcaaggttgacttacccgatcccgactcgcccaccagtgcgatggtctcgccacgtttgacaaccagctcaactccggtgaggatggagagttcatgctccccctgaccgacggacttcttaagatgatgaacttcaacaatgttttccgctggcatttgcccttcctgttcctggtcctgttaaccttccgtgccgccgcagcggacacgttattgattctgggtgatagcctgagcgccgggtatcgaatgtctgctagcgcggcctggcctgccttgttgaatgataagtggcagagtaaaacgtcggtagtcaatgccagcatcagcggcgacacctcgcaacaagggctggcgcgccttccggctctgctgaaacagcatcagccgcgctgggtgctggtagaactgggcggcaatgacggtttgcgtggttttcagccacaacaaaccgagcaaacgctgcgccagatattgcaggatgtcaaagccgccaacgctgaaccattgttaatgcaaatacgtctgcctgcaaactatggtcgccgttataatgaagcctttagcgccatttaccccaaactcgccaaagagtttgatgttccgctgctgcccttttttatggaagaggtctacctcaaaccacaatggatgcaggatgacggtattcatcccaaccgcgacgcccagccgtttattgccgactggatggcgaagcagttgcagcctttagtaaatcatgactcataaagcaacggagatcctgacaggtaaagttatgcaaaaatcggtcttaattaccggatgttccagtggaattggcctggaaagcgcgctcgaattaaaacgccagggttttcatgtgctggcaggttgccggaaaccggatgatgttgagcgcatgaacagcatgggatttaccggcgtgttgatcgatctggatttgccagaaagtgttgatcgcgcagccgacgaagtgatcgccctgaccgataattgtctgtatgggatctttaacaatgccggattcggcatgtatggccccctttccaccatcagccgtgcgcagatggaacagcagttttccgccaactttttcggcgcacaccagctcaccatgcgcctgttacccgcgatgttaccgcacggtgaaggacgtattgtgatgacctcatcggtgatgggattaatctccacgccgggtcgtggcgcttacgcggccagtaaatatgcgctggaggcgtggtcagacgcactgcgcatggagctacgttacagcggaattaaagttagcctgatcgaacccggtcccattcgtactcgcttcaccgacaacgtcaaccagacgcaaagtgataaacctgtcgaaaatcccggcatcgccgcccgctttacgttgggaccggaagcggtggtcgacaaagtgcgccatgcttttattagcgagaagccgaagatgcgctatccggtaacgctggtgacctgggcagtaatggtgcttaagcgcctgctgccggggcgcgtgatggacaaaatattgcaggggtgagttgaagcgcgcgcttaagcccccatgtcaaagaaaatatcgacaacagagagcgactccatgtccgtagaaaatattgtcaacattaacgaatctaacctgcaacaggttcttgaacagtcgatgaccactccggtgctgttctatttttggtctgaacgtagccagcactgtttgcagttaaccccaattctggaaagcctcgcggcgcagtacaacgggcaatttattctggcgaagctggactgcgacgcggagcagatgattgccgcccagtttggtctgcgcgcgattccgaccgtgtatctgttccagaacgggcaaccggtagacggcttccaggggccgcaaccggaagaggcgatccgcgccctgctggataaagtgctgccgcgcgaagaagagctgaaagcgcagcaggcgatgcagctgatgcaggaaggcaattacaccgacgccttgccattgctgaaagacgcctggcagttgtcgaatcagaacggggagatcggcctgctgctggcagaaacgctgattgcgctgaaccgttctgaagatgctgaagccgtgctgaaaaccattcctttacaggatcaggacacccgctaccaggggctggtggcgcaaatcgaactgctgaagcaggcggcagatacgccggaaattcaacagttgcaacagcaggtggcggagaatccagaagatgccgcactggcaacgcaactggcgctgcaactgcatcaggttgggcgcaatgaagaggcgctggagttgctgttcgggcatctgcgtaaagatctcaccgccgcagacggtcagacgcgtaaaacgttccaggagatccttgctgcgctgggtacgggtgatgcactggcgtcgaagtatcgccgccagctgtatgcgttgttgtattgatgttttgttgatcggcacatgaaccacaacgccggatgcgatgctgcgcatccggcatcgcatcatttcttcttcaattgcgtcaccaccaactggtggcgcgaattataaaatttacgataggttaaatagcaggcaataatggtagacaggctggcagttgagagcagcataaaggtcaccataatctgatatttaatcgccttcaccggatcaatcccggcaaatatcagcccggacatcattcctggtaaactcactaagccaaccgtttttgctgaatcgaccgtcggaattaaagccgcgcgaatactgtcgcgaatcaatatagctgaagcctgtttcggcgtcgcgccaagactcagtt

SEQ ID NO: 10011 - DNA, 23777 bp, Escherichia coli
cggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaaagattttcagcctgatacagattagattaaccggcgacaagcgggttaatgaaacagaatttgcctggcggccttagcgcggtggtcccacctgaccccatgccgaactcagaagtgaaacgccgtagcgccgatggtagtgtggggtctccccatgcgagagtagggaactgccaggcatcaaatttagcgtgctgatatggctcagttggtagagcgcacccttggtaagggtgaggtccccagttcgactctgggtatcagcaccactttttaggttaaagttcggcagattagaaaagaatttgtctggcggcagtagcgcggtggtcccacctgaccccatgccgaactcagaagtgaaacgccgtagcgccgatggtagtgtggggtctccccatgcgagagtagggaactgccagacatcaaatcaagcgaaaggccatccgaaaggatggcctttttgcttttcgaactaacattcaattaatggattacctgcgataaaaatgtcctcgtacgctctgatttaggatgcgcaaaaaattcattaggtgcagcttgctccactatttccccacgatccataaaaatcacccggtcagcgacggttcgtgcaaaccccatctcatgtgttacacacaacattgtcatacccgactgcgccagcccaatcatcgtatccagcacctctttcaccatctcaggatcgagcgccgacgttggctcatcaaacaacataattttcggcttcatacacagcgaacgtgctatggcaacacgttgctgctgaccaccagaaatctgtccgggaaacttctgggcatgttcggcaattctcacccgctcaaggtaatgcatcgccagagcttcagcctctttctttggcatcttgcgtacccaaatcggtgccagggtacagttctgcaacacggtcagatgagggaagagattgaaatgctgaaagaccattcccacttcctgcctgacgcgctcaatattgcggatatcttcattaagttcgatgccatctaccacgatccgtccctgttgatgttcttccagatgattaatacaacgaatggttgtcgatttaccggaacctgaagggccacacagaacgatccgttcgcccggttgcacgattaaatttatatttttcaaaacatggaattgtccataccatttattgacgttttccagcgtaatcatcgcgttagcaggttgcagtaaaatttggctcatagtgtcctcaatgcggtgtacgcccggtgttaaaacgtttttccagatgttggctataacgtgacatgctgaaacagaagatccagtagatcagcgcggcgaaaacatacccttccgtcgacatacccaaccaggcgggatcaacggttgcctgctgaacgctactgaaaagatcgaacaacccgatgatgatcaccagactggtatctttgaagagtgcgatgatggtatttaccagcccaggaattaccagcttcaacgcctgtggcagaataaccagcccctgagttttccagtaacccaatgccagcgactctgccgcttcatattgccctttaggcagcgcctgcaatccgcctcgcacgacttccgcaacatatgctgactgaaataggatcacgccaaccagcgcgcggatcagtttgtcgatactggtgccttctgccataaacaacggcagcatgaccgaagacataaacaatacggtaatcagcggtacgccgcgccagaactcgataaaaatgaccgataagatacgcacaatcggcatatgggagcggcgacctaacgccagtaagatcccccacggtagcgcccccgcaatcccaactgatgcaataattaaagttagcgtcaacccgccccattgccgggtttcaacccgatcaagaccaagaaacccaccatacatcagccaccagacaaccagtgggtaaatcaccgcccagaccgcaatatagcgactgcgatgcggaagtattttccagaacattggtgcgatagaaacaaggccaatcagtaatgccaggttaattcgccagcgttggtcgtgtgggtaaagtccatacataaactgaccaaatcgttcgtggatgaagacccaacaggcaccggattttgtgcagtcggcacgcgttgagccaacccagttagcctgcaaaaatacccagttcagcaacggtgggatcagttcccacatcaaccatatgcagccaatagtcagcaggctattgctccagctggagaacagattttttcgcacccacaccatcgcgcggcttgagttatggctcgccaggcgcgggggatgagacagcaatacttttgtcatcatgactccttagcgttcaacgatcgcgatgcggcggttatagatattcatcagcagcgagatagtcaggctgataatcagatagaccgacatggtcatggctatcgtctcgatggcttgccccgtttggttcagcacggtgccagcaaacagcgaaaccatatcgggatagccaatagcggcggcaagagaggagttcttgacgatgttgagatactggctggttaacggtggaataatcacccgcaatgcctggggaataatgacccggcgtagcgttaccgggttgggtaatcccagtgatcgagccgcttcatgttgaccataaggcactgcctggatccctgcgcggataatctcggcgataaatgcagaggtataaatcgaaagtgctagcgttaaggctgccagttcaggaattaaaaccatcccgccgcggaaattaaagcctcgaagggctgggacatcccagtgtagtgctgcgccaaaaagccattgcgccagtaaaggcaaaccaatgatcaacactgcggcaatcggccaggtgcggcgcagttgtccggtctttatctggtgtgttttattaaagcggaatagcccaacagaaaggactatagctataacaacagccaggataaacgcaagaaacccatctcccagctgcggcgacggaatataaagcccacgattgctcagaaacaccaaatccagtgcgctcactgcctggcgtggcccgggcaaattgcgcaacacggcaaagtaccagaagaagatttgcagcaatggcggaatattacggaagatctcaatataaattgtggaaagctttcgtagcagccagttatccgaaagtctcgccagaccgataaagaagcccaaaacagaagcgaacacaatacacaatgcagaaaccagtagcgtattgagcaggccgacaataaaaacgcgtccgtaagtgtcgccttgctgataatcaatcaaatgctgaacgatgccaaaaccggccccgcggtcaagaaaagcaaatcctgatgttatgccgcgattactgagattcgttacagtgttgtgaaataaccaaccaataatgccgacaacagcaacaacggcaaggatctggaataaccaggcgcgaaccgtagggttggcaaaagagagtgagcctttaacggttgagcggcgatgagacatagaaacctcggaaagcataacgctgaagagagcgccgccgtagcgacgctcgttacctcacaccgacttaacgcacgggcggcgcgtactgaataccgccgttattccagagattattttgcccacgtttaattttcagcgggctttctgaacctacgttacgctcgaaaatttccgagtagttacccacctgtttgatgatgttaaaggcccatttattatccagcttcagatccttgccgtaatcgccttctttacccagcagatgtgccatatcaggcgttgctggattagccgctttttcatcgacgttctgggaattgatgcccatctcttcagcattcagcatggcgaaaagcgtccagcgtacaatcgagaaccattcatcatcgccacgacgaactaccggcccaagtggttctttagagataacttccggtaagacaatccattcagctgggttgcttaatttgatgcgtagggcatacagttgtgattgatccgaggccagagtatcacagcggcctgattccagagctttcgctgattcgtctgagcgatcgaaggttactggcgtgtacttcatattatttgccttgaagtaatcggcgacgttgagttcggtatcagtccccgcctgaatacagacggtagcgccatccagttctttcgcgctttttagccccgctttatcgtgcgtcaggaagccaatgccgtcgtaataagtgacgccagtaaatgccattcccatcccggcatcgcgagatgaagtccaggtcgtattacgggagagcaaatccacctcccctgactgtaaagcggtgaagcgttcttttgcagtgagcggggtatatttcactttcgtatcgtcaccgaatacagcagcggcaacaccacgacaaacatctacatcaatacctgaaaacttaccgtcagcatcggcataagagaacccaggtaatccatcactgatcccgcattgcacaaaaccttttttctgaacggcatcaagcgtcgcgccagcatgcgcctgatttgcaacggcaagcagcacgctggcggcagccagtgtggctatcatcatctttttcataatgcttcctgtgaggcgaaaattatcgttataggacgtttgggaaacgtcttttacctgtctgtggccatcctcttataagcaaaagtagtgccagcttttgcgcacgatttcgcgtcgcaataagctgagtgtagacaggaaataataaaaacagcgccccgcaatggtgcgaaaatgaaacatgcgccacattttggcgcaaaatatttacgcgttttttactaagcagaataatgattgttagcgtgagtatatttctggtgggatgtgtgaaagttaaattgatgcgttatttcgaaagcagcgaaataacgtgatataacatgctaaatcagcagggaattacccagcagaatatagcaatattttatcttatggaaagatactgtatcgttaaaaagagcgcggagctccgcgccctgtttagttatttcgacagagcgatgatccccatcgtcaggccagcaacagctgctgccccgccggcaatagccccagccgtttcccagttatcctgagtcgtgcctttcatacaggtattggtgtgaaccagacgaccctgatcgtcataaaccggaacgcagggcgaatcgtgagcacagcccgccagcaatgcggtgagcaatgtcacaggaattaatcttttcatggtgttacctcagtaataaacgctaacgcttaataagttaactctcttattaacgagctgaatgccattttatcactggaggttataaatcttgcggaatgaataatgacaatttatgtgaattgtaaaaatagtgaagggagcgggaactatagaaagtttttaaagagtgagaagaagaatatcttattaatttttatggggttcactgaaaataaaaaaggcgcctgaaagcgcctttatgtttctgatttatcctttaaagcatcgacggatcaccacaaagaacactggcacgaagaagattgccagcaacgttgcagagaccattccgcccattaccccgataccgactgcgttttgcgcgccactgccggccccgttactgatagccagcggtaatacgccgagaataaaggcgagagaggtcatcaggataggacgcagacgcatacgtactgccattagtgtcgcttcaacaacacctttaccctctttctccatgagatctttagcgaactcaacaatcaaaatagcgtttttggccgacaagccaattgtcgttagcaagcccaccataaagtagacgtcatttttttgattaaagagtgttgccgccagtagcacgccgacaatccctaacggcacgaccaacataaccgagacaggaattgaccagctttcatagagtgcagcaaggcacaggaaaacaaccacaaaggaaattgctaccagagcgggagcctggtttcccgataaacgttcctgatatgacatacccgtccagtcataaccaatgcccgccggtaattttgacgcaaggttttccatcaacgccatagcatcgccggaactggttcctggcgcggcttccccctgaatctccattgacggcagaccgttgtagcgttccagtcgcggagagccatacacccaatgtgaagtggtaaaggcagagaatggcaccatttcgccgttggcgctgcggacataaagtttatcgacatcttctggcagcatacggaatttggcatccgcctgaacatacacctttttcacgcgaccacggtcgatgaagtcgttaacgtaagtcccacccaacgccgttgaaatggtctgattgatgtcagaaagtgaaacacctaatgcctgcgccttttcctggtcaacttccagtttaaactgcgcggtgtcttccaggccattagggcgcacgctgactaagctggcaggatgttgcgccgccatgccaagcaactggttacgggcctgggtcagggcatcgtgacccagcccagcctgatcaattaactcaaagtcgaaacccgttgccgtgcctagttcaacaatggctggcatattaaatggaatgacaaaaccgtcgcggatcttgcccaattccattttggcacgatggattactgcttccgcactgttttcgtcaccactacgctcttcccacggtttcagactgacgaaggccataccggcgttttgtgcctggccgctgaagctaaagccgttaactgtaaagacactttcaacgttcgctttctcgttcttcagatagtaatccgtcacttgatccaacactttttgcgtccgctcttgcgtcgcgccagcgggtaactgaatcatggtcagaaagacaccctgatcctcttcaggtaagaaggaagacggaagacgtaaaaacaacaccaccattcctgcaacaatcagcgcatagatcagtaaatatcgccctgtggaaccgaggattttgccaacgctattggtgtagtgattaacgctatgatcgaaagtggtgttaaaccagccgaagaatcctcccttattttcgtgatgctcggcagagactggtttcagcaatgttgcacataacgcgggggtgagaatcagcgcaaccagtactgaaagcgccattgctgaaacaatagtgatagagaactggcgataaattgcccctgttgagccaccgaagaatgccatcggaataaataccgccgacagtaccatcgcgatacctaccagcgcgccctggatttgcgacatcgatttttccgtcgcttctctgggggggagtttatcctccatcattacgcgctcgacgttctccacaacgactatcgcatcatcaacaagaagtccgatggcaagtaccatcccaaacatcgttagcgtattgatggagtaaccaaaagcggcgagtatggcaaatgtccctaacaacacgacaggtacagcaatggtgggtatcaatgttgcccgcatgttctgcaagaacagatacatcaccaggaacaccagcataatggcttcgaacagcgttttcaccacttcctggatagaaagctggacgaaaggcgtggtgtcataagggtaaagaaccttcattccctgcgggaagaatggctgtaattccgccagttttgccttaatggctttcgcggtatcgagagcattcgcgccggttgccagcttaatccccaggcccgccgccggttttccgttgatgcgagcgataacgttatagttttcaccgccaagttcaacccgtgcgacatctttcagacgcaccaccgagccgtcactgtttacgcgcagggtcactttgccgaattcttccggattttttaaccgcgtctgagcaataatcgaggcgttcaactgttgccctggtaacgctggcgttccgcccaactgtccggcagcgatctgatcgttctgtaccttcaactggttaatcacatcaaccggtgtcagtttatatttgtttagcagatcggcgtccagccagatacgcatcgcatactgtgcgccgaaaagctgtacgtcaccgacgccattcagacggctaagcgtatctttaacgttagaggccacatagtccgagatatcgtcctgtgtggtgccagggttatcagagacaaagcccgccaccatcaaatagctgctactggacttttcaacactgatcccctgctgctgaacctcctgcggcagcaacggcgtggcgagctggagtttgttctgcacctgtacttgcgcgatatcaggatcggtcccggactggaaggtaagggtaattgtcacgctaccggcggaatcgctggtggaggacatatacatcaggttatcgataccgttcatattctgttcgataacctgcgtcactgtatcctgcacggtctgcgcatcagcacccggatagtttgccgaaacagaaaccgcaggcggcgcaatggttggatactgggcgacgggcaattgtaggatcgccagtgcgcccgccatcatcagaataatggccagcacccatgcaaatatcggtcgtcgaataaaaaagtttgccatgtcagattgccttacttcgatgcagtatctgcgggggtatcggtagtggctttaacctgctctcccggacgcgctttttgcaggccgctgacaatgacttgatcgccagatttcagaccttcgctaatcaaccatttatcgccaatcgcctgactggcaacgacagggcgcgcttcaacctgacttttattgttaacaatcagcacggttgcatcaccacgtggtgtgcggctaacgccttgttgcgggataagaatggcgtcaggttggacgccttcatcaatccgtgcgcgcacaaacatacccggcaaaagcgtatgttgcgggttagggaagacagcacgtagggttatggagccggtgctttcatcaacggtcacatcggagaattgcagcgtacctttcaggggataggtttgaccgttctccatgaccaactctacgttgctggtggcgttttccttatgcaaatttccttgctctacggattgcttcagcctcataaaatcgttgctggattgggtcacatcaacgtagataggatcgagctgctggacagtcgccagttcagtcgtttgcccattagtgacaagagcgccttcggtcacggtcgatttgccgatacgtccgctaattggcgcagtcactttggtataagcgagattgatgcgagcgctttcgactgtggcttttgcggcaatcacggcggcatcggcctggcgagcatcagcaatggcctggtcgtactcctgctgactgatgtatttcgtacccacgagcggaacgtaacgttttaccgtcaaatgcgcgatggcggcggcggcttcacttttcgccagttcgcctttcgcgctgtcataacttgcctgataggtcgcgggatcgatctggtacagggactggcctgcttgcacatcgctgccttcagtgaaattgcgattcagtacgatcccgctaacctgtgggcgaacttcggctatacggtaagcattggtgcggcctggtaattcagtcttaacttctaacggggccgttttcacaatatgaacggtaacctgcggttcaccgacgtgagctttctcttctcccttatcgttacaaccggcgattaaagccgcggagatcagaataaaggagggcaggaggaaaaacctggcatgtttcgtcattactattcctcaaaaaaccaaaagcgcgttatttgcccaaaaaggcaatgcgttaactcgcagaaagaaaaatacagttcgctatcctacaaattatcattcgtcgatgtaaggaatagttatgaatactggcaactcaaggcacataaacacaaaaaaagattaatattctactgttttgttttgacgcggaatgaaagaaatagaattaaaatctcgtaaattgaaatatgtataggtcaagtgaatgtattttatgtaaataatacatatcatttatttgacgatttatagcaacgcaatattagcctctcgtataaatacacattaggtgatagattaacccttcgctattttctcatcctgtgtcgaatatatttatttcctgaataattaatcatggcaaaaagaaccaaagctgaagccctgaagacccggcaagaactgattgaaactgccatcgcccagtttgcgcagcatggcgtaagcaagacgacgctcaacgacattgccgacgctgctaacgttacgcgtggcgctatctactggcacttcgaaaacaagactcaactgtttaatgagatgtggttgcaacagccttcattgcgggagttaatccaggatcacttgaccgctgggttagagcatgacccgtttcagcaattgcgtgaaaaattgattgtcggtttgcaatatattgccaaaattccccgccagcaggcgttgctgaaaatcttatatcacaaatgtgaatttaatgatgagatgctggccgagggagtgatacgcgaaaagatgggctttaatccgcagactctccgcgaagtattgcaggcgtgtcagcaacaaggttgtgtagcaaataatctcgatttagatgttgtgatgattattattgatggtgccttcagcggaattgttcaaaactggttaatgaatatggcgggttatgatctttataaacaagcccccgctctggtcgataacgtattaagaatgttcatgccagatgaaaacataacgaaattaattcataaaacgaatgaattaagtgtcatataaattcacattctgtcctgaaaattcagttcgtcacagttaaccagttttagtggattaactgagttcatattgcggcatttgtctgtttctgttgccagcagttcaatccactgcatcagtaaagtatcaaacagaaaaacgaagacagcgaaaacgacgagccaccaatacttgcgaatcattacctgagcctgtgcatgtttaaccaagtctggcaggaaatatacacgaaatgaataatctgaaaaccaggcttacacttcctttactttgcaatgagatcggggtcaacttcgcttaaccggcttcgttttgacaggttgccggtctttctttttttcactttcgccagttcttccgcagagtaatgcgacgcgacatccagccgtcgaagccccattttgatgtactcgctgttgatctcaataccaatgaattttcgcccgctggcgacggctacggcaccggtagtaaagctaccggcaaacgggtcgagaacgatatcgcctgggttggaagaggcgagaataatgcgtttcagcaaggcttccggtttttgcgtcgggtggttttcatattcatccatcaaataacgcacgcgcggaaaatcccagacgttacccggtactttttgatgattgtaaggctgtggaggatttttgcgataattgatcaacgcgcgctgcgatccggttttggcttctaccagaatagcatcaccgttgaacgtgtagttctttgcgtctttcaccatcatcaggatgggttcgtacatggagccgtagtgttttttcgcctgcactccagaactgtcatatgaccagacgatgcgacttttgatggtaaaaagcttgcggcactggagatcgataaagggcatgttttccgtgctattcatgatgtacatgctgccctgctttttcagaacgcgatggcactctgcaatcacttcaaacagccagtcgataaacagatcttctttccaggcttcgatcagaccatcaaaatttttaccgatgttatacggtgggtcggcaaagatcagatcgacactttcggcggggagctttttaagttcggttaatgcatcaccctggatgatggtctttgcttcattaccaaatcgggtcggttcacatcctgttctcatggtcactccctttgtgacacctataaaaaaggcgcttccccatgccgagtagcgcctttttaatcaagcatttagctaaaacctgaattagttcatgccgtattttttcaattttttacgcagcgtaccacggttgatgcccatcatcagagcagcacgggtctggttaccacgggtgtattgcatcaccatgtccaacaggggctgttctacttcagccagtaccagctcatagaggtcattcacatcctgaccattcagttgagcaaaatagttcttcagtgcctgtttaaccgagtcacgcaggggtttttgggttacctgatcctgagagttaacggtagaaacggtcagtacgtcagaatttacgcgttgttcgaacatagttctgtcagctctttatttctgtttacgcaaaattttcgaagtatgcctccaacgcctccagctgttcgctggcatcctcaatggcgttgaatgtgcgccgaaactggtcatttggagcgtgttcctggagataccaggaaacgtgtttacgtgcaattcggtacccttttgccggaccataaaagtcatgcagttcccgaacgtgcgcgcaaagcaagcgcttaacctctgccaaaggcagcgggggcagcaactccccagtgtccagataatgctggatttcccgaaagatccagggtcttccctgagctgcgcggcctatcatcagggcatccgcccctgtatagtcgagcacagctctggctttaagcgggtcagtaatgtcaccattcgcgataaccggaatggaaactttctgcttaactgcccgaatactgtcgtactcagcttctccattgaacaaacaggcgcgtgtacggccatgaatggtcagagcctgaatgccacagtcttcagccagttgggcaatctcttcgcagttacggtgttccggtgcccagccagtgcgaattttcagggtaacaggaacgtccactgcattgacgacctcggtaaggatcgatttaacgacatccgggtactgcaagagggctgaacctgcgagcttgcgattcacttttttagccgggcaacccatattgatatcaataatctgggcaccgctttccacgttaatacgtgctgcatctgccatttctttcggatcgctaccagcaatttgcacggtgcgaataccgggttcatcaatgtgcaccatccgtaaacgagatttgtcgctttcccaaacctgtgggttagaagacatcatctcggatactgtcaatccggctcccatctcgtagcacaacgtccgaaaaggtctgtctgtaatgccagccatgggcgctgcgatcaggcgatttctgagctgatattgtccgatgcgcatgagttaagaaatgaccatactgtgactgcaaggcggcgtatattacgcattttttgcacgagatgaaaggccaaactttgaccaatcctctgagatggatcaaagaattgcatttaaaatgagcgtagcgcgataattactcataaaaatcatcatattagaaaatagtgactaaaatttacactcaaagaaatttgagtaagttctcaatttttctttatgaatgaaaattttggcacgcaaatttgcgtaaataatcggcaaattaacgtgccttttgtgacatcgctcgcacttcgctctgcgtcgccatacggcgatgcgaaggttaattcttacgaccggtaatgcggcaccactcttctttttccacgaccgggtccagagcgaagctgtcggcataagcttcgcaaacgctctctgcctggcttgccagaataccggaaaggcccagcaaaccgcctgaaactggcaggacgctgattaacggtgccagttcacgtaatggacctgcaaggatgttagcgaccaccacgtcggctttcatttcttctggctgatctttcggtaagtagagttccagacgatcagaaacgccattacgttcagcgttgtcgcggctggcctgaatcgcctgcggatcaatatcaataccaatggcttttgctgcacccagtttcagcgccgcgatagccagaatgccggaaccgcagccaaagtcgatgactgttttaccggttaaatcgaggctgtcgagccattgcaggcacagagaggtagttggatgggtacccgtaccaaacgccagccctgggtctaacatcacgttgacggcgttttcgtccggcacatcacgccagcttgggcagatccacagccgttcaccaaagcgcatcgggtggaaattatccatccattcgcgctcccagtctttatcttccagttgttcgattttatgcgcgaagcccgcgccgagcagcggatggttttccagaatcgccaccacgtcgttcatatcggtttcagcgtcgaacagaccaatcacatcggtgtcgccccacaggcgcgtttcgcccggcagcggctcaaatactggcgtatcgtgggtatcctgaaaagtgatagaaacggcacccgcttccatcagcgcatcgctaagatcttccgcgttcgcgccggtagtgttcagtttcagttggatccaaggcatggcaaaactctttatttatcagtagtcaaaacggtagcttgcgggacggatgtaccgaaacggtttccgaccaggaaagccagcaaacttagtagtaacgagggcacgatagggtggaagcccaggtactgaatattcagcttcgcgagtacggcatacagcacgccgccaacgatcatcgcacttagcgcgcctttggcgttggcacgttcccagtaaagacccagcaccagcggccacaggaaaacggcttccagcccaccgaaggccagcaaattcagccagatgatcatttctggcggcttccaggcggcaagcagcagcaacgcaccgagaaccaacgtgatcaccgccgacatccgcttcagacgcgtctcgttttgcatttgatccggacggatattcagatagagatctttaatgatcgtagcggaactttgcagcagttgggcgttaattgtcgacatgatcgcagccatcggtgcagccaggaagatcccggcggcaaacggtggcagcacttttaccattaacgtcgggatcaccagatccggtacggtgagatcggggatcaccgcccgacctaacgctccggccagatgcataccgaacatcaggattgcgactacaatcgtaccgataatgatcccccgatgtacggctttgctgtctttataagagatacagcgcaccgcagtatgcggcaggcctataacgccaaagcacaccagtacccagaacgacgtcataaaggcaggcgacagaatatcgtcagcgccttgtggcgtaaccagttgcggatcgatggtttgcagcgtgtctaccgcattacttaaaccacctgcggcatgtaccacgccaataagcagcacaacggtgccaatcagcatcaccagcccttgcatggtgtcgttcagcacgctggcgcgaaagccgccaaaggcggtatacaacgcaatgctgataccgaaaatcagcagcccggtttcataaggaatacccgccgcggtttccagcaggcgcgcaccgccgataaactgcacggtcatcgcaccaacgaacgcaaccagcaaactcaaactcgccagccataccagaagacgactctggtagcgggcaaacagcatatcgttcagcgtcaccgcattgtagcggcgcgcaagaattgcgaacttcttgccgagaataccgagcgaaagccagactgcaggaagctgaatcatcgctagcaatacccagcccaggccgtatttataagcagctccaggcccgccgataaacgaactggcactgatataggtcgcggtgagcgtcatcgccagcacaataccgcccatagagcggctgccgaggaaatactcattaaggaaggtgccagtgctccgtttacgcatcgcataaacagagataccgaacaccaccaccagataggcgaccagcggtagaatcacttcaagctgcatcgtcatcctccagcgggatatcgcgatagataaatttcaccatcgcccagcacagtccaataaacagcagcggcgtcaggatgcaggccatctcaaaccagcgcggaaagccggtaaaaccgggggcaacgccaggtaagtaagcggctactaaccataccgccagatacaaaagggtcagccccagcgcccagcgcgcctctttatgggcctgaacaaaacgagtgtccacggaaggggtcctcctcatggggggatacgagaaacgggcaattctacggcaagtcttcaggcagggaaaataatctgacagaaaattgccgttcagtgctgctgcaaaaagtcttcaatgtctgccagtgaggatatcccttccatcggaccttgccgcattacggcgagcgcgccactggcatttgcatattgcagcgccttgtgtgccgggaaaccggataagaaaagagtgataaacgttgcgccaaagcagtcgcctgcacccgttggatcgataatttcgatatcgtgacctgcaacatgctgggcgtgtaatgtaccgtttttaagcttgtaatagctggccccacgctgggcgcgttttatcgccacatgttttacgccgccgtggagaagatcgctaacaatctgttcctctgacagatttttgtgacgcgcgaagaaagggagttcgctttcgctggggataaaaatatccgtatattcaatcaaataatcgagagcctgcgccatttcaggaatgctcagcatctctttgcgaatattgggatcgaaagaaacggtgccgccagccgatttgatcgtcgttattgctttacgcatgacatcgatcatgcgaaatgagaacaacgatgagcccacaatatgcagatggttacactgtttaagcagatccttatcaatgtgctcggcagtaaacaaaccgcaggcgctgttagggatattaaagacgaaatcccgctgctggggattttgataactcacgaacgccgtacctgtgacggcattgttcataacatggatcccatcggtaatgacaccttcatgacggagacgctctataatgagtcgggcaaaatcatcattaccaacacatccaaagaagatggcccgatgggacagttttgccacctgagcagcaaaaattgctggcgcaccgctgggaaatggcccgataaactccccaggctgagtgaatttttgatgtgggttgcgggacaaaaactcggccagcaattcgcccatagcgcagatagttattgtcacaaaacccctctcattcctgaagcctttcgcgattggaccaggtaaagcactcattactggtataaaggataacgaaatcagccgactgcaattgttgctgatattgttcgttaatgctgcggctgacgatcacattttctgcctgatgcaaatgcccgatagcagccgttgatggcgcaggatcggcggcaacgataaccgtcttattctgggcatgatcgaaacagagctgccaggcagcggcgagtctgggaacgttgatatttaaagtaccatcagcatccagatggctgatttccagaatgctatgtgtaatggtgaaatgctgaagtgcctgttcaagcggttttccggccagtgcggtgtcggggcgcagcatttcactgccagccagtattatttcgccatcaataaactgatttgccagcagcgcatgttcgggatcgttggtgatcagacgcagttttttcacttcgctgagcaatggaatgatcttacggcagattgtcccatgtccaagaaatagcgtgtcacgatcgcgaattaaccgtgcgcaatgtcgtgctatttccatttgttgtgccagagacaatggcgcgatcggttgtatcgcttctggttcagaggagagtggtgtcgcaatagcaccgccaaatgatcgctttaaatatccctgttgctccagataactgagatcgccgcggatcgtcacgccagagacaccaagttgcgcagataagtcatcaactttgatttcaccctgggcggcaacaatttctgcaatttttaatctgcgtttcagtaggttagacgattttctcggcacgttaacactcttcattggcctttaatgcgtaacactatagccccttgtatttttctttgaaagttatccttcaatcatatcgacaattcgaaaagaaaatcatgggtcaaaaattgcaacgaaaatagcttaatacattgaaaaataaatgaatatattcatatttatgcagggtttccattggtttcacttgcaaagtgaaaaataaattaagttatttttgtaagttattttgatgatgttcgacatgcatcacgctttttgctgcttttgctgtgctagtttgctttcaaaatgaaagtgaagattctctttcttcattttgtaaggcgaacgacaaataacaggagctgcgatgtatattatttcaagcaaaaacatgctgaaaaaagcccagtcagagggatatgccgtccctgctttcaacattcataaccttgaaactttacaggtagttgttgagagcgctgcacaacttcgctctcccgttatgctggcgggaacacccggtacatatcgttatggtggcgtgggaagtttaatttcgttagtacaatcgctggctcgcgagtacaacctgccgttagtcctgcatctcgaccatcatgaagagagtgatgacatttttaacaaggttcgcgcagggatccgttctgtcatgattgatggctcccatttgccatttgaagacaacattgcgcgagtgcaagaagttaccaccttttgccatcgctttgatgttagcgttgaggccgagctagggcgtcttggcggccaggaggacgatctgcgggtggatgaaaaagattccgcttatacctcaccagccgcagctgcagagtttgttcaacgtacccaaattgactccctggcggtagcaatcggcacagcacatggtttatatgcgcatgaaccacgactggattttgtgcggctggaacagattcgtcagcgagtggagattccgctggtgttgcatggtgcttcgggcttatcggaacaggacgttcagcactgtattcgtcgcggtatttgtaaagtaaatgtcgcgacagaattgaaaattgcgtttgccgatgcgttaaaaggatatttctacaacaatcctgcggcaaatgatccacgtcactatatgcagcccgcaaaggccgccatgaaagaagtcgtaattcgtattattggcgtctgtggtagtgaaggaaaaatttaatacgttgtaccctacaaaaacaatgaggattgtttatgaaaaatattaaattacttggttcagctatgttggtgagcctggcattgttctcgcaaagttcgttggcaaaagagtataaaattggtgcgtcattattaacacaacaacatccattctatattgatcttgcgaatgccatgaaagaagaggcaaaaaaagacaatgtcaatttaagtgtctctattgccaaccaggatttaaacaaacaactttctgatgttgaggattttattactaaaaaagtggatgccattattgtctctccggtcgattcgaaaggcgtccaggcagcgataattaaagccgataaggccggtattcccgttatcaccgtcgacgtcgctgcggaaggcgttccggtcgtatcgcatgttgcgaccgataactatgcgggaggcgttgaagcaggcaagttaatgggtaaacttttgcatggtaaaggtactgtagccattatttcttatccggcactacaatcggtggttgcgcgcgttgatggttttaagaaagggttaagcgatacaccggatattaaaattgttgctgaacagcctggtattacgcgggctgaagcgttaacgactgcgcaaaacattatgcaggcaaacgccaacctgaatggtctgtttggctttggtgatgatgcggcgctggcagcggttatcgcagcaaaatctgcgcataacgacaacatcaaaatcattggttttgacggcatgaaagaagcgtgtgatgctgttgacagtgaaaaaacgtttgcggccgtgattcggcaatatcccgatcaaatgggggctaaagccattgatgccgctgttgatcacctcaatggtaaaccggtagaaaaaatgatcccggtacaacccggcgtttatacaggtaaatagtaaatatcttcacctcacaacaaaacgttattggcgttttgttgtgacaccgaggtcattatgacggatgttattcttgatgtttcgcatattgcgaagacatttggtcatgttcaggcattaaaagatattacactctctttacgtaaagggcgggtgcatactttattaggcgagaatggtgccggtaaatcgacattaatgaaaatactggccggtgtttatccgccaacccagggaacgataacactacgtggtgaaaccatcaccattaataatccgcagcattctcgccagttagggattgcgattatttttcaggaactgagcctgagtaataatatgaccgtggcggaaaatatttatgccaataatgaaccgcgacgttttggcatcattaacgataaaaaaatgctcgcagattgccagaatctcctcgcggacctgggcataccactagacccactggaaatggtcggcaatatgtcgatggcacataggcaactggtagaaattgctaaagccttaagctatgcagcggatgtcgtgattatggatgaaccgacatcctcgctaagtgataatgaagcggagatcctgtttaacattattgaaaaattaaagcagcgaggctgtgcggttatttatatctctcatcgcatggatgaaattatgcggatttcagatgatatttcggtgatccgcgacggtgagtatatcgctacgcatgaaaagaaaaacagtgatatccagcacttgattgcccaaatggttggtcgggaaatgaaaaatatttggccagcacgtcttggggaaaaaccggatgaaaatgttcctgcaaaactggaagtaaaaaatctttcccatccttcgctttttaaagaggtcagtttcgctgtgcgtccgggggaagtcctcggattttttggcctggtgggggccgggcgttccgatgtgatgaaggcgctatttggcctcgtttcgtatcacgggactgtgttgattgatggtaaggaagtcaggatcgctaatcccaaacaggctattgatcatggcattgcttttgtgaccgaaaaccgcaaggaagaagggttagtgctgatgcacgacgtcaatatgaacacgcaccatgtggcgtttcaatataacgcttcgcggatgggactcatcaatcaccgacaagaagaggcgaagacgctgcaatcaattgccagaatgaacactaaagtgagttctgtgcatcaggcagtgggagcaatgagcggcggtaatcaacagaaaatcgtgttatcgaagtggctggagaaaactccgcgtattttattgctcgatgagccaacgcgcggagtggatgtcggcgcaaaatttgaaatctataacgtgatacgtcaactggctgcggcagggacagcaattattctggtgtcctctgaactgccagaagtcatggcacttagcgatcgtctggtggtaatgcgtaataaaacgattgccgatatttattcatgtgaaaatttaacgcagatacaggtaatgaccgctgcaacaggagtacgttaaatgacagagaaaactcttgccagtccgaaaccttcggaaattcccattgcaaataattttaaaaaagtcttcaggcaatatggtggtatcctcagtggaatggtggtgttaatcattctgttcagttttattaatgacagtttttttaccgccaataacattactaatattattcttcaggtttcgataattgcaattaccgcctatggaatgacttatgtgcttttgcttggcgatattgatttatcggtcggttcaaccattgcattgattggcacatttgctgcgcttggggcttcatggggaattccatttgttttattggtcccattatccattattgcagcactgactctggggatgataaatggtggcttgacggctatagcggggatcccgtcgtttattgtcaccgttgctactatggggatcttccgtggtatcgcttatatagtgaccgatggtatgcccatcatgattaaagatgatgcctttctggcgctggggaatggagaatttctctatatacctattccaatctggatattaattatcttattgctgattaaccatttcattcttactaaaacaacctttggacgaaagatttatatcactggtggtaataaagaagcggcaatttattcagggataaatgtcacccgcttgaaaattaaagtctttatgattacagccgtgctggcaggtatcagcgggatgatccttgcctcacgcctctattccgggcaaccgaattccgcgttgagctacgaactggatgctattgccgcggctgtactgggaggcaccagcctgaacggcggctatggaaccgtggtggggacggtgatcggcgcattaaccatcggcgttattaataatggcatgaacttaatgaatgttccttatttttaccagatggtggttaaaggattagtcattcttgtagccgtttattttgacgtaagaaataaaagaaaacgcagctaatcatttcaaggaattaatcatatgagtaaggtcttcacaattggagaaattctggttgaaattatggcgagtaaaatcggccagccatttgatcaaccaggtatctggaacggcccttatcccagtggtgcgcccgctatttttatcgaccaggtgacacgtcttggcgtcccgtgcggcatcattagctgcgtggggaatgatggctttggtgatattaatatacatcgtctggctgctga

SEQ ID NO: 10012 - DNA, 21879 bp, Escherichia coli
tggacttggacttgctaacaaaacgttgagtgtcactctgctggccgcttggcgcaatcaccatctcttgtctcccgtcagattaaccagcagcttgccgaaaataactatttcttcgccaaaaatgatgaggggttggctacgtttacggcagtcgagactaagattaagcaatacgacgccatgctttataagcagatggaagccactcgtgatgcttaccagcagtacagcaaatctgttagcgcccgcggcgtgaagaggatgaactttattgatttcaatgaagctgttggcatggctatgcgccgtggtgatcagagtgatattcctgaggtttcctacacaccttctccggcctacaaaacattattgagaaacagaaaaaaaacagcgcccaacacttccccggacgctgcatggcaacttgaataatctcgccttatcagaaagtaattacgcccttaatcaactcacgattgttaatcacatcgcgctcgtaggtttctgccagcgtggcgaacggatagcgatgggttaacatcatgtcggcagtgattttcccttccgccatcaatcgaccgactttagcgaaatcttccggcgtggcgttgcggctgcccatcatcgtcgtttcttttttatggaattccggatcggagaactgcaactcacctttaaacaggccgacaaataccaccgtgccgccgtgacgaatcagatttacggtgttattcatcgcatgttgattacctgtcgcgtcaatcactttctgcgccagcgaaccaccaaactgcgcccgcagctgcgcgtcaaaatcttcggctgacgggtccagaacaggtaattccagacgcgttgccacatgttcacgacgcgccggactggtatccgccaccaccacctgcgcgccatcggctttagcgattgccgccgcgcccagaccgattggccccgccccgaccaccagcacctgctcgctgggtgcaatggctgcacgacgcaccgcatgagcgctaatagcgaaaggttcaatcaatgctgccgcctgcgggtcaataccgtctgcgggcaaaatgttcgccaccggcacgctcaaatactcactaaaaccgccatcctgatgcacgccaatgactgaaattttttcacagcaattggtacgaccgcttttacacgccgggcattgctgacaagaaatatacggaattaccgcaacttgctgtccgatattaaaattgtgaatgttttttcctgattcaataatctccccacatatttcatggcctaaaacgcgtggataactaaaaaatggctgattgcccgcccaggcatgaatatctgtaccgcaaatcccgacagttttaattttaattaatgcttcattatcgcctggcaccggtctttcccggacttcccatactaaattctttatttcctgacaaattaatactttcattgtggacatgattcaccgctccttttattttatgactttcagatatcgtcgaatttataagagcgcctgaatttacccataaaatatgcggatgatcgcgcataaaaatgttttaaatcggcttttaatgccggactggagggaagaatgagtcgttcgcagaatttacgtcatagcgtcataaatcaggtgattgaagatatggcgaggggcaatattccttctccgctgccttcacaaagcggactggcagaaatgtataacatcagtcgcactacggtacgccacatactccagcatttaagcgcatgtggcgtgctcaccctggtggggaaaaattatgttatcgcccgcaaacccgaacagaacgatggatttgattgcatcacggcctcgctgaaagagcaaaaccgtcttttcgagcaggcatttttcaccatgattaacctgcgccagttacgcgccggagaaagcttttccgaacttcagctggcgcgagcggcaagcgtcagtccggtagtggtacgagaatatcttttgaaattcggtcgttataatcttattcaaagcgaaaagcgcggccaatggagcatgaagcagttcgatcaatcctacgccgagcagctgtttgagctacgcgaaatgctcgaaacacattccctgcaacactttctcaaccttcccgatgatgaccctcgctggttgcaggcgaaaaccatgctcgaacgtcacaggacattgcgcgacagcattggcagcaactttcgaatgttttctcaattagaccgtgattttcatgccatgctgttatccgctgctgacaacatcttttttaatcaatcacttgaaattatatcggtgatctttcattttcactatcaatgggatgaaagcgatctcaaacagcgcaatatcattgctgttgatgaacatatgaccattctcagcgccctgatttgccgtagcgatttagatgcaataacggcgttgcgaaaccatctggataccgccaaacaatcaatgattcgttccatcaggcaacatcaccgataaattaagtacagattaaaaacattgattcttggtttatatcactatgttgtattaatgcagtattaatccaggcgattgttctgcccataaggaaatacatagggaataaacgatgctggaagtattactctcagccatcatttaattccctattactggcagcgataaaattatcggctatccatgattaacgtttccagcacatctaattcactgactatttttgccagtgtttcatcactgacttcttgccttgcgcgcatctggtaaatagccgcgcgtttggcatttaacgccgccagattaaatgttctttccagcttcgcacgctgcatatgcagggaattatcattaggcgacatatcctcttcactatgtcgcatataaccgataactctggcccccgtttccataatcaactcgttatcgaggttttctgttctggcgcgcagcaaacgttgctcggtcttttgcacactcagtatggccattttagccataaacagatcggcagcttcctcttctttttgtcggttatcgctgaaaatccccacatttttccccagtaataacggcagaataataatgccgcaaaccagcgaaaagaggatcacacctgtggcgagaaataccagcaagtaacgcccgggaaaaggtgtgccatccggcagcaataacgggatagaaagcacccccgcaagcgtgatagctccgcgcacccccgcaaaggtcgccagcagcatatgacgcgttttatatccagcaaacagcatcggatgtttgccgggtcgtttacggctatacagacgcatcagccaaagccagcccaggcgcacaaccattaacgccaggtagatccaaatgacatcaaggagcagcgatccggtgtccaccagtggatcgttttctgcacggatcagtgattccgaaataatgcccggcagttgtaagcctaaaatcagaaacaccatgccgttaaagacatattcaagcatcgaccagctacttttagctttaattctcaggcgaataggcgcgtggtggactacaccaatgcgactggttgttaaccccgcggcgacagcggcaagaatgccagataagccaaaatgttccgcaaccagataaacaataaacggcaacagaagcatcaatacaatctgaatggaaggttcatcgtgagcatatcggctgatcaacagcagccctttaccatataaccaggtaacagcgatccccacggcaataccgcccaacgcaacgacaaaaaacgcaatggttgcgccatgaacgctgaattccatcgttcccatcgtcactgcaacagcaaatttcaacgccaccaggccggaagcatcattcatcaacgcttcgccttcgagcacttcctggatgtttttgctgatacgccctttcccgacaatccccagcaacgccacggcatcggtaggcgacaacacggcggctaatgcgaaagcagcgatgagcggcacattcggtaagagtaaatgaatcacatagccgacaccaaaaatagtgattagtaccaacacaagtgccaggctgataatttcccggctgtgcttgatcaattctttaggttgtatttttgaactttcagcaaacaacaggggtggtataaacaataagagaaaaagttcaggattgaattccacatgcagaccaaatataggctgggccagtactgcgccagcggcaatctggattaaaggaaatggtatctggacaggagacagacgtgtaagcacgctggttaatgatactaccaacgtaagaattaaaattgttaaaagtatttccatataataaacaggcttcctcattcataaataatggatattattaatttaacttcataaaaagcgctctggttagcacttaacgttaatcattaatcactgcgttcactcacatgatcagaaggaacccagtaaaatgagttttcaagttgataacaaattcaccacgtgaatatttactgcctttccccgttgtaacgaatcatccgttactctctgatttccttgccgaacaagttatttagtgaatgacggttttcttttaatatcagcatgaattatacgttcagcaaatgtattaaatcagcactaaataaatttaatggataccaccattctgcgtcaacacttagtttttatctgtattgacaatttaaaatggccgcagccaaattaatgattttatttttaataaatcatcaacagaataagagatcttatcagcggtaactaaactcatcagagggtgttccttgtaacgtcatgcattacataactttaagatatacaatcaaaaaatgcattaaaaaccgattaaaagcagcaaagtattacccggtgcacgaatttatgatacatctgcagccattctgctattcgctgactacttttcagtaatgactgctttttcataaggtttcactcccgacaacaatgttggagttttatttccttagcatggagtaagtaaagatgagcaaaataatagcgatgctaattactgtcagtaccctttttttaccgtcaataatccaggcaaaacctatttcaataaaagttgcctatgaaaataaccctggagaacccctggatgtggtcatgcgttactgggcagacctattaaataaaaaaagtaatggcgaaataacacttgcgctctatcccagctcccaattgggatcaaaacaggatgtcaccgagcaagccatgatgggcatgaatgtcataaccttgagtgatgtggcttttcttgccgattatgaacccgatttggggattttgtttggaccgtatctgactgacgatccgcaaaaactgttcaaaatatatgaaagcgactggtttaaacaaaaaaatgaaagtctgaagaaaaagggaattcatgtggtaatgaataattatctctatggcactcgacagattatttcgaaaaaacccattcgcaccgttgacgatctcgcaggtttaaaaattcgcgttcctaataacgtcatgcaaataaaagccattcaggcgatgggggcaacaccaactcccatgccattaggcgaagtttatcccgcattaacccagggcgttattgacggcgtagaaaacccaatttcagtgctgcaagggcaaaaactgtatgagcaggcaagatatctgacaatggttaactacctgacaaatacctcagtgtggataggtggtgaagccttctttagcaccctttcaccagaacaactggagatgatccaccagaccggctatgaagcgggtgtctatagccagaaactcactcttgagcgtgatgccgaaatgttgaaaaccatgcaggcagccggcgtcgaagtgatctatcccgatactggaccattccagaagaaagcacgcgaagtttactctcaattcccggaatggacaccaggtctgtacgaaaccattcaacagcaactgcaataagcattaatgctcagcgtcctgcctcatctctcttaggcaggacacgcactaacaggaggtttcatgcgtctttttggcaaagtggcagaatttagtgctgcctttgcgctattcgttctggttgtggtgacaattggagcggtatttatgcgttatttcatcggccaaccgcttcaatggacagaagaaatgtcgggaatgctgatgatttgggtggtgatgttaggtggagtggtggcggaacgtgacagggcgcacctgaccattcccttcctgatggagatgcttccaggcaaactcaggcgtgttattgcagtactggtcgcccttctctccatcgcactgctgctttatatggcctggctgggctaccgactagccgaaatggcgcagtttaaagtgacacaaattctgaaagtttcctggttctggatcgatctggcggtccctgtcggcgcactggcaacggctatttataccctctactggttaataaacgatacaaaacaatccgatagcggagacaaaatgcaatgagttggttattgattattccgctaatgatcgtctgtttgtttctcaacattcgggtctatctggcgatgtttattggcatcatcgcttactttttattcttctccagcgtaccgattgaaattgccgtgcaaagactaatcgcgccaacgcaaagcccatcattgctggcaattccgttttttatcttgctcggcacactaatgagctacaccggcattgccgaacgcatcctgcacattgccaacgttctggtggggaaaatgcgcggcggactgggcgtggcaaacattctcgtcagcaccatgatgggcggcgtcagcgcctctaaccttgctgacgcggcgatgctgtcgcgcatgatggtgccggagatggaacgtaaaggctacaatcgcgcgtttgccgccgccattaccgctggtggctcgttagtcaccccgatcataccgcctggaatagccctgattatttacggtctggttgccgatgtctctatcggaaaaatgtttatcgccggactggtacctggtttgctatgcgcagtcgtactgatgtttaccgtctaccttgtcgcccgcaaaactaacgctaaaccctcgcgtgaaagctggcctacgggcaaagaggtggtgttctcgctgggacaggcctggcctgcgctgttcctcatttttgctgtggtgggtggtattcgcgctaacattttcaccccaacagaagcaggtgcagtagcggtgctaatcgtgctggcgattggcttttttatctatcgtgaaatgcggatttctcatgtcgtcaaagcattgggcgaaacggcacgcgcaaccgcatcggtgatgctggtaatcatggccagcgccgcattgggatggattttctcaatggaacatgctggtgtcgcagtggcgaattttgtgacttcgctgaccgaaaacaaatacatgttcctgttgattatcaacatattgctgctgacgctggggatgtttctggaaggaaacgccattttgctgatcctggtaccactattaaaaccggtggtcgaacactttggcatcgatccggtgcattttggcatcatcatgatcttcaacctgtcgattggcgcattcacgccaccggtaggtaccgtgatgctgctggtatgtaatatcacgcaagtttcggtgggaaatttctttaaacaatccctgcccctactggcggctctactgttaatgctaatgctggtgacatatatcccggcgatttcactgttcctggtttaataataaaaacgccggatgaaatactcatccggcatcattacgttaaaacgtttcccagttctcctcgctatctgccacggccattttgcgcggcgtagctggcgtcacggtttttaccacagccgatgcttcacgctgctgttgctgaatccggaacactgccactgcttcggtcaggcgactggcctgttcttccagcgcggcggcggcggcggcagattcttccaccagcgcggcgttctgttgagttacccggtccatctcagcaaccgctaagccaacctgatcgataccacggctctgctcatcagaagcagaagcaatttcgcccataatgtccgtcacgcgggtcacggcactgacaatctccgccattgtttccccggcgctttcgaccagcgtagagccaacatccactttccccaccgagtcttcaatcaggcttttaatttcacgagcagcctgagcgctacgctgggccagattacgcacttctcccgcgaccaccgcaaaaccgcgtccttgctcacccgcacgcgcagcctcaaccgccgcgttcaaagccagaatattggtctggaaggcaatgccgtcaattacgctgataatatcggcgattttctgcgaactggtggagatatcgcgcatggtctgcaccacgttatccaccactttgccgccgcgttgcgccgtttcggaagcacttaacgccagatggctggcctggcgcgcattttcggcattctgtttcaccgttgcggtcagttgctccatgctggctgccgtctcttccagcgaagcggcctgttgctcggtgcgcgaagagagatcgttattgccggtggcgatttcgctggcaccgctatagatggcattggccccgttgcgcacatcaccgacggtacgcatcagctctccctgcatatggcgcaaactctctgccagttgccccatctcattagagccatccacctcaatcggtttcaccagatcgccgcctgcaatatgacgaatgctgtcaatcaggcgattcattggcgctaccagcgaggctttaataccgaaccagacggcgaggatgaccgccagtacgacgatcatcacgcctaccagaatccacatcgcctggctgtaggaggcattgttatcgctgacggcgatatcatagagccgatcgttttgctccatgtaagccacatactgcttctcgaaaccgtcctgatatccctgggtcggctgatcaaagaactcgttgattttgcctgcacctaacagttgtatcagctccgccagcgcattgtgataaatatcgtaattacgtttgatctctgccgctgcggcggtgctctgacgcgggtcacgcggcaacgcttcgtaatccgcccagtttttttccgcctgtttcagcgaaatactggcactctgcatcagctcagcaacggttgaaccgctaccaatattgttctgatccatcatgtagcggatacccgcgcggttgagggtgttacgcgtctgcaacaaagcgacccagctgccattcagcgtggattgctgctggcgaatggtttgtaaaacagtgaaattttctttgtcgttctttaaggcattaaagaacagaccgcctgaagtcagttgtaaaaggccaaaaacggccaaaaccagcagtaggctggtcacaattttgatacgttttaacatggtttctctttcctgtggaccgatgcaagattttcggcctggaaaggaaaaactttatgaaaatcccgcggagatgacgccgagtaattttattcaccccctgaatttaaaaagccattatttacataaattattcgcaatataaatatgtgatataaatcacatatttatggtcacttaaacgacgcctttgccgctcaccgccattcctgaccgcttacgtccctaaaataaccactcagttatttaccttactttacgcgcgcgtaactctggcaacatcactgcaggatagcggtcaatttacctcctcaaacgcaacgcaaacctagaacggcttcggccaactattaatcaatacatgccaggttttactatggatactaaaaagatattcaagcacataccttgggtgattctcggaatcatcggtgcattctgcctcgcggtagttgcattacgtcggggggagcacgtcagcgccctgtggatcgtggtcgcctctgtgtcggtgtatctggtggcgtatcgctactacagtctgtacatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggtgggtccggttctcgccgcgcagatgggctacctgcctggcacgctgtggctgctggcgggggtcgtgctggccggtgcggttcaggactttatggtgctgtttatctcctctcgccgtaacggcgcatctcttggtgagatgatcaaagaagagatgggaccagtaccggggactatcgcgctgtttggctgtttcttaatcatgatcatcatcctcgccgttctggcactgattgtggttaaagccctggccgaaagtccgtggggggtcttcaccgtttgctcaaccgtaccgattgcgctgtttatgggtatctacatgcgctttattcgtccggggcgtgtgggtgaagtctctgtcattggtatcgtgctgctggttgcctctatctacttcggtggcgtgattgctcacgatccgtactggggtccggcactgacctttaaagataccaccattactttcgcgctgattggctatgcgtttgtttccgcactgctgccagtgtggctgatcctcgcaccgcgcgactatctggcaaccttcctgaaaatcggcgttatcgtcggcctggcgctgggtatcgtggtgctgaacccggaactgaaaatgcctgccatgacccagtacattgacggtactggcccgctgtggaaaggcgctctgttcccgttcctgttcatcaccatcgcctgtggtgcggtatctggcttccacgcgctgatctcttccggcacgacgccgaaactgctggctaatgaaaccgacgcgcgtttcatcggctacggcgcaatgctgatggagtccttcgtggcgattatggcgctggttgctgcgtccatcatcgaaccgggtctttacttcgcgatgaacaccccgcctgctggcctcggcatcaccatgcctaacctgcatgaaatgggtggcgagaacgcgccgatcatcatggcacagctgaaagacgttaccgcacacgcggcagcgaccgtcagctcctggggcttcgtgatttcgccagagcagatcctgcaaaccgcgaaagacattggtgagccttctgtcctgaaccgtgcaggtggtgcgccaacgctggcggtaggtatcgctcacgtgttccacaaagtgctgccgatggctgacatgggcttctggtatcacttcggtattctgttcgaagccctgttcatcctgaccgcgctggatgcgggtacccgttctggccgctttatgctgcaagacctgctgggtaacttcatcccgttcctgaaaaaaaccgactctctggttgccggtatcatcggtactgcgggctgtgtgggtctgtggggctacctgctgtatcagggcgtggtcgatccgctgggcggcgttaagagcctgtggccgctgttcggtatctccaaccagatgctggcagccgtggcgctggtactgggcaccgttgtactgattaagatgaagcgcacccaatacatctgggttaccgttatcccggcagtatggctgcttatctgcaccacctgggcgctgggcctgaaactgttcagcaccaacccgcagatggaaggcttcttctacatggcgagccagtacaaagagaagattgctaacggtactgacctgacggcgcagcagattgccaacatgaaccacatcgttgtgaacaactacaccaacgcaggcctgagtattctgttcctgattgtggtgtacagcatcatcttctacggtttcaaaacctggctgaaggtgcgtaacagcgacaaacgtactgacaaagaaacaccgtacgttccaatcccggaaggcggcgtgaagatctcttcgcaccactaaccggttgccttatccggcttacaaaatgtctatcgtaggccggataaggcgtttacgccgcatccggcaaatccccagcccggaccttccgggctttacgcatatctggaaggcaaaatgtttggtaacttaggacaggcaaaaaaatatctcggccaggcggcgaagatgttgattggcattccagactacgacaactacgtcgagcatatgaagaccaaccatcccgacaagccgtacatgagctatgaagaattcttccgcgaacgccagaacgcgcgctacggcggcgatggtaaaggcggtatgcgctgttgttaatggagagagcatgaacccgattgcagttaccctactcaccggttttttaggcgcaggaaaaaccaccctgctgcgccatattcttaacgaacaacacggctacaagattgccgtgattgaaaacgaattcggcgaagtctccgttgatgatcaactgattggcgaccgcgccacgcagatcaaaacgctgaccaacggctgcatctgctgttcgcgctccaacgagctggaagacgccctactcgacctgctggataatctcgacaagggcaatattcagttcgaccgtctggtcattgaatgcaccggcatggccgatcccggcccgattattcagacctttttctcccatgagattttatgccagcgttacctgctggatggcgtgattgcgctggtggatgcggtacatgccgatgagcagatgaaccagttcaccatcgcccagtcccaggttggctacgccgaccgtattctgctgactaaaaccgacgtcgcaggcgaagcagaaaaactgcgtgaacgcctggcgcgcatcaacgcccgtgcaccggtctacaccgtcacccacggcgacatcgacctgggcctgttgttcaacaccaacggttttatgctggaagaaaacgtcgtcagcaccaagccacgttttcactttatcgcggacaaacaaaacgatatttcgtcgattgtggtggaactggattacccggtagatatcagcgaagtttcccgcgtgatggaaaacctgctgctggaatcggcagataaactgctgcgttacaaagggatgctgtggattgacggcgaacctaaccgcctgctgttccagggcgtccagcgcctctacagcgccgactgggacaggccgtggggcgatgaaaaaccgcatagcacgatggtgtttatcgggattcagctgccggaggatgagattcgggcggcgtttgcggggttgaggaagtaaggggttatgggccggataaggcgcagccgcatccggcctgatatttcactcaaaataatccatatccagtttcggcaccttcaacaaacgtgaagaaacccctacttcgttttcgatcattaagtgcaccaggcgttccccatcaaccaacaccataccctcgacggattgggcaaagtcacgcgcctgagaagtaaatccagaagtggtaataaacaccccacgtttcgctttttgcccagccagtgcgccgtaaaatgcctgtaattctggcctgcctacagtattctgccaacgttttgcctgaacataaactttctccaggccaagtttatcaagcgatatcacaccatcgatgccaccatctccagtaccgccaacacgctgcaaatcatcacggtggccgccataccccaggcgatgcaaaacatccagaacaatgacttcaaagcgcgaaggagaaacctgcaataagttttccagaacctcatcagccaccgcatcacgaagctcttttagcgcctgatctaaccgatcgtccgggctgctctttgcaagttcttcatgatcgggagagtcggctttcggatctaaatcgacggcatccggccgtgacttaagtttgacattcacaaaattgaaggccagatggttcatctcctgctccgtcattggctggggatgagacgcaacccagtcaaaacccgcaggagtcaggcaccatttgccacgcgacaaactttgcgacaacccggcacgttttaaacggtcatgtgcccagcctgcacgatttttataaacaagttgtccgctggtaatgactttcgatcgctggctgtcatccagtcctaatgcatccgcggcagcctcatgaacatcacgcgcggctgcaccttccggttttgttgccagataacgcagaacaggttcaataaatttgtcataggtaggaaccgtcatagtacatccttgcagaatcaggtagatgtttttcggctactataacactaccaaaatagacgaacacgttagaaatgagtcagttgctgtgactccggtcattgcccggaaaggtacagaaagctaagatagggcgttatgggccttaaatatttggacaggcccacacagcaatggattaataacaatgatgaataaatccaacttcgaattcctgaagggcgtcaacgacttcacttatgccatcgcctgtgcggcggaaaataactacccggatgatcccaacacgacgctgattaaaatgcgtatgtttggcgaagctacagcgaaacatcttggtctgttactcaacatccccccttgtgagaatcaacacgatctcctgcgcgaactcggcaaaatcgccttcgttgatgacaacattctctctgtattccacaaattacgccgcattggtaaccaggcggtgcacgaataccataacgatctcgacgatgcccagatgtgcctgcgactcgggttccgcctggctgtctggtactaccgtctggtcaccaaagattatgacttcccggtgccggtatttgtgttgccggaacgtggcgaaaacctctatcaccaggaagtgctgacgctaaaacaacagcttgaacagcaggcgcgagaaaaagcgcagactcaggcagaagtcgaagcgcaacagcagaagctggttgccctgaacggctatatcgccattctggaaggcaaacagcaggaaacagaagcgcaaacccaggctcgccttgcggcgctggaagcacagctcgccgagaagaacgcggagctggccaaacagaccgaacaggaacgtaaggcttaccacaaagaaattaccgatcaggccatcaagcgcacactcaaccttagcgaagaagagagtcgcttcctgattgacgcgcaactgcgtaaagcaggctggcaggccgatagcaaaaccctgcgcttctccaaaggcgcacgcccggaacccggcgtcaataaagccattgccgaatggccgaccgggaaagatgaaacgggtaatcagggctttgcggattatgtgctgtttgtcggcctcaagcccatcgcggtggtagaggcgaaacgtaaaaatatcgacgttcccggcaagctcaatgagtcgtatcgctacagcaaatgcttcgataatggcttcctgcgggaaaccttgcttgagcattactcaccggatgaagtgcatgaagctgtgccggagtatgaaactagctggcaggacaccagcggccaacaacggtttaaaatccccttctgctactccaccaacgggcgcgaatatcgcgcagcaatgaagactaaaagtggcatctggtatcgcgacgtgcgtgatacccgcaatatgtcgaaagccttacccgagtggcatcgcccggaagagctgctggaaatgctcggcagcgaaccgcaaaaacagaatcagtggtttgccgataacccgggcatgagcgagctgggcctgcgttattaccaggaagatgccgtccgcgcggtggaaaaggcaatcgtcaagggtcaacaagagatcctgctggcgatggcgaccggtaccggtaaaacccgcaccgcaattgccatgatgttccgcctgatccagtcccagcgttttaaacgcattctcttccttgtcgatcgccgttctcttggcgagcaggcactgggggcgtttgaagatacgcgtattaacggcgacaccttcaacagcattttcgacattaaagggctgacggataaattccccgaagacagcaccaaaattcacgttgccaccgtacagtcgctggtgaaacgcaccctacaatcagatgaaccgatgccggtggcccgttacgactgtatcgtcgtcgatgaagcgcatcgcggctatattctcgataaagagcagaccgaaggcgagctgcagttccgcagccagctggattacgtttctgcctaccgtcgcattctcgatcacttcgatgcggtaaaaatcgccctcaccgccaccccggcgctgcatacggtgcagattttcggcgagccggtttaccgttatacctaccgtaccgcggttatcgacggttttctgatcgaccaggatccgccgattcagatcatcacccgcaacgcccaggagggggtttatctctccaagggcgaacaggtagagcgcatcagcccgcagggagaagtgatcaacgataccctggaagacgatcaggattttgaggtcgccgactttaaccgtggcctggtgatcccggcgtttaaccgcgccgtctgtaacgagctcaccaactaccttgacccgaccgggtcgcaaaaaacgctggtcttctgcgttaccaatgcccatgccgatatggtggtggaagagttgcgtaccgcgttcaagaaaaagtatccgcaactggagcacgacgcgatcatcaagatcaccggtgatgccgataaagacgcgcgcaaagtgcagaccatgatcacccgcttcaataaagagcggctgcccaatatcgtggtaaccgtcgacctgctgacaaccggcgtcgatattccgtcgatctgtaatatcgtgttcctgcgtaaagtacgcagccgtattctgtacgagcagatgaaaggccgcgccacgcgcttatgcccggacgtgaataaaaccagctttaagattttcgactgtgtcgatatctacagcacgctggagagcgtcgacaccatgcgtccggtggtggtgcgtccgaaggtggaactgcaaacgctggtcaatgaaattaccgattcagaaacctataaaatcaccgaagcggatggccgtagctttgccgagcacagccatgaacaattggtggcgaagctccagcgcatcatcggcctggccacgtttaaccgtgaccgcagcgaaacgatagataaacaggtgcgtcgtctggatgagctatgccaggacgcggcgggcgtgaactttaacggcttcgcctcgcgcctgcgggaaaaagggccgcactggagcgccgaagtctttaacaaactgcctggctttatcgcccgtctggaaaagctgaaaacggacatcaacaacctgaatgatgcgccgatcttcctcgatatcgacgatgaagtggtgagtgtaaaatcgctgtacggtgattacgacacgccgcaggatttcctcgaagcctttgactcgctggtgcaacgttccccgaacgcgcagccggcattgcaggcggtgatcaatcgcccgcgcgatctcacccgtaaagggctggtcgagctccaggagtggtttgaccgccagcattttgaggaatcttccctgcgcaaagcatggaaagagacgcgcaatgaagatatcgccgcccggctgattggtcatattcgccgcgctgcggtgggcgatgcgctgaaaccgtttgaggaacgtgtcgatcacgcgctgacgcgcattaagggtgaaaacgactggagcagcgagcaattaagctggctcgatcgtttagcgcaggcgctgaaagagaaagtggtgctcgacgacgatgtcttcaaaaccggcaacttccaccgccgcggcggtaaggcgatgctacaaagaacctttgacgataatctcgacaacctgcttgataaattcagcgattatatctgggacgagctggcctgacacgtatacacttcatccttcaggctgcctctgcgttggctgcgctcgttcaccccggtcacgtacttctgtacgctcccggggattcactcacttgccgccttgatgcaacctgaatgattttgtgtatattaccctcggcaatttcttcttctgcggccccaaacaatgcgggccgttgtttaatttacggaactcacaatgaacaataacgatctggtcgcgaagctgtggaagctgtgcgacaacctgcgcgatggcggcgtttcctatcaaaactacgtcaatgaactcgcctcgctgctgtttttgaaaatgtgtaaagagaccgggcaggaagcggaatacctgccggaaggttaccgctgggatgacctgaaatcccgcatcggccaggagcagttgcagttctaccgaaaaatgctcgtgcatttaggcgaagatgacaaaaagctggtacaggcagtttttcataatgttagtaccaccatcaccgagccgaaacaaataaccgcactggtcagcaatatggattcactggactggtacaacggtgcgcacggtaagtcgcgcgatgacttcggcgatatgtacgaagggctgctgcagaagaacgccaatgaaaccaagtctggcgcgggccagtacttcaccccgcgtccgctgattaaaaccattattcatctgctgaaaccgcagccacgtgaagtggtacaggatccggcagccggtacggcgggctttttgattgaagccgaccgctacgttaagtcgcagactaacgatctggacgaccttgatggcgacacgcaggatttccagatccaccgcgcgtttatcggcctcgaactggtgcccggcacccgtcgtctggcgctgatgaactgcctgctgcacgatattgaaggcaacctcgaccacggcggcgcaatccgtctgggcaacaccctgggcagcgacggcgaaaacctgccgaaggcgcatattgtcgccactaacccgccgtttggcagcgccgcaggcaccaacattacccgcacctttgttcacccgaccagcaacaaacagttgtgctttatgcagcatattatcgaaacgctgcaccccggcggtcgtgcggcggtggtggtgccggataacgtgctgtttgaaggcggcaaaggtacggacatccgtcgtgacctgatggataagtgtcatctgcacactattctgcgtctgccgaccggtattttttacgcgcagggcgtgaagaccaacgtgctgttctttatcaaagggacggtggcgaacccgaatcaggataagaactgcaccgatgacgtgtgggtgtacgacctgcggaccaatatgccgagctttggtaaacgcacgccgtttaccgacgagcatttgcaaccgtttgagcgcgtgtttggcgaagacccgcacggcttaagcccgcgcactgaaggtgaatggagttttaacgccgaagagacggaaattgccgacagcgaagagaacaaaaacaccgaccagcatcttgctaccagccgctggcgcaagttcagccgcgagtggatccgcaccgcgaaatccgattcgctggatatctcctggctgaaagataaagacagtattgatgccgacaacctgccggagccggatgtattagcggcagaagcgatgggtgaactggtacaggcgctgtctgaactggatgcgctgatgcgtgaactgggggcgagcgatgaggcggatgcgcagcgccagttgctggaagaagcatttggtggggtgaaggaatgagtgctgggaaattgccggaggggtgggaacagattgaaataggcgacattgctgatgtcatctctggtgggacaccaaaatcgggagtcgctgaaaattttgcaccttcgggtgagggagtcgcctggcttacgcctgccgatttgagcggttataaagagaaatatatctcacatggtgccagagatttaactacactaggctattcctcttgttcagcaaaactaatgcccaaaggcactatactttttagtagccgggcaccgattggatatgttgctattgctgcaaatgagattgcgactaaccagggtttcaaaagttttgcttttccttcagacatttttcctgattatgcatattactttctccgcaacatcagacatattgcagaggaaatgggcacaggaacaacttttaaagaaatttctggtagttctgcgaaaacattaccatttgttcttgtaccgtttgccgaacaaaaaatcatcgctgaaaaactcgatacgctgctggcacaggtagacagcaccaaagcacgtcttgagcaaatcccacaaatcctgaaacgttttcgtcaggcggttctgggtgcagcggtgagaggaaaactaactgaagactggagagataattcaagcctgtctgggtggagagaaggcaaacttggggagtttataaaaaaaccaagttacggaacgtcatctaagtctaataaagaaggactcattcctgtattaagaatgggcaatcttcagggaggaaagttggactggacggatctagtctatacgtcagataccatagaaattgaaaagtataaacttgagtacaatgatgtattattcaatcgtacaaatagtcctgaacttgtcgggaaaacagccatatataaatcagagcaaccagctatttatgcaggttatttgattagggttcaatgtttacctgatttaaaccctgactatcttaactaccatttaaatagcattttggggagacaatattgctattcagttaaatctgatggggtcagtcaatcaaatattaatgcacagaaattaattgcatacccaataactgttcccccccttcccgaacaagctgaaatcgttcgccgcgtcgagcaactcttcgcctacgccgacacaatagaaaaacaggtcaacaacgccttagcccgcgtcaacaatctgacgcaatccatcctggcaaaagcgttccgtggtgaactcaccgcccagtggcgggccgaaaacccggaattaatcagcggtgaaaacagcgccgccgcgttgctggagaaaatcaaagctgaacgcgcagccagcgggggtaaaaaagcctcgcgtaaaaagtcctgatcattattttctggcgcacctttctggtgcgctatttattatttttacgccaatcataactcacacaaatatatttaaatcgttccagaaacttcccattttattctatttttagctggactttccctgtatttactgatgatatatccaggtatttagcgcgatgcggatgtgcgccaacacacccgcaccgctcatcacaatcactatttatggagaatagtaatcatgactgacacgcattctattgcacaaccgttcgaagcagaagtctccccggcaaataaccgtcaattaaccgtgagttatgcgagtcgctacccggattacagccgtattcccgccatcaccctgaaaggtcagtggctggaagccgccggttttgccactggcacggcgatagatgtcaaagtgatggaaggctgtattgtcctcaccgcccaaccccccgccgccgaagagagcgaactgatgcagtcgcttcgccaggtgtgcaagctgtcggcgcgtaaacaaaggcaggtgcaggagtttattggggtgattgcgggtaaacagaaagtcgcctgatacattgacccggtagcgccagtgctaccgggtattattcgccacgttataccaacgcgctctccatctgtttttcaaatgcctgacgaattaatcccataatgtaaggaagttgtgcgaggtcactgaaaccaatttccacatcaccattgccccatcgcccaacatttgtcacatct

SEQ ID NO: 10013 - DNA, 18638 bp, Escherichia coli
aggaagcgtaatatacgccacctcgcgacagtgagctgaaagccgcgtcgcaactgctctttaacaatttatcagacaatctgtgtgggcactcgaagatacggattcttaacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgccygatggagggggataactactggaaacggtagctaataccgcataacgtcgcaagaccaaagagggggaccttmgggcctcttgccatcggatgtgcccagatgggattagctagtaggtggggtaamggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgaagtgctcacacagattgtctgatgaaaatgagcagtaaaacctctacaggcttgtagctcaggtggttagagcgcacccctgataagggtgaggtcggtggttcaagtccactcaggcctaccaaatttgcaccgcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaatgaaagttgttcgtgagtctctcaaattttcgcaactctgaagtgaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctctttatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggtaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcgacaggtcagaacaggacgtgttgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaatttagcagtaagccggttataaaccggtggttgtaaaagaattcggtggagcggtagttcagtcggttagaatacctgcctgtcacgcagggggtcgcgggttcgagtcccgtccgttccgccacttattaagaagcctcgagttaacgctcgaggttttttttcgtttgtatttctattattgccaaaatcgcaaaaatcctctgcgttttacgccatttttccacaactgtctgaagcccataatcacctcagttaacgaaaatagcattaaaagaggcatattatggctatccctgcatttggtttaggcactttccgtctgaaagacgacgttgttatttcatctgtgaaaacggcgcttgaacttgattatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccgagtctgaaagagagcctgcaaaaattgcgtaccgattatgttgatctgacgctaatccactggccgtcaccaagcgatgaagtctctgctgaagagtttatgcaggcgctgctggaagccaaaaaacaagggctgacgcgtgagatcggtatttccaacttcacgatcccattgatggaaaaagcgattgctgctgttggcgctgaaaacatcgctactaaccagattgaactctctccttatctgcaaaaccgtaaagtggtcgcttgggctaaacagcacggtatccatattacttcctatatgactctggcgtatggcaatgcactgaaagataaggttattgctcgtattgcagctaaacacaatgcgactccggctcaagtgattctggcgtgggctatgggggaaggttactcagtaattccttcttctactaaacgtgaaaacctggagagtaatcttaaggcacaaaatttacagcttgatgccgaagataaaaaagcgatcgccgcactggattgcaacgaccgcctggttagcccggaaggtctggctcctgaatgggattaagcctctctgacagctcctccgggagctgtttttacatgtccgctaaggaaatcgataaaagcccggatgcgcgtacttaccgcacggtcgctgtaatagactgcactgaatggcatttccactggcaacactttatctgccattaactccaccaattctccgcgagcgatttctttgtcgatcatgtagtcggacaaacacgcaatcccgttgccactcaggcaaagctgtttcagtgtttccccactattggatgacaaaccgtacttcacctcatgtaattgtccatcgctacaggctatcggccaggtattgagggaagcgggttcagtgaatctcaggcaaatatgttgctttaaatcgtcgatcgtttctggcttcccgtagcaggaaatataatcgggggaggcgataatttttcgataactgttaaataacggcctggcacgtaagctggaatccgttaacgtaccggcgcgtatcgcgacatccacttttctttcgatcaaattaataatcgtttcggaggagactagcgataaagtgacttccggatagcgttcacgaaaaggcttaatcaacggcatcagaaagtgcagcaccactggagttgcggcatcgatccgtaacagtccacgcggtgtattacgcgtctccataatttctgattctgccgctgccatctcctgcaaaattgactgtacgcgatgaaaataacgctcgccttcttccgtcaggctaagttgccgcgtggtccgattaagcaggctaacgccaagtttcatctccagctttttcaccgcccggcttaccgctgagtttgcttgccctaattgttccgctgcccggctaaagctgccgctttcgacgactgaaacaaaaatggcgagttcttccgacgtggctttcatttttgctcctgttgcaaaatagaagagatattttgaatttatttgtcattaaaccatcaggatgcgagatatgccatccgatttaatgttctcaataatgagcaaaatcctgaccggtgtaagcacttgcttacataacaatatacaattgctcgttgaaagagtgagctaaaatccctataacagtagaaccctcccgagtgcggaagggttgacgtgatagaggtttcaaagtcaaaagtgcgaaaaaacacctatgccatgcgctatgttgccggacaacctgcggaaaggatcttaccgccggggtcttttgcgagcatcggccaggcattaccacctggagaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgactgctaactatcttgccgccgatcaggtacccgctttcgtgctgccacaacatccttctggcgtaatgaccctttcggcggcacatccagtgtattgctgcccgttacgtgaacgagaacccattttgcgtctggcgaaatcggcactggtgacggtctatcccttacctgacacccgcctgttgatggtggttaatatacacgccgtcaacttcagtctgggcgtggatgtctatagtaagcagttacttcctattggcgatcagatagctcaccacagtggcccggtcattatggcgggagatttcaatgcctggagccgtagaaggatgaacgcgttatatcgctttgcgcgggaaatgtcgctacgccaggtgcgttttaccgatgatcagcgccgtcgggcgtttggtcgcccgctcgattttgttttctaccgtggtctgaacgtcagcgaagcttctgtactggttacgcgcgcttccgatcacaatccgctactcgttgaattcagtcccggcaagcctgataaataaggtatgtcaggtctgccacagggcagaccaacgtttggcgctgcccttttatactcaaacaacaaaaggacagcgcaatgacaacacaatcccaccatgaccacgtagaaaagcagtttagctctcaagccagcgaatatctgaccagtaccgtacatgcatccggacgagatttacagcgcctggcggtgcgtctggctgattatcctgatgcaagtgtacttgatatgggctgcggagcagggcatgccagctttgttgctgcgcaaaacgtgagcgcggtggtagcgtatgacttatctgcccaaatgctggatgtcgtggcacaagctgccgaagcccggcaactgaaaaatatcaccacccgccagggttatgccgaaagtctgccatttgccgataacgcatttgatattgttatcagccgttattctgcccatcactggcatgatgttggtgcagcactgcgtgaagtgaaccggatattgaaacctggcggtaggctgattgtgatggacgtaatgtctccgggccacccagtgcgcgacatctggttacagacggtagaagcattacgcgatacctctcacgtacgaaactacgccagcggtgagtggttgaggttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgaaaacgtattttgccttgcagaatgatggctctttcaccagtgatatcatcatggtagaagcacataaagcagcataaataaaaaaggcaccgggggaatcggtgcctttcattatctggtttgtcaggaatctggcatgttgttgtttttcacaaacaacgtcagcttatcgcctggttgcagattcgcagtatcgctgttccagcgcatcacatctttgatgttcacgccgtggcgtttagcaatgcttgaaagcgaatcgcctttgcgcacacgatacgtaatgctatcgctgttgtttgccaaccgctgtgcgctactacctgcgccaatcgtcaagctttggcctggcttcagcttagatccgcgcagtttgttccactgctgcaaatctttggtgctaacgccgagacgtgaagcgatacttgaaagcgtgtcgccagagcgtacggtgtaaacacggctgttaagcggcgtattgtcggcaaccagcgtcgactgtacagcagcaatttcgcccgaagccagagattcacgcagttgatctgcatgcttctttggcaccatcacgtactgcggaccacttgcgcccagcgtggagcctttcacgccagcgttgaatgtcttcagcttgctgacggaaatccccgccatatctgcaaccttcgccatttcaaccgggctgctcaggtgcacacgcgccagagcacggctttcatcggtcgttggcagacgtacgccataacgcttgctgtttttgagaatatcactcaatgccagcattttaggcacgtactgcttcgtttcctgcggcaacggtaacgaccagaagtccgtggatttcccacgcgctttgttcgttttaattgccttcatgacccgaccttcgccgctgttataagccgctacggtcagaagccagtcgccgtcaaacatcttgttcagacgctgcatcatgttcagcgcggcagttgttgaagcaacaacatcgcgacgcgcgtcataattgcgtgtctgtttcaaaccataattgcgccccgtgctcggaatgatctgccagatgcccgcggcattggcgccagacgttgcgtgaggatcaaaagcgctctccactatgggtagtagtaccagttccataggcatgttacgttttttaacttgcccggctatccagtacatatacggctctgcccgtaaagttacatcgtggagatagctcttattgcgtaaatatttctgtttctgttcgcgaatccggtcgttttccggaattcccatctttagctcgtcgccaatgaaagcccacaagtcaccatctggcgcgatagacgtcccatcgtccatccatcgtgcctgacttgtaaactttgctgcttccccttgaccagctgcagaaaggctctgtgcgtgctgttgaacgttgccggtgctctggcaacccacgagcaggacagaggcgagtaatatcgcttttgccttcatgtgtgtgtcaatagttgcttaaaagacgaccgatcataacggcgaacggagccgatgacaagaaagttttatcagaacctatctttctttgaccttaaccatgcaaaacgttcttcaggttgttgcaataatgtttcttcattaattacattaattaaatcaatatcttccgttcttaaaaaaacattaatttgccgctcatttttcagaattacgggtagtgttatttgattttttgcccgtaactccttaactttacgataataatcatttatggacaaatcgtgcggaagaatactcaaagcaaacttcatatttgataaggtatattcatgagcacaacataccaatgtatcgtcaggtaacgcacttaactttttaattgattgatacatttgtgatggtgtcccttcaaacaaccgaccacacccaccagaaaacagcgtgtcgccgcaaaatagataaggtttactgaagtaacagatatgtcctaaagtgtgacccggtgtggcaattacactaaattcatgccccaaaacgaaggcagtttcgccatctttgactacctgtgttgttcccttatcttgtgtctcttgtggtccatacaccacaatttgcggaaacttttccaccagttcttttacgcctccaacgtgatcgtggtgatggtgggtgagaaatatggcctccggttgccagttattggcggaaatggcgtttaatactggctctgcgtccccgggatcgacaatcagacagcgacctgcttcatcattcaaaacccagatgtaattgtcatcaaaggcgggaatactgttaagattcatagattacctctcagtgtgaaacggaaggttgtgatgaaaccggcaagagtccctcaaactgtcgtggctcctgattgctggggcgatttgccctggggagagctttatcgcaaggcgctggagcgtcagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtgcaggcggacccacttcatcttccttttgccgataaatccgttgatgtttgtctactggcacatacattgccgtggtgcactgatccgcatcgtttattgcgtgaagccgatcgggtactgattgatgatggctggctggtgattagtggcttcaatcccatcagtttaatgggattacgcaaacttgtgccggtattgcgcaaaacatcgccctataacagccggatgttcactctgatgcggcagctggactggctctctttgttgaattttgaagtgctacacgccagccgtttccacgttctcccgtggaacaaacacggaggaaaactattgaatgcgcatattcctgcgcttggttgcttacaacttattgttgcccggaaacggactattcctttaacgctaaatccgatgaaacagagcaagaacaaaccgcgaattcgccaggcggttggtgccacccggcaatgtcgtaaaccacaggcttaaacttcgacttgatagcctgtatcttccagtgtgggattcattgccgcagcacgagccagttcatcacagcgttcgttttccgggtgtccggcatggcctttaacccattcccatttgatttgatgctgccccagagcagcatcaagacgttgccagagatcgacattttttactggttttttgtctgctgttttccaaccacgttttttccagttatggatccactgggtgataccctggcggacatactggctgtcggtactcaaaatgacttcgcaatgttcttttaacgcctccagcgcgacaatagcggccatcaactccatacggttgttggtggtgcgggtgtagccagcgctaaaggttttctcgcgtccgcgatagcgtaaaatagcgccgtaacccccaggtccaggattacccagacacgaaccatcggtgaaaatttctacctgtttaagcatctctggtagacttcctgtaattgaatcgaactgtaaaacgataagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaggtagccgatgagttcatggactatatccgcggcgcggagctggtgatccataacgcagcgttcgatatcggctttatggactacgagttttcgttgcttaagcgcgatattccgaagaccaataccttctgtaaggtcaccgatagccttgcggtggcgaggaaaatgtttcccggtaagcgcaacagcctcgatgcgttatgtgcccgctacgaaatagataacagtaaacgaacgctgcacggggcattactcgatgcccagatccttgcggaagtttatctggcgatgactggtgggcaaacgtcgatggcttttgcgatggaaggagagacacaacagcaacaaggtgaaacaacaattcagcgcattgtgcgtcaggcaagtaagttacgcgttgtttttgcgacagatgaagagcttgcagcacatgaagcccgtctcgatctggtgcagaagaaaggcggaagctgcctctggcgggcataaatacctgtaaaaggcgctaaaaatagcgacttgggcgatttttgcagcaaacgattcaaaagatgagaaaaaccgttgacgaagggtgaggcaatccgtaatattcgcctcgttcccaacggaacacaacgcggagcggtagttcagtcggttagaatacctgcctgtcacgcagggggtcgcgggttcgagtcccgtccgttccgccaaattcactcatgaaaatgagttcagagagccgcaagatttttaattttgcggttttttcatctaaatcccgctatttcttcggtctatgattttgttatgctgtaaatgtgttaatcacatatgatagaccatgtcattaatatttaatcatgctatcgaatcattcaatttaaatatatttgcacgttatgattttcatttttctattgatttaatgaatttatatttgctgttattttttgtttgttctgattcaagtggagtatataattaaaaatcgttagctaaacattaccatgattatgacaggcgagggagtgtccgattatgaatttaaaaaaggtttgttgtatatgtgtattattctcgctgcttgcaggatgtgcctctgaatctcctattgatgaaaaaaagaaaaaaactcaaaccacacaaatttctattaataaaaacgttccccagcaactaacagacaaagatttatatggtaatgaaaccacactggctgtatccgaggaggatattcaagctgcgcttgaaggagatgagtttcgtgtgcctcttaattctcctgtaatacttgttcagtctggcagtcgcgcaccggaaaccattatgcaggaggagatgagaaaatattatacagttgccacattttctggcattcctgacaggaaaaaaactgtaacctgtaataaagacaaaaacaaagatgaaagcctggatattgtagatgccgaaaatatgaactggatgcaggcattgcgttttgttgcagcaaaaggccatcagaaagcgattattgttttccaggatacgttgcagacaggaaaatatgactctggattgaaatcaatagtttggacagattataaaaatcaaaaattgactgacacgatgtcactgcgttatttggttcgattcacgttggtggatgtggctacaggtgagtgggctacctggtcgcctgtgaattatgaatcgaaagtgatttttccgcagatagggaataaaaattctgacagccttgatgtggcagaacagcagatttcacaacttaagcagaaaacgtatgcagcagtggttaaagacctggtgaatcgatatcagtagtgaggttttataccagacgttttagtggtacttagcaagaaagagcatttctcttttctattttacactatggaacaagtctgctaattaattttacatatatcttttaggagtggtaaaaactttcctaaagttatttattgtcctctcaacatataagctgtaattcgagttttcggttgaactgtcaaaaatacatcatatacatctataaaacagcaggtacggttaattaagaatttttattcgtgattaaccgtactttgtcattttatcctataatgttaaattgcctttttaaaatataacaataatgcagatgaaagactccctggtaacttagaaaatccgttcactccaaaggctgtatgcactggttccggcgacgctgtgctcccaattgatgctctcataggtaaatgacacagactcttccgcctgccctggactgtcgttaatggtatggggaacggtaaggccgatgtttgagagccgggcgttagccagtttcagcttgtagtacggttcattaattccaaagcggttggtgcggtagaatacaaaatcacaggtcagacattcattctctgaaatggccttgcccagcagaggggaggatttgtccaccggtttcgtgatggtcaactcctgatggttgacattctgcgcacggctcagaccatgggacagtgacgtcaccatgatctgatcctgatgtgcaatctgggctttgttaccgatggacggcattgacgagcatccggatgaaatcagcccctgaagttctccgttcagtgtcagatagacgggatttgccattgttattctccttaatctcaatgagttggatggacaggttcggttctgttatccgttgccatatcctgtccggtatttttcagcagcagccagcggcttaacagcccgtccagccgttcgttgatctctttttccaacgcctgtgtgtcctgcttctgtgtacgggtctcctggtactgcgtcagcaggtactccagtggtgtttcttgattcagtaaccgttcggcctgccaggtcaccgttttgatatacgatagggtgaaaccctgtttctccgtctccttcttcatcatcaaatctgcaaaatcccgcaaattctgccgcgcttgttgccagcccttcatctgcggactggcttgcgcccggtttctcagcgtgttgctccacatcctgctggcttcctgctgttgcaggctttccggccagagggtgtctgcggtgcgcatcatctgcattccggtttccagcggctgtagtggcggggcattcagaagctgttgcaggtactgttcatattctttcagtaccggggatgccaaccagacggtggcggctccctgtgtggtatccctgacctgtgtaagctgctgctgcatcggatacgcctgccaccaccagagtgcagatgcgataacggcagtacaggcggcaccggcaacaaaaccttttaccgtgtcgccctgttttgctttgtcggcgttatctgccacaccgcgcacccccacccgcatttccggcaggtcgggtagggggggcatggtttccgctgtggcggaagccgtgccttcaggcgcatagaccagcgttctgaccatggtctgtgccgccgtatcagtacggtttctgggctgcggctcaaaccgcttgcgtgtgttctgcacaaaataaagcagattttccacgcgcggctggcgcttcagttccacttgctggagtttgtcgcagataagctgcaaagcccgttccgtgcggtagagcaacgaaagatcattttcggaaaaggaaacctgctggcgcaggatattcccggtgcgggtgttgaaccagtccagcatctcagtccgcgccggaccactctgcggccagaatttatcccattcgtggatgatcatcgcagccagcagttccgcgccttcacagaaccctgccagtccctgattacgtgtacgtgccagcgtatagtaggtggcggtatgcaaatccaccccgttggccttaaaaatcgacagcgccagcgattccaccagtttccagttcagctccggctgtgacgggtggttagctttgttaatttcttcgcggatggcgctgaactccggcagggcgcgcggatcgctgccggtaacgatagtttgtgtcagtgcgtaattgctcatcactatccccttaatacaacgtatccggtaaacggaacaggctgaacagaccgccggtgaacgggttatcttcggtatccacatgcacctggtaaaccattgcgccgccgtccacgttaaagcgcacgttaaaggtgtcactggtcacattggtcaactggcccgcgccgaacaggcggaactgcgcccacggtccactgaacgcgatactgcgcggtgctctgccgctggtgccaatcagcgtcagcttgctttcattgccttcacgcatgttgttcggccagaccagatgggcggtgtagttgcgtccctggctgtagtccactaactggccgtccaggttaagtacgctgcgccgcttattgccggaaagcgatacggtttccacggcaaactgtgcgcccagcccgttctgctggctgaagaagatgtcgcggattttctgcgcggtatccagttgctgccggatatcttcacggattaacactctgccgtcgtcgccaaaggtcagatcgttttcaaggaacaggcgcaggttgttcttgtagaaattgtccagaatgccatccggtttaaagaaacgttcaaacgaatccagtgaggcatcctgtgtggcgcgcggattaaacggatagttatcggcaagctgctcgttgaagggtttcactacattgtcgcgccagtccacttccatgtaacgaacggcttccaccatcaccacatgccaggcctgatccgcgagcttacctacccagcggttaagaggcgcaggcagggtttttgccatctgacgggtggcgaagattggatcgctgctgttttgatccagccgtagctgtactgctttcagcgccgatttccccggcactggcgagttctggatcgccagcaggtaacggtgcagctcggtcagttgctggtacacggcctgtagcgtactcgccttgtccttttgctcctccagtgcgctgttttccggtgcgaactcatgccccagccgggataacaggcggtaatccatctcatttatcgccgcttccctcgccttatcatccagtttgccggagagcgtcagcgcgtgggtattatcgcgcagcgccgtcagcgcacgctggaatggctgatcgccgctgataatctgctccagcgcgtcggtcagcgccgacatggcctcatagtcacggacgttgaggttatccattccggcacgccaggtggcggtatagtcactgatgtactgttcggtgatatggcgctggatctcttcacggtcggcctcgctgtaggcgacgctttgcgtcaggttcagtacccacgaatccagcgcggtcagctcaacgaggccctcacgctgtttgacaaaatagctttgcagtccatagcgggtgaggaactgcgggatcaccagtttttcatcattaccggcgacgaacacgttgtcgaaggtgggaccaacctggtcgcgcaaattcaaatcggcgggcaacacgcttaatgctttggtgcgcagggtctggtagacacgctggtatatgggcagcttgctcagttcctgctgcgcattaatgatcggtttatcatagggggtccagcggctgacagcatcgctgtcgctgctttggcgctgcgcgtgccagtcggtgtgctccagcgcatagtccagatgcaccatcagttgc

SEQ ID NO: 10014 - DNA, 13516 bp, Escherichia coli
tgcttcgaagaacttgtttatcgctcatcgtcgctgcgtggcgcacatattactttctgagacttataagtcaaacaatttttcccacacttttatcgtttgcacacttcacgctcaattagtctgtaaaaacgtcaaaaagagtgttttatcaacagaaaaacggaggtctgacagatagcagtaatgcaaaaaaatggagacttaagttgaatgaacgggagtaaagcgaaaagacaatggagtgaaagagaaattttgagggtgcgtctcaccgataaagatgagacgcggaaagattagtaactggactgctgggatttttcagcctggatacgctggtagatctcttcacggtgaacagaaacttccttcggggcatttacgccaatacgtacctggttgccctttacccctaaaactgtcacggtgacctcatccccaatcatgagggtctcaccaactcgacgagtcagaatcagcattctttgctccttgaaagattaaaagagtcgggtctctctgtatcccggcattatccatcatataacgccaaaaagtaagcaatgacaaacacattacatctaagcagtcatggcattacattctgttaaacctaagtttagccgatatacacaacttcaacctgactttatcgttgtcgatagcgttaatgcgaatgccgtgaagcgagtccacggcattgcctgacgcttatattattgcaatttcgcgctgacccagcctttcacactggctaacgctgcaggtaaggccgcagcatccgtaccaccggcttgcgccatgtcaggacgtccaccacccttgccgcccacctgctgagcgaccataccaatcagttcccctgctttcacacgatctgtgacgtccttagatacgcctgcaatcagagaaaccttaccttcggctaccgttgccagcacgataattgtcgaccccagctgattttttaaatcgtcaaccatggtacgcaacattttcggctcaacaccgctaagctcgctaaccaacagcttaacaccattaacatcaattgccttactggaaagatttgcgctctcctgtgcggcagcttgttctttaagctgttgtaactctttttccagctgacgcgtacgttccagtactgaacgcactttatcagccagattattgctatcgcctttcagcagatgcgcgacttcgcttaagcgatcgctgtctgcatgaacggtggcgatagcgccttctccggttaccgcttcgatacgacgaacgcctgcagcagtacccgattcagagatgatgcggaacagaccaatatcaccagtgcggctggcgtgagtaccgccacacagctcggtggagaaatcgcccatgctcagcacgcgtacgcgctcatcatacttctcgccgaacagtgccatcgcacctttcgcttttgccgcttcgagatccatgatgttggtttcgatcggcaagttacggcgaatctgtgcgttcaccaggtcttcgaccgcacgaatctcttctggtttcatcgcttcgttgtgtgagaagtcgaagcgcagcactttgtcgttaaccagtgaacctttctgcgatacatgagtacccagaacctggcgcagcgcagcgtgcatcaggtgcgttgcggagtgattcagacgaatacgggcgcgacgagcctcatcaacatcagcctgcacagcgtcgcccactttcagagaacccgcagcaagtttaccgatgtgaccaatcgcctggccgtatttctgcgtatcttccaccgcgaaggagaagttagcgcctttcagttcgcctttatcaccaacctgaccgccggattccgcatagaatggcgtttgatccagcacgaccacagcttcctggcctgcattgatggcatcaaccgctttaccatcaacaaacagcgcggtcactttgccgttcagttccagatggtcatagcctttaaattcagatgcactgtcaacacggatcattgcgttgtaatcggcaccaaagccgctggcttcgcgcgcacgacgacgctgctcttccattgctgcgtcaaaaccagcttcgtcaactttgatgttgcgctcacggcaaacgtcagccgtcaggtcaaccgggaagccgtaggtgtcgtacaggcggaaagcagtttcaccatccagcgtatcaccagaaagttttgccagctcttcatccagcagcgccagaccgcgctccagagtacgggcaaactgctcttcttcagtcttcagcacctgctcaacctgcgcctgctgtcgtttcaggtcttcacccgcagagcccataacgtcgatcagcggaccaaccagtttgtagaagaaggtttctttcgcgccgagcatattaccgtgacgcactgcgcgacgaatgatacgacgcagtacataaccacggctttcattggacggcattacgccatccgcgatcaggaacgcacaagaacgaatgtggtctgcgattacgcgcagcgatttattgctcagatcggtcgcgccagtgactttcgctaccgcctggatcaacgtgcggaacaggtcgatgtcatagttagagttaacgtgttgcagcaccgcagcaatacgctccagacccataccggtatctacagacggtttcggcagcggttccatcgtgccatcggcctggcggttgaactgcatgaagacgatgttccagatctcaatgtagcggtcgccgtcttcttccggacttcccggagggccgccccaaatgtggtcgccgtgatcgtagaagatttcggtgcacgggccgcacggaccagtgtcacccatctgccagaagttgtcagatgcgtatggcgcacctttgttatcgccgatgcgaataatacgttcgcgcgggatccctacttctttctcccagatttcgtaggcttcgtcgtcgctttcatagacggtaacccacagacgctctttcggcagggcaaaccatttttcgctggtcagcagttcccatgcaaactgaatggcatcgtgtttgaaatagtcgccgaagctgaagttgcccagcatttcgaagaaggtatgatgacgcgcggtgtaaccgacgttttccaggtcgttgtgtttaccacccgcacgcacgcagcgttgggaagtggtagcgcgggaataattacgcttgtcgagcccaaggaacacatccttgaactggttcatcccggcgttggtaaacaacaaagttgggtcgttatggggtaccagggagctgctggcaactacctgatgtcccttactatggaaaaagtcgagaaacgcctgacggatctcagcggtgctcttgctcataattatcctgaaatcaagctaacgaaatatcgccaccagctccagcgtgtcttaaccgccgggctggtaactgaaaagtgggaataagataagttttcttgactgggaagtaaaataccgtatgcgttcagtcggcaaaatttcgccaaatatcctggatatcttccatcagatagccacgatagagcagaaaacgctggatcttaactttttctgaaaagacagttggcaaaggttcgccatattttcgcgtcgcctgatcgcgcgccagtgcgcaccagtcgatgtcacattcacgcatcgctttttctgtcgcttcgcgggaaatacctttctgattcagttcctgacgaatacgcgcaggtccataacctttgcggctacggctggcgataaagcgcgcaacaaatcggctgtcatcaagatagccatgttcgtggcaccaggcaataacgcgctcgtaatcttctgccgtggcatcaatctcttccgggccatttttgcccataataggtgccgcgagtttacgtcgcagttcttgctcactgtgatcgcgcaccgccagaatgcgtaccgcacgatccaacaggcgagcatatgccgggcgacgggatgttgattctgtcatggcatatccttacaacttaaaaaagcaaaagggccgcagatgcgacccttgtgtatcaaacaagacgattaaaaatcttcgttagtttctgctacgccttcgctgtcatctacagagaaatccggcgttgagttcgggttgctcagcagcaactcacgtactttcttctcgatctctttcgcggtttccgggttatctttcagccaggcagtcgcattcgctttaccctgaccgatcttctcacctttgtagctgtaccacgcgcctgctttctcgataagcttctctttcacgcccaggtcaaccagctcgccgtagaagttgataccttcgccgtagaggatctggaattcagcctgtttaaacggcgcagcgattttgttcttcaccactttcacgcgggtttcgctacccaccacgttttcgccctctttcaccgcgccgatacgacggatatcgagacgaacagaggcgtagaatttcagcgcgttaccaccagtagtggtttccgggttaccgaacatcacaccaattttcatacggatctggttgatgaagatcagcagcgtgttggactgcttcaggttacccgccagcttacgcatcgcctggctcatcatacgtgccgcaaggcccatgtgagagtcgccgatttcgccttcgatttccgctttcggcgtcagtgccgccacggagtcaacgacgataacgtctactgcgccagaacgtgccagggcgtcacagatttccagtgcctgctcgccggtatccggctgggagcacagcaggttgtcgatatcaacgcccagtttacgtgcgtagattgggtccagcgcgtgttcagcatcgataaacgcacaggttttaccttcgcgctgcgctgcggcgatcacctgcaacgtcagcgtggttttaccggaagattctggtccgtagatttcgacgatacggcccatcggcagaccacctgccccaagcgcgatatccagtgaaagcgaaccggtagagatggtttccacatccatggaacggtcttcacccaggcgcatgatggagcctttaccaaattgtttctcaatctggcccagtgctgccgccaacgctttctgtttgttttcgtcgatagccatttttactcctgtcatgccgggtaataccggatagtcaatatgttctgttgaagcaattatactgtatgctcatacagtatcaagtgttttgtagaaattgttgccacaaggtctgcaatgcatacgcagtagcctgacgacgcaccgcatcacggtcaccgctgaaacattcccgccgggtaatgccttcaccacgggcagtggcaaaagcaaaccagacggtgccgacaggtttctcttcactgccgccatccggcccggcgataccactaatagacacggcgtaatcagcacgagccgctttcagtgcgcctatcgccatttccaccacgacaggttcgctcaccgcgccatgctgtgccagcgtctcttcgcgtacaccgatcatttgcgcttttgcttcgttactgtaggtgacaaatccgcgttcaaaccaggcggaactgccggcaatatcggtaatcactttcgctacccaaccgccggtacaagactcagcagttgttacggttgcgccacgggctttcagcgactgcccaacctgttcgcttaactgcatcagttcactgtcagtcatcacaacctctgtcagtcaaaaatttatgccggacaagataacactttcgtcaggaagatggtgttggcgttgcaattttacgaggaggattcagaaaaaagctgattagccagagggaagctcacgcccccctcttgcaaatagttactgtacgcgcgccagcgccacggcttgtcctaactgccagaccgccattgcgtaatgggtgctgtggttataacgggtgatggtgtagaagttcggcagaccgtaccagtactggtagccggtgccaacatccagacgcagcaggctggcttgttgatggttgcccagcggctgctgtggcgttaaacctgccgcggcaagctgcgaaatgctgtacctggttttgaagccatttggcaagcctggagcctgaccgtttgccattaccgcgacctgatcgcctttcacccagccgtgcgctttgaaataattcgccacgctaccgatcgcatcaaccggatcccacaggttgatatgcccgtcgccgctgaaatctaccgcatattgtttgtaagacgacggcataaactgtccgtagcccatcgccccggcaaaggaacctttcagattgagcggatcgtcctgctcgtcgcgcgccatcagcaggaaggtttccagctcgccagaaaaatactccgcgcggcgtgggtagttaaatgacagcgttgccagcgcatcgaggatgcgagttttccccatcacgcgcccccagcgggtttcaacgccgataatcccgacgataatttccggcggtacaccatacacctgccacgcgcgattcaacgcatcttcatactgattccagaaaaccacaccgttctgcacgttgtccggcgtaataaattttttgcgataacgcagccatgcgccgttcggacstgatggcggtttcaccgatgtggttggtgcctggttatccatcagccgcagtaccgaatccagacgtttcgcctgggagagaatttcctgcaactgctgacgatcgaaaccgtgtttgttcaccattttgtcgatgaactgctgggcattcgggttattggcgaagtcaccgcccatctgcatcacattgtgctgcggctcaagcaggaagccgccagacggcgttccggtggtcgtttcagtctcagtaggttttggcttgctgctacaggcggcaagcaacacaaaaaggggaagcaatgttacataacgacgcttgaacatgaggggtccatttaacagattcaaccaggggcaagtatggtaaagcatcccgccccgcacaaggaagcggtagtcactgcccgatacggactttacataactcaactcattctcctcactaccttctttatacaaactttcaaaataaaatatttatctttcattttgcgatcaaaataacacttttaaatctttcaatctgattagattagattgccgtttggtaataaaacaataaatactgaaggagagaacaatgatagaaaccattactcatggcgcagagtggttcatcgggctgttccagaaaggcggagaagtgtttaccgggatggtaaccggcattcttccgctgttaattagcctgctggttatcatgaacgcattgattaattttatcggtcagcatcgtattgaacgatttgctcaacgttgcgccggtaaccctgtttcccgttatctgctgctaccgtgcattggtacgtttgtcttttgtaacccgatgaccttaagtcttggtcgctttatgccggaaaagtacaaacccagctattacgcggcggcctcttatagctgccactcaatgaatggcctcttcccccatatcaaccctggcgaactgtttgtttatctcggcattgccagcggtctgacaacactgaatctgccacttggcccactggcggtgagctatctgctggttggtctggtcaccaacttcttccgcggctgggtaaccgatctgaccaccgccattttcgagaaaaagatgggcattcaacttgaacaaaaagttcgtctggcaggagcaacatcatgacacgcattcggatcgaaaaaggaacgggtggctggggcggcccgcttgagctggaagccacgccgggcaaaaaaatcgtctatatcaccgccggtacccggcctgcgattgttgacaaactggcacagcttactggctggcaagctatcgacggatttaaagaaggtgaacccgcggaggcggaaattggtgtcgcggtaatcgactgtggcggcacattacgctgcggcatctatccgaaacggcgtattcccaccattaatatccactcgacgggcaagtccggcccgctggcgcagtacattgtggaagatatttatgtctctggcgtaaaagaagaaaacatcactgtagtgggtgaggcgacaccacaaccctcttccgtgggccgtgactatgacaccagcaagaaaatcaccgaacaaagcgatggtttactggcgaaggtgggaatgggtatgggttctgccgttgccgtgctgttccagtctggccgtgacaccatcgacactgtattaaaaaccattctgccgtttatggcgttcgtctcggcgcttatcggcatcattatggcttctggccttggtgactggattgcccacggtcttgctccgctggcgagccatccactgggtctggtcatgctggcgctcatctgctccttcccgctgctttcacctttcctcggcccaggcgcagttatcgcacaggttatcggcgtattgattggcgtgcagattggtctcggcaatattccgccgcatctggctttacctgcactgtttgccatcaacgcgcaggcggcctgcgacttcatcccggtcggtttgtcgctggcggaagcccgtcaggacacggttcgcgtcggtgtcccttctgttctggtgagccgctttttaaccggcgcgccaactgtactgatcgcctggtttgtctccggttttatctatcaatagaggctgaaacatgaccgttatttatcagaccaccatcacccgtattggcgcgagtgccactgacgccctcagcgaccagatgctcatcacctttcgtgaaggcgcgcctgcggatctcgaagagtattgcttcattcattgccacggcgagttgaaaggtgcactccatcccggtttgcaattttctctcgggcagcatcgctatccggtgaccgccgttggcagcgtggcggaagacaaccttcgcgaactgggtcatgtcaccctgcgcttcgatggtttaagcgaagcggaatttccgggcactgtccatgtggcaggccctgtacccgacgatatcgcgccgggatcggttttgaagtttgaatctgttaaggagtaaaaaatgaatcaggttgccgttgtcatcggtggtgggcaaaccttaggcgcgttcctgtgccacggtctggctgccgaggggtatcgcgtggcggttgtcgatattcagagcgacaaagccgcaaatgtggcacaagaaattaacgccgaatatggtgaaggaacagcgtacggttttggtgctgacgccaccagcgagcaaagcgttctggcgctttctcgtggggtagatgaaatctttggtcgcgtggatttgctggtctacagcgccggaatagcaaaagcagcctttatcagcgacttccagctcggcgattttgaccgttcgctacaggtgaatctggtgggttatttcctgtgtgcccgtgaattttcgcgtttgatgatccgcgacgggattcagggtcgcattattcagatcaactcgaaatccggcaaagtgggcagcaaacacaactctggctacagcgccgcgaaatttggtggtgtcgggctgactcaatcactggcgctggatctggcggagtacggcattacggtgcattcgctgatgctcggtaacctgctgaaatcgcctatgttccagtcgctgttgccacaatatgccaccaagctgggtatcaaaccggatcaagtcgagcagtattacatcgataaagtaccgctcaaacgcggctgcgattatcaggatgtgctgaatatgctgctgttctacgccagtcctaaggcgtcgtactgcactggtcagtcgatcaatgtcaccggcggtcaggtgatgttctgatcaacagcggagatcttttaaggatctccgcgcgactaatagaatgcctgatgcgctacgcttatcaggcctacaggacttccgccactacattacggagaagttatggtatccgcactcatcaccgtcgccgttatcgcctggtgtgcgcaactggccttaggcggttggcaaatttctcgttttaaccgtgccttcgacacgctatgccagcaagggagggttggcgtgggccgttccagcgggcgctttaaaccgcgggtcgtggtcgctattgcgctggacgatcagcagcgcatcgtcgacaccttgtttatgaaaggactgaccgtcttcgcccgaccgcaaaaaattcccgcaattaccggcatgcatgtgggtgatttacagcccgatgtgatctttccccatgatccactatcacagaatgctctatcattggcgcttaaactgaaacgtggataatttcgttgtgaatgttactagcttgcgaagttatcattttgaaacctaaatcaggtaatcacgcccatgaaacctcgtcagcgtcaggccgccattctggagtatctacaaaagcagggtaaatgctcggttgaagaattggcgcaatactttgacaccacaggcacaaccattcgcaaagatctggtcattctggaacatgccggaaccgtcattcgtacttatggcggcgtggtgttgaacaaagaggaatccgatccgcctatcgatcataaaacgcttatcaacacccacaaaaaagagctgattgcagaagctgccgttggttttattcatgatggcgactcaataattcttgatgctggcagtaccgtgttgcagatggtgcccctgctctcgcgctttaataacatcacggtgatgaccaacagcctgcacatcgtcaatgcgctatccgaactggataacgaacaaactatactgatgccaggcggaacatttcgcaaaaaatcggcctcatttcacgggcaactggcagagaatgccttcgagcatttcaccttcgataaattgtttatgggcaccgacggcatcgatctcaatgcgggcgtaaccacctttaacgaggtctataccgtcagtaaggcgatgtgtaatgccgcgcgcgaagtgattttgatggctgactcatcgaagtttggtcgtaaaagccccaacgtggtttgtagtcttgaaagcgtcgataagctgattaccgacgcaggtatcgatccagcgtttcgtcaggcgctggaagaaaaagggatcgacgtgatcataaccggagagagcaatgagtgaagcactactgaacgcgggacgtcagacgttaatgctggagttgcaggaagcaagccatttaccggaacgtctgggcgatgatttcgttcgcgccgccaatatcatcctgcactgcgaaggcaaagtggtggtttcgggaattggcaaatcgggccacattggtaagaaaatcgccgcaacgcttgccagcaccggcacaccggctttttttgtccatccggcagaagcactgcacggcgatctggggatgattgaaagccgcgatgtgatgctgtttatctcttattccggtggcgcgaaggaactggatctcattattccgcgtctggaagacaaatctatcgcgctgctggcaatgaccggaaaaccgacgtcaccgctgggcctggcggcgaaagcggtgctggatatctccgtagagcgcgaagcctgcccgatgcaccttgcgccgacctccagcaccgtgaataccctgatgatgggcgacgcgctggcgatggcggtcatgcaggcgcgcggatttaatgaagaagattttgcccgctcccacccagccggggcactgggcgctcgcttgctgaacaaagtgcatcatcttatgcgtcgtgacgatgccatcccgcaggtggcgttaaccgccagcgtgatggacgcaatgctggaacttagccgcaccggtttaggtctggtggcagtgtgcgatgatcaacgactggtgaaaggcgtctttaccgacggtgatttacgtcgctggctggttggcggcggcgcactcaccacgccagtcaatgaagcgatgacggtcggcggcaccacgttgcaatcgcaaagccgtgccatcgacgccaaagaaatcctgatgaaacgcaaaatcaccgccgcaccggtagtggatgaaaacggcaaactcaccggcgcaattaacctgcaggatttctatcaggccgggattatttaatccttcagccccagacgtttcgccagccgatgcaggttggcgacgtcggtttccagcatccgcgcacaggcggcccagttgtgatgattttgcgccagtgcctgacgaatggtttcacgctggaacgcttctgtcgcttcacgcaggttttgcttaacaacgggcaccgccgccgcttctggcggcggcaacgtcacctcaggaaaagcaaaatgttgcgcctcaagaatcacttcatcgccgctgcgggtggctctcgacaatactaccgcccgatgaatagcatgttccagttcgcgcacgtttcccggaaaattgtagtgttgcagtaaatttcgcgctccggcacttaataccacgcgggagagccccagccgcaaacgacactgctcgcagaaataccccgccagcagaatgacatcatcgccccgctcacgcagcggcggcactgaaagtggaaacacgctcaggcggtggaacaagtcagcgcgaaatcgccctgccagtacctcttcgcgtaagtcacggttagtcgccgccagcacgcgcacatcgacccgcaaactgcggtcatcgccaacgcgttgaatatcgccatactgcaacaccctcagcagcttggcctgcaatgccaacgacaactcgccgatctcatcgagaaacagcgtgccgttatccgccatttcaaacttcccgctgcggttactgatagcaccagtaaacgcccctttcacatgcccgaacaactcactttccgccacactttccggcagtgcggcacagttgagatagaccagcggattcaccgcccgtggcgaggcttcatgaatcgctttcgccaccagctccttaccggttcccgtctcaccgctaattaaaacgttgagatcggatgccgccacaatctcaatctcttttttcaattgcgtcatgccaggggacaaaccaatcatctgcgtctgtttcaccgcttcaaacggcgcggcatcgcctggcagcatattctggctttccagttgttcaatcagcaatgcattgcttaacgctcccgccgccagtgcggcaatcagccgtagctcttcgtcgctgaaaacatcgaactgatcgggctgcatcccgtcgagcgtcaaggcaccgatcaggttttgcccggcaaacaacggcaaaccaacgcaggcgtgaaccttcagactctcctgccctggaatcaaaccgtcataaggatcgggcaattcgctgtctgcgggaaagcgcaccacatcacccgcgcgggcaatcgcttccagccgtggatgaccttccagcgcaaagcgtctaccgagtacatccttcgccagcccgtcgatggcaagcggaataaactgccgcgagtcgtaacgtagcaacgcagacgcatc

SEQ ID NO: 10015 - DNA, 12932 bp, Escherichia coli
gcccgtagctcagctggatagagcgctgccctccggaggcagaggtctcaggttcgaatcctgtcgggcgcgccatttagtcccggcgcttgagctgcggtggtagtaataccgcgtaacaagatttgtagtggtggctatagctcagttggtagagccctggattgtgattccagttgtcgtgggttcgaatcccattagccaccccattattagaagttgtgacaatgcgaaggtggcggaattggtagacgcgctagcttcaggtgttagtgtccttacggacgtgggggttcaagtcccccccctcgcaccacgactttaaagaattgaactaaaaattcaaaaagcagtatttcggcgagtagcgcagcttggtagcgcaactggtttgggaccagtgggtcggaggttcgaatcctctctcgccgaccaattttgaaccccgcttcggcggggttttttgttttctgtgcatttcgtcactttcccttcgcaataaacgcccgtaataacgtattgcgccacggtatgatttcgcccttaacttattgaaggatgacttcaggcaaggagcgaccatgcagcaacaggttccaacgcgtgcttttcatgtgatggcgaaaccgagcggttctgattgtaatctgaactgtgactactgtttttatctcgaaaaacaatccctttaccacgaaaagccagtcacgcatatggacgatgacacgctggaagcgtatgtccgtcactatatcgctgccagcgaaacccaaaacgaagtggcttttacctggcagggcggcgaaccaacgttactcgggctggatttttaccgccgtgccgtggcgctacaggcgaaatatggtgctggcaggaagataagtaatagcttccagactaacggcgtgctgctcgatgacgaatggtgtgcatttctggcagaaaatcattttcttgtagggttatcgctggatggtccggctgagatccacaatcaatatcgcgtgaccaaaggtggcagaccaacgcataagctggtgatgcgtgctctgacgctcctgcaaaaacatcatgtcgactataacgtgctggtctgcgtcaatcgcaccagtgcgttacaacctttgcaagtctatgattttctgtgtgatgcaggtgttgagttcatccagtttattccggtggtcgagcgcctggctgatgaaacggctgctcatgctggacttaagctacatgctcccggcgatattcagggcgaactgacggaatggtcggtgtgcccgcaagagttcggtgagtttctggtggcgattttcgaccactggattaagcgcgacgtcggcaaggttttcgtaatgaatatcgaatgggcgttcgccaattttgtcggcgcaccgggcgcggtttgccatcatcagccaacctgtgggcgctcggtgattgttgaacacaacggcgatgtttacgcctgcgatcactatgtttatccgcagtatcgactagggaatatgcttcagcagacgattgcagaaatgattgattccccgcaacagcaggcatttggtgaagataaattcaagcagttaccggcacagtgtcgcagttgcaacgtgttaaaagcgtgctggggaggctgcccgaaacaccgctttatgctcgatgccagcggcaaacccgggctgaattatttgtgtgccgggtatcagcgttatttccgccatctaccgccatatcttaaagcaatggctgatttgctggcgcacggtcgtccggccagcgacattatgcaggcgcatttgatggtggtgaataagtagaaatcggcggccgcctgcggttgattgccggatgcggcgtgaacgccttatccggcctacaatcattgcaaattcaataaattgcagcgttctgtaggctggataagatgcgtcagcatcgcatccggcaaaggcagatctcagcgatagcgccggcttagtcagatttaatctgcgcgcgtggtggatattttttcaggatctccatatacgcgtgcatttcggtctgtagcggtacacccatcggaatatggcgcacgccgatagagtcgctttcctgcggatcggtgtacaggttaaacaccgacgatcccgccgtttgcattactgtgccggtgaatccaccctgatatccgctctgggtataagcgtaaggttgctgaatcaggacgtgatacttgaactcatccatacgcacagcagaaagtttaccgttgaggaagtagtgctcggccttacggttagactgaccatttgttcccaggaagaaagatgtctggtccacaccatcgataaaggtggttttcggtactaaattcgctactttcgccccaggatgccccgccagatccagcgccgtagggaagagatccgccagatcgacaatgccgtcagatttacgcggttggatcatgcctttccagtaaacgaaggttggcacacgaacgccgccttcccatgtagaacctttcgcaccgcggaacggcgtgcgaccgtgcggcggaacttcggcttccggaccgttatcagaggtgaacacaatcagcgtgttatcaagctgaccgtttttctccagtgctttatacagattggcgaagatatcgttcatctccaccatgcagtcgccgtaagaggtgcgcgccggagagctacccgcatatttggcgttcgggtagttatcgaagtgacagccgcgagtgccgtaatagaggaagaaaggcttatcactcttcgccatcttgtcgaggaacttaacgccatattccatccagcgttgatccaggtcttccatatatttcggcgtaatgtcggcaatggcttcctgttcaccgccgcgcacggcatgaacgtcatctttgctgaacggcagtttttggatgtattcagaacgagccgggctcagggcgacttccgggttgacatgaacatcacgccattcggtatacatatcggacaccgagttaaagccgcggaaatcatcaaagccaacgttctgcggctgcgactctttgttttcccccatatgccatttcccgatagcctgggtgacgtagccctgatcgtgcagcaactgcggcagcgtggttaacccttgcagaccgcccggttgcccgtacattggcggcatcagaatgccgtggtggatggagtattgtccggtgagaatcgtggcgcgggttggggaagaactcggttgagaatacgccgaagttaaaatcagcccctggctggcaacggcgtcgatatctggtgtagggttacccaccgccacgccgccgccgttaaagccaacgtccatccagcccacatcatccagcaagaaaacaaccacgttcggtttcttaccggtttttttctcaagttccgccagtttctgctgggtttctttgtcttgtgcaggatgctgcatcaccggcatcatgttgtcggcaatagtggtcgccggtttaaccagatactggtttgggtgatcgtatccggcaaagcctttgcgtgcggtggcggttgacggggtatctgctgcgctggctatgagaggaagagctgcggcgacagcaacaacaagaagtttgggtgaaaacgaaaattccatgcaaaatgctccggtttcatgtcgtcaaaatgatgacgtaattaagcattgataattgagatccctctccctgacaggatgattgcataaataatagtgataaaaataaattatttatttatccagaaaatgaattgaaaaatcaggagagcattttcaatcctacctctggcgcaggtgatatgtaaggcggtgatgttatatcgcgttgattattgatgctgtttttagttttaacggcaattaatatatatgttattaattgaatgacttttattattcattatatatatgtgtagaattgtgcgcaggagaaatattcactcaggaagttattactcaggaagcaaagaggattacagaattatctcataacaagtgttaagggatgttatttcccggttctctgtggcataataaacgagtagatgctcattccatctcttatgttcgccttagtgcctcataaactccggaatgacgcagagccgtttacggtgcttatcgtccactgacagatgtcgcttatgcctcatcagacaccatggacacaacgttgagtgaagcacccacttgttgtcatacagacctgttttaacgcctgctccgtaataagagcaggcgtttttttatatatcagaaaggccccggaggtgcttgcctccgggtgagaaagagctactgtggcgggttgttctgcaacgttaacatcaaaccgtcgcgacgcatcgctgcggcttcttccggcttgtgcagtctgtccagcgcgtcggcaagccatgcgtaatcgtaggcgtccggacgttgtttcagcgctgcgcggaaggcgagcgatgcttcctgccattctccgtgtttcatcagcgactgacccagtgtgctccacaacagcgggcgatcgcccacgtttttgatctgttggcgcagcactttttccagctgttccgggttattggttttcagacgcgggatcggcagcagcaggcgatcgtcatactggcgtttcaggccatcgatgataatttgctgggcagtatcatgatcgtcacactcaataagatgttccgccattgccacctgcaaggccacctgatgacgcgttttccggctttggtttttccaccagttacgcaaaccttcactaccgttatcggcacgcgcctgatccatcaggccaatccatgcctgttgttccagcattgcacgatgttcttcatcaccaacatgggctttcgccattgatgggatgatatccagcagcgaactccatgcaccagtgcggatatacgcctgttccgccagacgtaatacttccggatggcgtggcgtaacttccagcagcttatccacgccgtgacgtgctgcatggttttcattacgggccagttgcagacgtacacgggtgatttctaccggaatggtgtcattgccggccagctccgctgcgcgttccagatgttggttggcgcgtgcttcatcaccacgttgttgcgcggcttcggctgccagtagatagttcaccaccggttgttcagcgtgatcggcatttttcgccatcagcttttcaacttgctgataatcgccttccgccagtttcagcagcgcctgttcggtctgcttacgtgcacggcgacgcttacgtccgacaaaccacccacgggtgtgcgcgcctgtgcggaagattcgccgcagtagccactcaatggcaaacagcactaccatcgccagaatcaaaataatcgcgaggcccgtgacgctggtttcaatattgtagttgtcggtctggatcagcacgtaaccctgatggccggcaatcatcgggccaaccacgatccccgcaatcagcaacacaaagagcaataacacttttagcatggttattctccttgcggcgcggctgccggagcatcagcttgcggtgcaggtgcaggtgcaggtgcaggtgcaggtttagcttccgttgtccctgctgccggttgtgccagcaggttacgcacgcgggtctgcatcaatttttccagcatcgcctggctttgcagggtttccggaagatccatcgagatattttgctggcttaactggtccacctcgtcgaggaacgctttggtggtggcatcatcagtatcgtagtaagcacgtacccaggtggagacgttctccagcgcctggcgataagtctcttcctggtgacgcggtacagcttgtgctgcgaccagcaggcgagagcgaatattttcgcgcagatagatatcctgatttggcgctaacagcggtacggcggtgtcatcacgacggcgaatcgtaatgaagttgtccataaagttctgccagcttttttgcagattgatacgccattcgctgatggaactggaaagctcttcaccgtcggaatccatcggcgaaccatcgctgtcattatcggccagacgcagattatctacctgatttgaaagctgattaagcttaaggatgataccgtcataatccacctgcgataccgcagaaaggctggcgatatcatcggtaattgcccggcgaacggtaatcagactcgggtcattcatatccgccaggctggcgtctgcacttttcagcaacgctgcagcggtcgtgacgtcctgatcgctccacagcttccgtccggcgagtttcaccagaaaatcggcctgggccagcagccaggttttagcatcgctgccggaaatggtggcgaccttttgttggacttcatccagctgttttgccagcgtttcttgctgacgattcgcctgctcaagctgtacagcttgttgcttgataatgccttccagctcggctttttggctctcctgggctttttgcagtgccgtaagttggttagccagggcatcgctggtggcagtctgattgacggcctgttgtttaccccagccatacaaaccgacgcccgccgccagagcaatagcgatagccaccgcgctgagaatcaatgcggtattgttcttactctttttttctgttgcgacaggttgtgacgtggtgtccacggcctccctggtctcttcaaccacggcggaggttttttcttgttccgtcattatggcttcctgttatgagagttattgtaatgcccgtaaaagcgcatcgttgtcagcgttatcggcgaccttaatgtcttgccagcccagttcccgggcgagtttcgccaaacgctcactgacgaccaatagtcgacagcgtagtaaccagtgctcacgataccattgtgggatcagcgaccagagttgctgcaacatttcaccgctggtaacaacgaccgtcgtcacctcgcgggattgccagcgcatcgcttcttctgcaccatcgtaatggattgcgcatcgttgataacattcacaaaaagtgacctcagcaccgcgcgccgtcagggaatccccaattagctcacgaccgccattgccacgtaatatcagcgcacgtttgcccgcaatattttgtaattcaggtaattgtagcaagacttcgctgatttcccgatcctgcgggtagagaatcttctgtccgcttacggtatgtagtgccagcgcggtggtgcgtccaatggcgaaataatcaggtagtcggggccatttacgatcttgctgatgcagctgtgattgggcaaaagcaaccgcgtgttgcgagagggcaaacaacagatcgctctctcccagcgctgccagttgatcagcaagttgcggtaattgtcgacccggagaaaactcaatcagcggaaaatgccaggccacctgccccagtgtgcgcagacggctcactaactcttctcctgcgggagacgggcgggtgaccaggatactcatgccggggcgtctccgttatagacttcagcgaggatctcgcgcgcgccgttattcagtagctcttctgccagcgaaatccccatttgttcggcatcttgcggcgcaccgcggcgttcaccgcgaataatctgcgaaccgtccggcgcgccgaccaacgcacgcagccagatttcgccatcaataagctcggcgtagctaccaattggcacctgacatccgccttcgagacgggtattcatggcgcgttcggcggtaacgcgcagtgcagtttcgtggtgattcagcgcggcgagcagctcgcgagtgcgtgcatcatcaaggcggcattcaatgcccaccgcaccttgccctaccgccggaagagaaatctcgggtggcaacgcggcgcgaatgcgggactccagacctaaacgttttagtccggctacggcaagaatgatggcatcatattcgccgttatccagtttgctcagacgagtgccgacgttgccgcgcagggagcggataatcagatccgggcggcgttcagccagttggcactggcgacgtaaactggacgtcccgacgatactgcctgccggtaacgcatccagactgtcataggtgttggatacaaaggcatcgcggggatcttcgcgcttgcaaatggtgaccagccccagaccttgtgggaattcaaccggcacatctttcattgaatgtacggcgatatcggcgcgattttcgaggagcgcgacttccagctctttcacaaataagccttttccgcctactttcgccagcggcgtatcaagaatcacatcgccgcgcgtcaccatcggtaccagttcaacgaccaggcccggatggctcgccatcaacttgtctttgacatagtgtgcctgccagagtgcaagtgggctttggcgtgtggcaattcttaaaacattgtctaacatgcttgttaccgtcattatcatccgtggtccatcctaacatccttgccagagcgatgtcagtgttgtggtgaaacgtagacgcctgcgcaaaccgtaaaatgaggtctggcagtggatcctgacaggcgctttgagccttcgtaataaggaatttacagagaataaacggtgctacacttgtatgtagcgcatctttctttacggtcaatcagcaaggtgttaaattgatcacgttttagaccattttttcgtcgtgaaactaaaaaaaccaggcgcgaaaagtggtaacggttacctttgacatacgaaatatcccgaatgccgcgtgttaccgttgatgttggcggaatcacagtcatgacgggtagcaaatcaggcgatacgtcttgtacctctatattgagactctgaaacagagactggatgccataaatcaattgcgtgtggatcgcgcgcttgctgctatggggcctgcattccaacaggtctacagtctactgccgacattgttgcactatcaccatccgctaatgccgggttaccttgatggtaacgttcccaaaggcatttgcctttacacgcctgatgaaactcaacgccactacctgaacgagcttgaactgtatcgtggaatgtcagtacaggacccaccgaaaggtgagcttccaattactggtgtatacaccatgggcagcacctcgtccgtagggcaaagttgttcctctgacctggatatctgggtctgtcatcaatcctggctcgatagcgaagagcgccagttgctacaacgtaaatgtagtctgctggaaagctgggccgcctcgctgggtgtggaagtcagcttcttcctgattgatgaaaaccgcttccgtcataatgaaagcggcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgttgacgccaaatgaatggctggatcttggtggcttaagctcgctttctgctgaagagtactttggtgccagcctttggcagctctacaagagtatcgattccccatacaaagcggtgctgaaaacactgctgctggaagcctattcctgggaatacccgaacccacgtctgctggcgaaagatatcaaacagcgtttgcacgacggcgaaatagtgtcgtttggtctcgacccgtattgcatgatgctggagcgcgtcactgaatatctgacggcgatcgaagattttactcgtctggatttagttcgccgatgcttctatttaaaagtttgcgaaaaactcagccgtgaacgcgcctgcgtaggctggcgtcgtgaagtgttaagccagttggtgaaagagtgggaatgggacgatgctcgtctggcgatgcttgataatcgcgctaactggaagattgatcaggtgcgtgaggcgcacaacgagttgctcgacgcgatgatgcagagctaccgcaatctgatccgctttgcgcgtcgcaataaccttagcgtttccgccagcccgcaggatatcggtgttctgacacgtaaactgtacgccgcgtttgaagcgttaccgggtaaagtgacgctggtaaacccgcagatttcacccgatctctcggaaccgaatctgacctttatttatgtgccgccgggccgggctaaccgttcaggttggtatctgtataaccgcgcgccaaatattgagtcgatcatcagccatcagccgctggaatataaccgttacctgaataaactggtggcgtgggcatggtttaacggcctgctgacctcgcgcacccgcttgtatattaaaggtaacggcattgtcgatttgcctaagttgcaggagatggtcgccgacgtgtcgcaccatttcccgctgcgcttacctgcaccgacaccgaaggcgctctacagcccgtgtgagatccgccatctggcgattatcgttaacctggaatatgacccgacagctgcgttccgcaatcaggtggtgcattttgatttccgtaagctggatgtcttcagctttggcgagaatcaaaattgcctggtaggtagcgttgacctgctgtatcgcaactcgtggaacgaagtgcgtacgctgcacttcaacggcgagcaatcgatgatcgaagccctgaaaactattctcggcaaaatgcatcaggacgccgcgccgccagatagcgtggaagtcttctgttatagccagcatctgcgcggcttaatccgtactcgcgtgcagcaactggtttctgagtgtattgaactgcgtctttccagcacccgccaggaaaccgggcgcttcaaggcgctgcgcgtctccggtcaaacctggggcttgttcttcgaacggctgaatgtctcggtacagaaactggaaaacgccatcgagttttatggcgctatttcgcataacaaactgcacggcctgtcagtgcaggttgaaaccaatcacgtcaaattaccggcggtggtggacggctttgccagcgaagggatcatccagtttttcttcgaagaaacgcaagacgagaatggctttaatatctacattctcgacgaaagcaaccgggttgaggtgtatcaccactgcgaaggcagcaaagaggaactggtgcgtgacgtcagtcgcttctactcgtcttcgcacgaccgtttcacctacggctcaagcttcatcaacttcaacctgccgcagttctatcagattgtgaaggttgatggtcgtgaacaggtgattccgtttcgcaccaaatctatcggtaacatgccacctgccaatcaggagcatgacgcgccgctgttgcagcagtatttttcgtgatgaaagtgccggaaagcgaggcttatccggcatgcaatcttagcggaaactaactgtttcacccgcctgctgcgtcgccgcctgttccagcaaatcccagaaggtttcaccgctacgatcgcaaatccactcgtcgcctttcagatcaaaatggtagccaccctgtttggttgccagccacacctggtgcagtggttcctggcggttgataatgattttgctgccgttctcaaaggtaatggttagtacaccgccgttgatttcacagtcgatatcgctgtcgccatcccagtcgtccagatgttcttcaatggtcagccacagttgatcagccaggcgatgaaattcactgtcgttcattgttgtatcctgtttttaagtgatggcggcagtatagcggcatggggtcagggcttcaaagtttgcccgtctgctgctgcgttccggcatgattcatccgtcaccggaataataatgtcgctgttatgaatttcacggacattctcttctctgacgcgtgttttcgccgggcagtgggagggcgtaatccttacctctgtatcagtccaggtataaacattgcgatcgtcataagcgaagcgatcgtttttagttagcggaccgttaactggaataatttgcacgctcttgcgtgaccgtaattggcggataaagtaagcatgttgtttgccgctattaaatgagtcatcaatgaccaggtctggcgtatccagcgggattatctcaagctggtcttcaccaaaagtcgataattttgttacatacagtcgatctttatactgcgcaatattgtcagtaatcagatgaaattgttcaggttcaatacccggtaggtctatccacttgctccactgacggtcgggcgtgagctgtttacgccagcgaacgcgactttcccctacttcaaaagagacgtcatcatctacgggtatcgctttgccagataattgaccaaagggataacgatgcagacccttattgtcgcgaaaaaccagcagtgaatgaggtatccagcgaattatctcaaatgagtctgcattcgccgtaaggtgagcgccatttaaataaatattctgcccactgcggataagcagatcattggaatacaaatttctgtttacactcataagacgtggattaataccccaccatcttttttctaatacagtaacattactgctgctcccctgacgtcgaccggacaagtagagatttttactatccaccagcgtggtagagttaccttcgatagcttttagtgtcgccagatcaacacgtgacgcgccgctattactttcggtacgctgtccgtcaaaatagaggctatatttatcgaccgcgaagcggcccatagcctgaaagctggcaatatcgacagtgggtgttcccggtggattgctaacgattttgccacgccagagaataacgtggccgtctgtcacccagtgatattcctcattttctatgcttatttcatcggaaggtatataacccgtcttcccagagatatttttcacaaggcgcaaatcggccctgttcatctccggaaattgggcaatgattttcttatc

SEQ ID NO: 10016 - DNA, 6500 bp, Escherichia coli
atcggcgtcaagcggatgtctggctgaaaggcctgaagaatttggcgcgttaacaaagcggttatgtagcggattgcaaatccgtctagtccggttcgactccggaacgcgcctccactttcttcccgagcccggatggtggaatcggtagacacaagggatttaaaatccctcggcgttcgcgctgtgcgggttcaagtcccgctccgggtaccatgggaaagataagaataaaatcaaagcaataagcagtgtcgtgaaaccaccttcgggtggtttttttgtgcctgcaacttgtcgttacaccctccttaatttttaatcaccggcaaagccactcaaaaagtatctctgatacggaccggcatgtaagataggtgctggcgagttgagatccacaaggaaaagcgtatgaaaacgggaccgttaaacgaaagtgagttggaatggctggacgatattctgaccaaatacaacactgaccacgccattcttgatgtggcggaagctggacggtttattgacggcggtgttgagttctccgcaagagattgaaccggcacagtggctggttgccgtgtggggtggggctgactatgtgccgcgctgggcgtcagagaaagagatgacgcgctttatgaacctggcttttcaacatatggccgataccgcagagcgtctgaacgaattcccggagcagtttgagccgttattcggcttgcgagaagtcgatggcagcgagctgacgattgttgaggagtggtgctttggctatatgcggggcgtggcactttctgactggtcaacgttgcccgattcgttaaaaccagcgctggaggcgattgcgctgcacggtactgaggaaaacttcgagcgggtagagaagatgtcgccagaagcgtttgaagagagcgtagatgctattcggctggcggcgcttgatttacatgcatactggatggcgcatccgcaggaaaaagctgttcagcaaccgatcaaagcagaagagaaaccggggcgtaacgatccttgtccgtgtggcagtggtaagaaatttaagcagtgctgcctgcattaagaggtcacattgggtgtcagcgttaattctggcacccaataagaatctaatcaccccacttctggtaacaagcctgccgcaatcaaaaattgcacgccaatcacagcaataccacagagaaacaccaccaccagcgccggacgaccacctttcacccggtaacccgcctgaggattgtgcttcctgctttgccaggtcaacagcgaagggataatcaatgccagtaccgccagtgccacaccggcgtaacccagcgccatcacaaatcctcgtggataaaacagtgcaaacgccagtggcggcagaaaggtaattgcaccagtttgcaatcgtccaccaacggtatttgaacgctgaaacaaatctgccagataatcaaataagcctaacgctacgccgaggaaggacgtggcgagggctaaatcagcaaataaatgcactgccagctcaacatgcggagaggccaccatttcgcgtaacgcctgtaacagcccgtttaatccggcatgattagccagcaatcccataaaggttgttgaatcaatgctgccaagggtcgccagctgccagaaaatatatgccaccagggggatcgcactaccgattataaacacccagcgtagcttacgaatgttgccatccatatagctgacaatactcggcacgctaccgtgaaaaccaaacgacgtaaaaatcaccgggattgcagacagtgccagtccctgttgcaacggcagggttaaaagattcactttgtgaatatgcggtagcagcaataccagcatcaccaccaaaaaaataattttggcgctgaacagaaaacggttaaataaatcgaccagcgaagttccgacacaaaccacgccaccggcaacaaaagtgaacaacagcacgccagcggttgccgacattgaaatacctgtccagtcgctgatgctggaggccaacaattcaccggcaccgctgatgtatgccgcagtcagagcatacattaagaacatcatactgaagcccgtcagccactgaccgtagcgtcccagatagcgttttgccagcgtgcccagaccggtatctgccgggacatgctggtacacctccagcagtaatagcgccgtgtagcacatcaatgcccaaagcccaattaacaagattaacgtgacgctaaaaccaacacctgccgcagccagcggcattgccagcataccagcgccaattgtggttcccgccacgataaaaacacttcccagagttctgtttttcacgctttcttctgtcctgacgatctttatgagtgatatctgcggcgcaggttaaggcataacggctgattcgtcaaaccgacgttacatatgttgtaaatataaatgtacaataaaaagcgttcagttctgcgctggcgcaaagtcttcataagcggtaatcgctacgctaggctttttttgaggaggaacgatggactctattcacggtcacgaagtgttaaatatgatgattgaatcaggcgagcaatatacgcatgccagtctggaagcagcaattaaagcgcgttttggtgaacaggcacgttttcacacctgctcggcagaagggatgactgcgggagagttggtggcgtttctggcagcaaaaggcaaatttataccttcagaagaaggtttttcaaccgatcagagtaagatttgccgtcactgatttgaaacggcggcagaaaacctgccgccggagagcattagttttgtgtgtcgagggtagagagttctttgtcgataaaatacagaccttcgccgcttttgcctgcaaggcttaatttatcaataatcgatttgaacagtttctcttcttcatgctgctcagaaacataccattgcaggaaattaaatgttgggtagtcctgattggtcattgcagcatgagccagttcgttaattttctgcgtgattaattgttcgtgtttataggtttcctggaataattcatcaagtgaggaatattcagcaaacggagattcaacggtattaatacgcggtaagttgccggtatcagtcaggtaatcaaacagacgctgcatatgcgtcatctcttcctgggcgtgacggcgcaggaacgcggcagcaccttcgaaggtatgatagctgcaccaggcgctcatttgctgataaagcagtgaagagtacagttccaggttcatctgctcattaagtttttcaatcatttctggtttcagcatgatagtgctccacaaaggttatatttgttgctgtagcgtcactataatttgttattttattatttgcaaaaggtaaaatataaatatcatttattaaaaatacgaatgggaataaaacgcattaccgctatttatttaatcagcgaagatccccctcgctgattaaaacgtttagagaaagacagggaaggcggaatgatggcactgatatgacaaagtgaattccgtattcaaacataaggaacccgcaaagaggctacagttgcctactggctgaccaaaggggatagcgtgggtatagcctgcctgctggcatgcgcgatcggcgatcccgcgactgacataacgatcggtactggcatgctgcaaaaaagcctgatcataaaccaaccgaacaatacctgttgccgcgtcaacttcgctcacatgggcctggcgagtaaccgtacatcctgtcagcgttattaaggaaagagtcagaatcagaagtctcatggtccagccagaagagtaaaagaaagcagtattttacgcgttacagcgctgcgacaatggccggaaaagacgcctggcaggcgctatttcttgccatctgtatgtgttagaaattgggggggctgctttttgattatcatttttataacattaaaggggtatttatgtgatttacatcacataaagattgatttttgtgatggttgtcatattataaatgtaaagacaataacacctgtataacaaatggtcggagtaccgcgatgaaactgcgcaagatcctgaaaagtatgttcaataactattgcaagacgttcaaagacgtaccgccaggcaatatgttccgataacaaaaaacctgctccggcaggtttttttgtgttctgatgacggtggatgtgactatcgctgaagatgtgaagccgctactataaaggctttcaaaatgctatcaggagtttacgatgtcccagccgctgaatgccgatcaggaactggtttctgatgtggttgcttgccagttggttatcaaacaaattctggatgttctcgatgtgatcgcgcccgttgaagttcgcgaaaaaatgtccagccagctgaagaatatcgactttactaaccatcccgccgccgcagacccggtcaccatgcgggtaatccaaaaagccatcgcgttgattgaactcaagtttaccccacagggcgaatcccattaaaaaaccgctgcttcaaaaaaatgaggcagcggtttctcaaaaacttcatcggcgcaatgcattagcgccgatgatgatcaatgtagctgatgcgacacgacattcagaacatgttggtcggtctgcacaggacacataccagcaagtttcgcactgcgcacttcatcaagaatggtttgcagtaacaggccatcatgctgctgttctttttccagatcgcgcaggaaattgacggttgaatcatcattcagttctttcgcttcatcggctaactgcgccagcgtgcttgaacgttgctcgtattcttccatcgttttttggaacagttcttccagagagttcagtttttcaccgggaacatcaatggctttaacgatgggggtagcgccgacactcttcataaagttaaacatgcgcatcatttgggtcacattactctgtgcctgggcgcgaaggaaagtggcggtgccgttcagactctgttcagaacaccagttactcaggtgaaggtagagattggatgcgtaaaactcgcggttcatttgagagttgagtttgagaagcattccagcggttgccatacctaatatccttatatccagaagtggagaggtgcaagataaatcaaaacaccataattactgtttgcagaataattcctttctgccggtccgaaatgtgatcgtggagtcaattctgacgatgatctgaaataagaataacgtctgaacgggtataagaaaatgcttaaatcatcaagtttatatatttttacatttcattgatgaaatcaatgtaactgtaatgaattttaatgatggtgctttttgtatcttgttgatattaatcgatgaatttgaattcatgatgaagcaatgattttataaaacgttttttcatttttgcgatatagctctcattatacgtgttctgttaattaatgagtacagtgataattaatggcgaaatgaatgacgcgcattttccacatctttaagttgcggttattacaccattgcaaaaactcaacgccaggtaatgaggcctattgactggttaaaaagaagacatcccgcatgggtaccaaagacaacaaggacttccaggctaatcttatggattattctgctgtgcactcgataatttgtctgacaaattcgcttttccttatgtcttttcccgctaaatttatgcacgttttcactgtaattctgcgatgtgatattgctctcctatggagaattaatttctcgctaaaactatgtcaacacagtcacttatcttttagttaaaaggtaatgctttgttttccgattaatttaacgaatgtcattcgtttttgccctacacaaaacgacactaaagctggagagaaccatgcacaaatttactaaagccctggcagccattggtctggcagccgttatgtcacaatccgctatggcggagaacctgaagctcggtttcctggtgaagcaaccggaagagccgtggttccagaccgaatggaagtttgccgataaagccgggaaggatttagggtttgaagttattaagattgccgtgccggatggcgaaaaaacattgaacgctatcgacagcctggctgccagtggcgcgaaaggtttcgttatttgtactccggacccgaaactcggctctgccatcgtggcgaaagcgcgtggctacgatatgaaagtcattgccgtggatgaccagtttgttaacgccaaaggtaagccaatggataccgttccgctggtgatgatggctgcgaccaaaattggcgaacgtcagggccaggaactgtataaagagatgcagaaacgtggctgggatgtcaaagaaagcgcggtgatggcgattacctccaacgaactggatacggctcgtcgccgtactacggggtctatggatgcgctgaaagctgcaggattcccggaaaaacaaatttatcaggtacctaccaaatctaacgacatcc

SEQ ID NO: 10017 - DNA, 3655 bp, Escherichia coli
catcttgatattttctctgccctgcaaaaacgtgatggcgatgcggtagaacgtgcaatgacgcaacatttgcaggaaatcagcgaatctgtgcgccagatccgccaggaaaacagcgactggtttagcgaagagtaattcatttcctctcatcccatccggggtgagagtcttttcccccgacttatggctcatgcatgcatcaaaaaagatgtgagcttgatcaaaaacaaaaaatatttcactcgacaggagtatttatattgcgcccgttacgtgggcttcgactgtaaatcagaaaggagaaaacacctatgacgacctacgatcgtaaccgtaacgcaatcaccactggcagccgtgttatggttagcggcaccggtcacactggcaagatcctgtcgattgatactgaaggtctgaccgctgagcaaatccgccgcggaaaaaccgtagttgttgaaggttgtgaagagaaactggcaccactggacctgattcgtctcggcatgaactaagcgtgtgaatgccgccgatggcggcattgctttttttacttcacggaatatttcgccacggtcgctttcgcgccatgcgctaataaagacaagtacgcttccgttacttttgtcgtaaacaaactattgcctggtaaatcatcaccaaagatcgccttaattgccagcagtgactggacgcgcgctgtcccttcagcactactttgtactgccttctgaataacaggtaacagtggatcactgatttctatcggatttccctgttcatcaacaccaccgacataacgcatccaacccgcgacgcccagcgccagcagatcgaacttgctgtcatgcgccagatgccagcgaacagaatccaacatccgctgtggcaatttctggctgccatccatcgcaatctgccaggttcgatgacgtaacgccgggttgctatagcgttcaattaatcggttagcgtaatcttgcaaatcaacgccctgcactttcagcgtcggcgcttgttcctgcaacattaaggtatacgccgcatgacgataatgttcatcctccatgcagtcattaatgtgctgatatccggcaagatagcccagatacgccaggaatgaatgactgccgttaagcatacgcagtttcatttcttcataaggcagcacatcgctaaccagttcagctcccgctttttcccattccggacgtccggcaacaaagttatcttctattacccactggcggaaaggttcacaggcaacgcctgccgcatcgcgcacaccggtaagttgttcgattttcgccagcgtatcctctgtcactgcgggcacaatacggtccaccattgttgatgggaaagtcacgttatcttcgatccattgtgccagttttacatcaatggcttgcgcataggaagtgacaacgtcacgcataacatgaccgttttctggcatgttgtcacatgacatgacggtaaatgcgggaagtcctgccgctttacggcgagccagcgcctcaacaatcacccctgttgcagttttcggctggtggggattttgcacgtcggcaacgaccatcgggtgatcaagcattaactgtccggtcgccggagagtggaaataccctttttcggtgattgtcagagagacaatcgcgatttgcggttcacacatcgcagccaacacggtttctaagccatctatttgtacgtgcaaggcttttttaacgacgccaacgacgcgagccgtccacgcatcagccgacatttccgcaacggtataaagattatcttgctgttgtaaatcggcaatttgctgttcgccgccgattaagttgacctcataatatccccagtcactgaaatgttccgtagcaagaatatcggcatacacgccctgatgcgcacggtgaaatgcaccaaagcctaaatgaacaattcttggggccaggttattacgatcataaacagggagcgtcgcttttgctgataacaaatgatttcccataacaattccttaaaattaaatatagcaagctacatgttttgttatatgaataaaaatcccctctccggtaagagaagggattgaggatttacagacttctggacggttgcgcagctcttacaacatgtggttgatcttctgcggcgtcttccagcgcacttaaatcacggtctttcacttctggcattttcagcgcagagattaaaccaatcacagaatatgccatgatcataatggcgatcggataccaggattccgtcatggtgcagaaaatccccgccaggataggaccaaaaccggaagcgataagaccaccaatttctttagaaatagccattcgggtaaagcggttagtccataaattcaagcgcagtgcccaaccatcccgatactgctgctttcaccaaatccttagtacttctttcgtgtttttctattgtcataatggttatctctaaaaaagaggtaagatgcgtgctacttactcgccgttattggtattattcagaaaaagtgagtaagactttgcagcaatgtttttgatcctgttcaaataaactaatggcatccgcaacatgctggaaatcaaatgtatgggtaattagtttttctggtttaattaaccctttacttaaccagtcgataacgaccgggaatttatttgcatttaagcgtgaagagaaaatagagagttcttttccggtaattccttgctgaatcacttcagacggttcactggagaagcccatcaatacaatacgtgccgctggagaagccagcgttacggcctctttcaagattgaaggatgacaagcggcatcgataattaaagtcggcttgatgcctttttcagcgaaactctcgccaagcggtgtctggctgttattaatcgcccagtctgccccgctctctttcgctttttccagtcgttcatcaatgcgatcggcaacaatcacatttttaacgttatagacgccttttaatacctgaacgatcgtcaggccgattgggccggcaccgtaaaccagaacggtatcattttcagtcggttgaccatgaccggtaacgttagccgcaatggtaaaaggttcgatcatcaccgcatattgatcggccacagcttcaggaattttccacgcattttttgccggaaccacggcatattcactgaaaccaccgtcagcgtgcacacctaatacagcaagtgtcgtacaaacgttcggcttacctatagagcacggatagcaatgcccacagctgaccaccggatcgacagcaacgcgttcaccgactctggcgctttccacgccgtcacccactgcatcaatgacgccaaagaattcatgaccaatgacgcgcggatatttcgcaaaaggattatgcccacggtaaatatggctatctgaaccacaaattccggcaagtttcacttttactcgtacttcacccgctgacggggtgggtatttcacgttcgataatcgacagttgattcggtttttcaattaaaatgcttttcattaccttactccttaccagttccacagcgtgccatcttccagacgtgcgactggcagataagcaggttcatagggatatttcgccgccagcttttcatcgaattcgatgccaaggcccggtt

SEQ ID NO: 10018 - DNA, 63268 bp, Escherichia coli
ccgggttttcccgtagtaattccgtagttcttcacaactctatccacagaaaaggtgaataaaaacggctatccaccccttcctctgtttataactctgcacataactgtgagttattcaattgttattagtgtgtaatgccctgcagagagtggtttaccgtcttcctggagtatgaaacaatcattcgtatataaagctttattttgaggtagtccggtgattgatgacgatggctaccgcccaaacgtaggtatcgtgatttgtaatcgccaggggcaggtaatgtgggcccggcgatttggtcagcactcctggcaatttccgcaaggcggaatcaaccccggagaatccgcagagcaggcgatgtaccgtgaattgtttgaagaagtaggattaagccgcaaagacgttcgaatccttgcttcaacgcgtaactggttgcgctacaaattaccgaaacgtttggtgcgttgggacacgaagccggtttgtatcggccaaaaacaaaaatggtttctcttgcagctggtgagcggcgatgcagaaatcaatatgcaaaccagcagtacaccagagtttgacggctggcgatgggtaagttactggtatccagtcagacaggtggtgtcatttaaacgtgatgtctaccgtagggtaatgaaagagttcgcgagtgtggtgatgtcactgcaggaaaatacgccaaaaccacaaaacgcatctgcttatcgacgtaaaagaggttaagtcacgccaattatgctcactcgcctgcgcgaaatagtcgaaaaggtagccagcgcaccacgcctgaatgaggcgttaaatattctggttaccgacatctgtcttgcgatggataccgaggtctgttcggtctacctggccgatcatgatcgacgttgttactacctgatggcgacccggggactgaaaaaaccacgcggtcgcactgtaacgctcgcgtttgatgaagggatcgtcggcctggttggcaggctggcggaaccgataaaccttgcagatgcgcaaaagcaccccagcttcaaatacatcccctccgtaaaagaagaacgtttccgcgcgtttttaggcgtaccaattattcaacgtcgccagttgcttggtgtactggtggtacagcaacgagagttgcgccagtatgacgaaagtgaagaatccttcctggtgacgcttgccacccagatggcagctattctttctcagtcgcagttgactgccttgtttgggcaatatcgccagacgcgaatccgtgcattaccggcagcacctggtgtggcgattgccgaaggctggcaggatgccacgttacctttaatggaacaggtgtatcaggcatcaacgctggatccggctctggaacgcgaacgactgaccggggcgttggaagaggcggctaacgagtttcgccgctatagcaaacgctttgctgccggtgcacaaaaagaaacggcggctattttcgatctttactcacacctgctttcggatacccggctgcgtcgcgaattgtttgccgaggttgataaaggctcggtggcagagtgggcggtaaaaacggtcattgaaaaatttgccgaacagtttgccgcgctaagcgataactatctcaaagagcgggctggcgatttacgtgcgctgggtcagcgattgctgtttcatcttgatgacgctaatcaagggccgaacgcctggccggaacgtttcattctggtggcagatgaactgtcagcgacaacgcttgctgagctgccccaggatcgcttagtcggtgttgtcgtgcgcgatggcgctgccaactcccatgctgcgatcatggtacgtgcgctggggatacctaccgtgatgggcgcggatattcagccttcggtactgcatcgtcggacgctgatcgtcgatggttatcgcggtgaattgctggtcgatccggaaccggtactgctgcaagaatatcagcggctaattagtgaagagatcgagcttagccgtctggcggaagatgacgtcaatttacccgcccagttaaaaagcggcgaacgcattaaagtcatgctcaatgccggtttaagcccggaacatgaagaaaaactgggcagccgtattgatggcataggactttatcgcactgaaatcccattcatgctgcaaagtggttttccgtcggaagaagaacaggtggcgcagtatcaggggatgctgcaaatgtttaatgataaacccgtcaccttgcgtacgctggatgtcggagcagataagcagctgccttacatgccgattagcgaagagaatccatgcctgggttggcgtgggattcgcattacgctcgatcagccggagatcttcttgatccaggtgcgggcgatgctgcgtgctaatgccgctacgggcaacctgaatattctgttgccgatggtcacaagcctcgatgaagttgacgaagcacgccgcctgattgaacgtgccggacgtgaagtcgaggagatgatcggttacgaaattcccaaaccacgtatcggcatcatgctggaagtgccgtcaatggtatttatgctgccgcatctggcaaagcgggtcgatttcatctctgttggcaccaacgatctgactcaatacatcctggccgttgatcgcaacaatacccgggtggcgaacatttatgacagtcttcatcctgcaatgttacgagctctggcgatgatcgcccgggaagcggaaatacatggaatcgatctccgtttgtgcggtgaaatggcgggcgatcccatgtgcgtggcaatcctcattgggcttgggtatcgccatctgtctatgaacggacgttctgtagcgcgcgtaaaatacctgctgcggcgcattgattttgctgaagcagaaaatcttgcgcagcgtagtctggaagcgcaactggcgaccgaagttcgccatcaggttgctgcctttatggagcgtcgcggcatgggcgggctgattcgcggggggttatagcgcggatcatatacatatcttttaacggtatccggcaaccagccaggtccccttgtgctattattcgcacctttggagcgcctgaaacctgcggcgcgcatttcaatcgctgttctctttcagcgaaataacaagaacttgtggtgacagatgaccagtagctatctgcattttccggagtttgatccggtcattttctcaataggacccgtggcgcttcactggtacggcctgatgtatctggtgggtttcatttttgcaatgtggctggcaacacgacgggcgaatcgtccgggcagtggctggaccaaaaatgaagttgaaaacttactctatgcgggcttcctcggcgtcttcctcggtggacgtattggttatgttctgttctacaatttcccgcagtttatggccgatccgctgtatcttttccgtgtctgggacggcggcatgtccttccacggaggcctgattggcgttatcgtggtgatgattatcttcgcccgccgtactaaacgttccttcttccaggtctctgattttattgccccactcattccgtttggtcttggtgctgggcgcctgggcaactttattaacggtgaattgtggggccgcgttgacccgaacttcccgtttgccatgctgttccctggctcccgtacagaagatattttgctgctgcaaaccaacccgcagtggcaatccattttcgacacttacggtgtgctgccgcgccacccatcacagctttacgagctgctgctggaaggtgtggtgctgtttattatcctcaacctgtatattcgtaaaccgcgcccaatgggagctgtctcaggcttgttcctgattggttacggcgcgtttcgcatcattgttgagtttttccgccagcccgacgcgcagtttactggtgcctgggtgcagtacatcagcatggggcaaattctttccatcccgatgattgtcgcgggtgtgatcatgatggtctgggcatatcgtcgcagcccacagcaacacgtttcctgaggaaccatgaaacagtatttagaactgatgcaaaaagtgctcgacgaaggcacacagaaaaacgaccgtaccggaaccggaacgctttccatttttggtcatcagatgcgttttaacctgcaggatggattcccgctggtgacaactaaacgttgccacctgcgttccatcatccacgaactgctgtggttcctgcagggcgacactaacattgcttatctacacgaaaacaatgtcaccatctgggacgaatgggccgatgaaaacggcgacctcgggccagtgtatggtaaacagtggcgcgcctggccaacgccggatggtcgtcatattgaccagatcactactgtactgaaccagctgaaaaacgacccggattcccgtcgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttactggtgcatatgatggcgcagcagtgcgatctggaagtgggtgattttgtctggaccggtggcgacacgcatctctacagcaaccatatggatcaaactcatctgcaattaagccgcgaaccgcgtccgctgccgaagttgattatcaaacgtaaacccgaatccatcttcgactaccgtttcgaagactttgagattgaaggatacgatccacatccgggcattaaagcgccggtggctatctaattacgaaacatcctgccagagccgacgccagtgtgcgtcggttttttttgccctccgttaaattcttcgagacaccttcccgaaattttgcaacgtcctgcaacggcgtaaatagtccggaagatgcgccgaagaaatagaaactggccctcgtctttttttctcctcgctccatactgccggcatgaaaacacaacgtggttatacgctgattgaaacgctggtcgcgatgctgattctggtcatgctaagcgcaagtgggctttatggctggcaatactggcagcagtcgcaacggctttggcaaaccgccagccaggcgcgggactatttgctctatttacgtgaagatgccaactggcataaccgcgaccacagtatcagtcttatcagggaggggacgttatggtgccttgtgagttccgttgctggggcgaatacctgtcatggcagttcaccattggtctttgtgccgcgctggcccgaagtcgaaatgagcgacctgacaccttcgcttgctttctttggcctgcgcaataccgcatgggccgggcatattcgcttcaaaaactcaacgggcgagtggtggctggtggtttcgccgtggggaagactccggctttgtcagcaaggagaaacagaaggatgcctgtaaaagagcaaggtttttctctgctggaagtgttgattgctatggcgatcagtagcgtattgttgctgggggctgcacgctttctgcctgcgttacagcgtgaaagtttaacgaacacccgtaagctggcgctggaagatgaaatctggctgcgggtatttaccgtcgcgaagcatctccagagggcgggttattgccatggcagctgtacgggcgaagggctggaaattgtcggacagggtgactgtgtcattgtgcagtgggatgcgaacagtaatggtatctgggatcgcgaaccggtaaaagagtccgaccagattggatttcgtctgaaggagcatgtgctggaaacgctacgcggtgcgacatcctgtgaaggtaagggctgggataaagtcactaatccggatgccatcattatcgacacttttcaggtcgtacgtcaggatgtcagcggcttctcgccggtgttgacggttaatatgcacgctgccagcaaggctgatccgcaaaccgtggtggatgccagctatagcgtgacaggatccaacctgtgaaccgcgaaaagggtgtttcgtcactggctctggtcctgatgctgctgattttgggtagcttgctattgcaaggaatgagtcagcaggatcgcagttttgcttctcgcgtgagcatggaaagtcagtcattgcgccgccaggccatcgttcagtcggcgctggagtggggaaaaatgcactcctggcagacgcagcccgcagttcagtgcttactgtatgctgccaccggtgcccgggtttgtctgcgtttactggcagataatgaagccttattgattgctggttatgaaggcgtttcgttgtggcgaacaggcgaagtcatcgatggaaacattgttttttcgccacgcggctggagcgatttttgtccgctgaaagagagggcgttatgtcagcttccctgaggaatcaacaaggctttagtctgccggaggtaatgttggcgatggtgttgatggtgatgattgtcactgcgttatcgggtttccagcgaacattaatgaacagtcttgccagcagaaaccagtaccaacagctctggcggcatggctggcagcaaacgcaactgcgcgcgatttcgccacctgctaactggcaggtcaaccgaatgcagacatcgcaggcgggatgtgtcagcatcagcgttacgctagtttcacccgggggcagagaaggcgagatgacccgcctgcattgcccgaatcgtcagtagtcaggagccgctatgttaagggtctaccattccaatcgtctggacgtgctggaagcgttgatggagtttattgtcgaacgcgaacggctggacgatcctttcgaaccagagatgattctggtgcaaagtaccggtatggcacagtggctgcaaatgaccctgtcgcaaaagtttggtattgcggcaaacattgattttccgctgccagcgagctttatctgggatatgttcgtccgggtgttaccggagatccccaaagagagcgcctttaacaaacagagcatgagctggaaactgatgactctgctgccgcaactgttggagcgcgaagactttaccctgttgcggcattatctgactgacgatagtgacaagcgaaaactgttccagctttcttcaaaagcggcggacctgtttgaccagtatctggtctatcgtccggactggctggcacagtgggaaacaggacatctggtagaagggttgggagaagcacaggcctggcaagcgccgttgtggaaggcgttggtggaatataccgacgaacttgggcaaccgcgctggcaccgcgccaatctctatcagcgctttatcgaaacgctggagtccgcgacgacctgcccgccggggttaccttcgcgcgtctttatatgcggtatttccgcgttaccgcctgtttatctccaggcgctacaggcgctgggtaaacatattgaaatccatctcctgtttaccaacccctgccgttattactggggcgacattaaagatcccgcttatctggcgaaactactgactcgccagcgccgacacagttttgaagatcgcgaattaccgctatttcgcgacagcgaaaatgccgggcagctctttaacagcgatggtgaacaggatgtcggcaacccgctgctggcttcatggggcaagcttgggcgcgactacatttatctcctttctgacctggagagcagccaggagctggacgcttttgtcgatgtgacgccagataacctgctgcataatattcagtctgacattctggaactggaaaaccgcgccgttgctggtgtgaacatcgaagagttttcccgtagcgataacaaacgcccgcttgatccactggatagcagtatcaccttccacgtttgccatagcccgcagcgtgaagttgaagttttacacgatcgcctgctggcgatgctggaggaagacccgacacttactccgcgcgacatcatcgtgatggtggctgatatcgacagctacagtccgtttattcaggctgtgtttggtagtgcacctgcggatcgttacctgccttacgccatttccgaccgtcgggcgcggcagtcgcatcctgtacttgaagcgtttatcagcctgttatcgctgccagacagccgctttgtgtcggaagacgtgctggcattactggatgtgccggtgctggcagcgcggtttgacatcaccgaagaagggctgcgttatttacgtcagtgggtcaacgaatccggcattcgttgggggatagatgacgacaacgttcgcgagctggaacttcccgctaccggtcaacacacctggcggtttggcctgacgcgcatgttgctgggctacgcgatggagagcgcgcagggcgagtggcaatcggttctaccttatgatgaatcgagcggcttaattgcagaactggtggggcatctggcttcactgctaatgcagctaaatatctggcgtcgcgggctggcgcaggagcgtccgctggaagagtggttgccggtttgtcgcgatatgctcaacgcctttttcctgccggatgcggaaaccgaagcggcgatgacgctgatcgaacaacaatggcaggcgattatctccgaaggtttaggcgcgcagtatggcgacgcggtgccgctgtcactattgcgtgatgaactggcactgcgcctggatcaagaacgtatcagccagcgttttctcgccggaccggttaacatttgtactctgatgccaatgcgttcaattccgttcaaagtggtttgcctgctgggaatgaacgacggcgtttatccacgtcagcttgcgccattgggctttgatctgatgagccagaaaccgaagcgtggcgaccgtagccgtcgcgatgacgaccgctatctgttcctggaagcgttaatttccgcgcagcaaaaactctatatcagctatatcgggcgttccattcaggataacagtgaacgtttcccgtcggtactggtgcaggaactgatcgactacatcgggcaaagccattatctaccgggcgatgaagcgcttaactgtgatgaaagcgaggcaagggtaaaagcgcatcttacttgccaccatacccggatgccgtttgacccgcaaaactaccagcccggtaacttacaaagctatgcgcgcgagtggctacctgcggccagccaggctggtaaagcacattctgaatttgttcagccgctgccgtttaccttaccggaaaccgtgccgctggaaacgctacaacgattctgggcacatccggtgcgggcgtttttccagatgcgtttgcaggtgaacttccgtaccgaagacagcgaaattcccgacactgaaccttttattcttgaagggcttagtcgttatcaaatcaaccagcagttattaaatgtactggttgagcaggatgatgccgaacgcttgttccgccgattccgggcggcaggtgatttgccgtatggtgcctttggtgaaattttctgggaaacgcagtgtcaggagatgcagcaacttgccgacagagtcattgcctgtcgccagccagggcagagtatggagattgatctcgcctgcaacggtgtgcagataactggctggttgccgcaggtgcagccggatggcctgttgcgctggcgtccctctttattaagtgtggcgcagggaatgcaactttggctggaacaccttgtctactgtgccagcggtggtaatggtgaaagtcgcctttttctacgcaaagacggcgagtggcgttttccgccgcttgcagccgaacaggctttgcattacctctcacaactgattgaggggtatcgtgaaggaatgtccgcgccattgctggtgttacctgaaagtggcggcgcgtggctaaaaacctgttatgacgcgcaaaacgatgccatgctggatgacgattccacgttgcaaaaagcccgtacgaaattccttcaggcttacgaaggcaacatgatggtgcgtggcgaaggtgatgatatctggtatcaacggctctggcggcaattaacaccagagacaatggaggctatcgttgaacagtcgcaacgtttcctgttaccgctgtttcgctttaatcagtcatgagtattgtataaaaattgcgcaatctatccgcttactttatgatgcgcaccagtcacggactgatggttatatagacataggctgactcgtgcagcacaagattaaattctggcagatgatttgcgttaacgtgttgaatctggccagaaaataaagttgattatgaggtccgtgaatgccccgcagcatctggttcaaagcattattgttgtttgttgccctctgggcacccttaagtcaggcagaaacgggatggcagccgattcaggaaaccatccgtaaaagtgataaagataaccgccagtatcaggctatacgtctggataacggtatggtggtcttactggtttctgatccgcaggcagttaaatcgctctcggcgctggtggtgcccgttgggtcgctggaagatcctgaggcgtaccaggggctggcacattaccttgaacatatgagtctgatggggtcgaaaaagtacccgcaggctgacagtctggccgaatatctcaaaatgcacggcggcagtcacaatgccagcacggcaccgtatcgcacggctttctatctggaagttgagaacgacgccttgcccggtgcggtagaccgcctggcggacgctattgcagaacccttgctcgacaagaaatacgccgaacgtgaacgtaatgcagtgaatgccgaattaaccatggcgcgtacgcgtgacgggatgcgcatggcacaggtcagcgcagaaaccattaacccggcacaccccggttcaaagttttctggtggtaacctcgaaactttaagcgacaaaccaggtaatccggtacagcaggcgctgaaagatttccacgagaagtactattccgccaatctgatgaaggcggttatttacagcaataaaccgttgccggagttggcgaaaatggcggcggacacctttggtcgcgtgccgaacaaagagagcaaaaaaccggaaatcaccgtgccggtagtcaccgacgcgcaaaagggcattatcattcattacgtcccggcgttgccgcgtaaagttctgcgcgttgagtttcgcatcgataacaattcagcgaagttccgtagtaaaacggatgaattgattacctatctgattggtaatcgcagccctggtacactttctgactggctgcaaaagcagggattagttgagggtattagcgccaattccgatcctatcgtcaacggcaacagcggcgtattagcgatctttgcgtctttaaccgataaaggtctggcgaatcgcgatcaggttgtggcggccatttttagctatctcaatctgttacgtgaaaaagggatcgataaacaatacttcgatgaactggcgaatgtgctggatatcgacttccgttatccgtcaatcacccgtgatatggattacgtcgaatggctggcagataccatgattcgcgttcctgttgagcatacactggatgcagtcaatattgccgatcggtacgatgctaaagcagtaaaagaacgtctggcgatgatgacgccgcagaatgcgcgtatctggtatatcagcccgaaagagccgcacaataaaacggcttattttgtcgatgcgccgtatcaagtcgataaaatcagcgaacaaactttcgcggactggcagaaaaaagccgccaatattgcgctctccttaccggagcttaacccctatattcctgacgatttctcgctgattaagtcagagaagaaatacgaccatccagagttgattgttgatgagtcgaatctgcgcgtggtgtatgcgccaagccgttattttgccagcgagcccaaagctgatgtcagcctgattttgcgtaatccgaaagccatggacagcgcccgcaatcaggtgatgtttgcgctcaatgattatctcgcagggctggcgcttgatcagttaagcaaccaggcgtcggttggtggcataagtttttccaccaatgctaacaacggccttatggttaatgccaatggttacactcagcgcctgccgcagctgttccaggctctgctggagggctactttagctataccgctacggaagatcagcttgagcaggcgaagtcctggtataaccagatgatggattccgcagaaaagggcaaagcgtttgagcaggcgattatgcccgcgcagatgctctcgcaagtgccgtacttctcgcgagatgaacggcgcaaaattttgccctccattacgttgaaagaggtgctggcctatcgcgacaccttaaaatcaggggctagaccagagtttatggttatcggcaacatgactgaagcccaggcaacaacgctggcacgccatgtgcaaaaacagttgggcgctgatggttcagagtggtgtcgtaacaaagatgtcgtggtcgataaaaaacaatccgtcatctttgaaaaagctggtaacagcaccgactccgcactggcagcggtatttgtaccgactggctacgatgaatacaccagctcagcgtatagttctctgttggggcagatcgtacagccgtggttctacaatcagttgcgtaccgaagaacagttgggctatgccgtgtttgcgtttccaatgagcgtggggcgtcagtggggcatgggcttccttttgcaaagcaatgataaacagccttcattcttgtgggagcgttacaaggcgtttttcccaaccgcagaggcaaaattgcgggcgatgaagccagaggagtttgcgcaaatccagcaggcggtaattactcagatgctgcaggcaccgcaaacgctcggcgaagaagcatcgaagttaagtaaagatttcgatcgcggcaatatgcgcttcgattcgcgtgataaaatcgtggcccagataaaactgctgacgccgcaaaaacttgctgatttcttccatcaggcggtggtcgagccgcaaggtatggctattctgtcgcagatttccggcagccagaacgggaaagccgaatatgtgcatcctgaaggctggaaagtgtgggagaacgtcagcgcgttgcagcaaacaatgcccctgatgagtgaaaagaatgagtgatgtcgccgagacactagatcctttgcgcttgcccttacagggcgagcgcctgattgaagcctctgccggcacaggcaaaacctttacgattgcggcgctctatttgcgcctgttacttggactaggcggttctgccgcctttccccgcccgctgaccgttgaagaactgctggtggtgacctttaccgaggctgctacggcagaattgcgtggtcgtatccgtagcaatatccacgagttgcgcatcgcctgtctgcgtgaaaccaccgacaatccactgtacaaacgcctgctggaagagatcgacgataaagcgcaagccgcgcagtggttgttgttagccgagcggcagatggatgaagcggcagtctttactattcacggcttttgccagcgcatgctcaacctgaatgcctttgaatccggcatgctgtttgagcagcagctgattgaagatgagtctctgctacgctaccaggcctgcgccgatttctggcgtcgccactgctacccgctgccgcgtgaaattgcccaggtcgtctttgaaacctggaaagggccgcaggcgttgctgcgcgatattaatcgttatctgcaaggcgaagcgccggttatcaaagcaccgccccccgatgatgaaacgctggcttcccgccacgcgcaaattgtggcgcgtattgatgccgtaaaacagcagtggcgcgacgcagtgggtgaactggatgcgctgatcgaatcttctggtattgatcgacgcaagtttaaccgtagcaatcaggctaaatggatcgagaagatcagcgcctgggcagaagaagagaccaacagctatcagttgccggagtcgctggaaaaattctctcagcgtttcttagaagatcgcacgaaagccgggggggaaaccccgcgacatccactgtttgaggcgatcgatcaactgcttgcagaaccattgtcgatccgcgatctggtgatcactcgcgcattggctgagatccgcgaaacagtagcgcgtgaaaaacgccgccgtggcgaattgggttttgatgacatgttaagtcggctcgattccgcgctgcgtagtgaaagcggcgaggtattggcagcggcgatccgtacgcgattcccggtggcaatgatcgatgaatttcaggataccgacccccaacagtatcgaatttttcgccgtatctggcaccatcagccggaaaccgcattgttgctgattggcgacccgaaacaggccatatatgcattccggggtgcggatatcttcacttatatgaaggcgcgtagcgaagttcatgctcactacaccttagataccaactggcgttccgcaccgggaatggtgaacagcgttaacaaacttttcagccagactgatgacgcgttcatgtttcgtgaaataccgtttattcctgtgaaatctgccggcaaaaatcaggcgttacgttttgtatttaaaggtgaaacgcagcctgcgatgaaaatgtggctgatggaaggcgaaagctgcggcgttggcgactatcaaagtaccatggcgcaggtatgtgctgcgcaaatctgcgactggctacaagccgggcaacgcggcgaagcgttgctgatgaacggcgacgatgcgcgtccggtgcgtgcttcggacatcagtgtgctggtgcgcagccgccaggaggccgctcaggtgcgcgatgccttaacgctgctggaaatcccttccgtttacctttcgaaccgcgacagtgtttttgaaactctggaagcacaggagatgctttggctgttgcaggcggtgatgacgcccgaacgtgagaacaccctgcgcagtgcgctggcaacgtcaatgatggggctgaatgcgctggatattgaaacgctgaataatgacgaacatgcgtgggatgcggtcgtcgaagagttcgatggttatcggcaaatctggcgcaaacgtggcgttatgccgatgctgcgggcgctgatgtcggcgcgtaacattgcagaaaacttgctggcaacggcaggcggtgagcggcgtcttaccgatatcttgcatatcagcgaactgctacaagaagccggaacgcagctggaaagtgaacatgcgctggtacgctggttatcgcaacatatcctcgagccagacagtaatgcctccagccaacaaatgcgcctcgaaagtgataaacatctggtgcagattgtcacgatacacaaatcaaaagggctggaatatccgctggtctggttgccatttattaccaatttccgcgtccaggatcaggcgttttatcacgatcgccactcgtttgaggccgttctggatcttaatgctgcgccagaaagcgtcgacctcgcggaggccgaacgtctggcggaagatctgcgtttgctttacgtggcgctgacgcgttcggtttggcattgcagtctcggcgttgcaccgctggtgcgccgtcgtggcgataaaaaaggtgataccgacgtccaccaaagtgcgctcgggcgtttgctgcaaaaaggagaaccgcaagatgcggcagggcttcgtacctgtattgaagcgttgtgcaatgatgatattgcctggcaaacggcacaaattggtgataaccagccctggcaggttaatgatgcattaactgcagaactgaatgcgaggacgctacaacgattgcccggcgataactggcgtgtcaccagctactccggtttgcagcagcgtggtcacggtatcgctcaggatctgatgccacggctggatgttgatgccgcaggcgtggtcagcgtcgttgaagaaccgacgttaacaccgcatcagttcccgcgcggtgcgtcaccggggacattcttgcacagtttgtttgaagacctcgattttacccagccgattgacccgaactgggtacaggaaaaactggagctcggtggctttgaaccgcagtgggaactggtgttgactgagtggatcacggctgtcctccaggcacctctcaatgaaacgggtgttagcctgaatcagctttccgatcgcgataaacaggtggagatggagttttacctgccgattagtgaaccgcttatcgccagccagcttgatgcactaattcgccagtttgacccgctatccgctggctgcccgccgctggagttcatgcaggtacgtggcatgttaaaaggctttatcgatctggtgttccgccacgaagggcgttattacctgctcgactataaatccaactggttgggtgaagacagttcggcttacacccaacaggctatggcagcggcaatgcaggcacaccgctatgatctgcaatatcagctttataccctggcgctgcaccgttatctgcgccatcgtattgctgattacgactatgagcgccactttggcggcgttatttatctgttcctgcgtggcgttgataaagaacatccgcaacaagggatctacgcgacccgacccaacgccgggttgattgacctgatggatgagatgtttgccagtatgaccctggaggaggcgtaatgaaattgcaaaagcaattactggaagctgtggagcacaaacagctacgcccgctggacgtgcagtttgccctgaccgtggcgggagatgaacatcctgccgtcaccctcgcggcggcactattaagtcatgatgccggagagggacacgtttgtttgccgctttcacgactggaaaataacgaggcatcgcatccgctgttggcgacctgtgtcagtgaaatcggtgaactacaaaattgggaagaatgcttgctggcttcacaagcggtcagccggggagatgaaccaacgccgatgatcctctgtggcgatcgtctttatttgaatcgcatgtggtgtaacgagcgcacagtggcacgctttttcaacgaagtgaatcatgccattgaggttgatgaagctctactggcgcaaaccctggacaaactttttccagtaagcgatgaaattaactggcaaaaagttgcggcggcagtggcgctgacgcggcggatttcggtgatttccggcggtcctggcaccggtaaaacgaccaccgtagcgaagttgctggcagccttaattcagatggccgacggcgaacgctgccgtatccgtctggctgcaccaacgggtaaagctgccgcgcgcttaaccgaatctctcggcaaggctttgcgacaattaccgctgaccgatgaacaaaagaaacgcattccggaagatgccagcactttgcaccgattgctgggtgcgcagccgggtagccagcgtttacgtcatcatgccggtaacccgctgcatcttgatgtgctggtggtagatgaagcgtcaatgatcgatcttcctatgatgtcgagactgatcgacgccttgcccgatcatgcgcgagtgatctttctcggcgatcgtgatcaactggcctcggttgaggctggggctgtgctgggcgatatctgcgcttatgccaacgcgggctttaccgccgagcgtgccgggcagttgagccgcctgacgggaagccacgttccagcaggaactggcacagaagcggcatctttgcgcgacagcctctgcctgctgcaaaaaagctatcgtttcggcagcgattctggcattggtcagttagctgcggcgattaaccgtggtgataaaacggcagtgaaaaccgtttttcagcaggattttactgatatcgaaaaacgacttttacagagcggcgaagattatattgcgatgcttgaggaagctcttgcgggttacggacgttatctggatctgctgcaagcgcgtgccgagccggatttaatcattcaggcgttcaatgagtaccagcttttgtgcgccctgcgggaagggccgtttggcgtggctggactgaatgagcgaattgagcagtttatgcaacagaagcgcaaaattcatcgtcatccgcactctcgttggtacgaaggccgaccggtgatgattgcccgtaatgacagcgcgcttgggttgtttaatggcgatattggtattgcgctggatcgcgggcaggggacgcgcgtctggtttgcgatgccggacggcaatattaagtctgtgcaaccgagtcgcctgccagagcacgaaacgacgtgggcgatgacggtacataaatcgcagggatcggagttcgaccatgcggcgttgattttaccgagtcaacgcacgccggtagtaacgcgagagctggtttacaccgcggtgacccgcgcgcgtcgccgtctgtcgctgtatgccgatgagcgcatattaagtgcggcaatcgccactcgtactgagcggcgcagtggtctggcggcgttgtttagttcacggggataaacgtaattgcctgatgcgacgcacgagtgttacgcatgtcgcatccggcgattttcatcgcttaccctaaatccgccatcaaaactttggatttacgctggtagttgtacaactgctttttgctctcgggcagtaaatcaatatccactggggtaaatccacgttcctggaaccagtgaatactgcgcgtggtcagcacaaacaatttgcttaagccgctctgcttcgcctgagcggcaatgcgttccagcagaacctcgccccgtgatgaactgcggtaatccgggtgaactgccacacaggccatttccccaatcttctcttccgggaacggatagagcgcggcgcaggcaatagtcgtgttatcgcgctgaataatggtgaatttgtcgatttccatctccagctgctcgcgagaacggcgtaccagaataccttgttgctccagcgggcgaatcaactccagaataccgccaatatcgttgattgttgcgcgacgaatctgctcggcgctttccatcacaatctgcgtaccgataccgtcgcgtgagaacaactcttgcaacagcgcgccatcttcctgataactgattaaatgacagcgacgcacgccgctgcggcaggctttcactgcgccacgcaaaaagcgcaccgtaccggagttgtaatcgcctttctcttcctgggcttctacccgtgcttgcgcttcgttagggaaaagttcggagacaatatcaccgtcgtcattagtgacgccctgggaagagcaaaaaccaatcattttttcagctttcagtttgatggccagttgagtggcaatctcttccgaggtcagattaaagctctcgccagtgaccgaaacagcgaccggccccattagcactattgcaccgctgtccagttgacgatggatcgcgtcttcatcaatccgccggatacgcccgctatgacagtaatccacgccgtcatcgacgcccagcggctgggcaataataaaattaccactgacgacgttgatatgcgcgccctgcagcggtgtgttattgagactcatcgacaggcgagcagtaatatccagttgcaatgttcccgctgcctgcttcaccagttccagtgttttggcgtcggtcacacgtatattcttgtgatacagcggttcgtggtgatgtgcagccagatttgcgtcgatctgcggacgtgcgccatagaccaccaccagacggatgccgaggctgtgcaacaacccgatatcattaacgatactggagaaattctcatgctcaatggcttcaccgccgagcatgatgacaaacgtttttccccggtgggtattgatatagggaaccgaatggcggaatccctcgaccagctcggttttacgttcctttaccacggtatacctctttgcatgattattcgaaattattgtatttttattctgttttttcgcagggtgcaagtgtaaattttatgcgggagcgagttttttatcagtaataccgtgaatataaaaagaatgtttaccgttttatagatgacagattatgcgtctttcgctaaagtttccggtcaaattggtcgtttacttgttacacagcttagatttcttttgctcgggagaggcatgtcaggatccaacactgcaatcagccgtcgtcgtttactgcaaggcgcgggtgccatgtggctattgagcgtaagtcaggtcagcctggctgcggtcagccaggtcgtggcggtgcgcgtctggcctgcgtccagctacacccgcgtgacggtagaatcaaatcgtcagctgaaatataagcagttcgcgttgagtaatcctgaacgcgtggtggtggatatcgaagatgtaaacctgaactcggtgctcaaggggatggctgcgcaaatccgcgctgacgacccgttcatcaagtcggcgcgcgtcgggcaatttgacccgcaaaccgtacgtatggtttttgaattaaagcaaaacgtaaaaccgcagctgtttgcccttgcgccggtcgccgggtttaaagagcgtctggtgatggacctctatccggccaatgcacaggatatgcaggacccgctgctggcgctgctggaggattacaacaaaggcgacctcgaaaagcaggtgccgccagcacaaagtggtccacaaccgggtaaagctgggcgggatcgtccgattgtcattatgcttgaccctggccacggtggcgaagactccggtgcggtggggaaatacaaaacgcgcgaaaaagacgtggtattgcaaatagctcgccgtctgcgctctctgatcgagaaagagggcaatatgaaggtgtacatgacgcgcaatgaagacatcttcattccgttgcaagtgcgcgtagcaaaagcccagaaacagcgcgctgacttgtttgtttctatccatgccgacgcctttaccagtcgccagccgagcggttcctcggtgtttgcgctctcaaccaaaggcgcaaccagtactgcggcaaaatatctggcacaaacccagaacgcctcggacttgattggtggcgtaagcaaaagcggtgaccgctatgtcgaccacaccatgttcgatatggtgcagtcgctgaccattgccgacagccttaagtttggtaaagcggtgctgaataagctcggtaaaatcaacaagctgcataaaaatcaagttgaacaggccgggtttgccgtactaaaggcaccagatattccctccattctggtcgaaacggcgtttatcagtaacgttgaggaagagcgtaaactgaaaacggcgactttccagcaggaagttgcggagtctattcttgcgggaattaaagcgtattttgccgatggggcgacgctggcgagaaggggataatgtttttatttattcaatgaatttatatttcgttgaatagataacatttacctgaatattagacgctggttttgtgactgatgtcggatatttgaatgtcggcttgaaaaataagccgaccatctctttaattaagcacaattccgtgtaatgtatacgcattagttaatcatcttgtaactgttaaatcaggcaaggcaatgtttgaagtagttattacttctgacgtgccttgcctttttttttggagccatggaatgatcatcgaaaaagtcatgaacaataattgtgtacaggcatcgatgaatggacaggaggttatcatttctgggcctggcgtcggttacaacaaaaaatatggaatgtcggtccctgagcatccggctaaccggattttttatgtcagaaatgaacaaaaaaacaaactttataaattgattgaacatgtagatattgagtatgtgtttgttgccgaaaaaatagtgcaatatgcggagaaaaatctcgaaaaaaatctcaatccatcgctactattgattcttgcggatcacatttcgaatgcaatatcccgagtcgtttcaggtatacaaattaataatgttttccttgatgaaatcaaagcgttgtacaaagcagagtatgcgataagtcgcgatgcattaactatcattaatgagcaattcagcgttcaacttcctgatgatgagattggttttatagcattgcatattttaaataattatgaaaattcagttgattatgaatcagtacggattattgagttgtcgcaaataatcacggagcttattgaagttgtttataacagaaaggtggacagaagttcatttaactattccagatttatgatgcaccttaaatatttttcaagtcgcgtgttatgcaatgaaaaaataaaacagaaagatattggtgatatctatgaacagtttcttgaaaaggacatcctgttacagcgcgcaattcatgaaattgaacggtatctgtatgccacttttaaatatgaattaattttagaagaaaaattatatctctctattcgtaccaaagtattaatggactaattatatataacatttatatgagataacccacatgaaacaaaagaaagcctggagtttttttcagagcctggggaaggcatttatgtatcccattgctctgctaagtgtatgtggcatgatgctagggctgggaagtggtttagccagtgatgatatggcaaagttaattccatttctggctattccaataattaaaaccatacttgatttcattgttagtcttggtttgtttgcctttgttaatttacctgtattgtttgcgatagcgattcccttaggattattaaaagataaagaggataaagcctatggtgctttttctggcttaattggttttatggcgatgcatctgggaacgaacttttatcttaaacagcacgacttattggtcgttgctgaccaaatgtcgacacatgggcaaaccatcattctggggatccagtcctacaataccagcgtgttggggggaattgttgctgggttattagtcgccagcatgtataaaaagatcgttaatttacgcattccagaatcattaggtttttatagcggcccacgtctggtgcctatcattacactgattgtgatgagtggatttggtctgatcattccttttatctggccgccgtttttcaatcttttcatgctcattggacactggatttcaacttccggtcctgttggttatttcttctatgcagttgccgaacgtgtgacgattccttttggcttaaaccatctggtgacgtcagttttccgctttacgccaatcggcggttcggctgtgattggcggcgaagaatattacggcaccctgaacatgtttatggcatacgttaaagagaatgcggtcattccgctggatttggcggggaaaatggagcagggcaaactgatgattcagtatggtctggctggtgccgcgctggcgatgtatcgcactgctcatgctcaaaacagaaaggctatcaaagcattgcttatttccggggtgcttacggtgattattggcggcgtcagcgaaccgattgagtttctgttcttatttgtcagtccactgctgtttgtcttccatgcctttatgaatggattcgctaacatggttctgccatatatgggcgtgaagatgggatttactggcgatctgattcaatttattagttttggcgtattgcgtggcacaagaacaggttggccgatcgcggtgtgtgtcgaagtggcctatttcttcatttattactttgtgttccgttggaccattcttaaatttaacctgatgaccgtaggccgtgaagagtccaatcctgtcacgctgaacgttcacgaagatacggctatagcggatatcccaactcctgataaatcagagctgcaagcggcggagcagatggttaaggcacttggtggtaaagagaatattaagtcactggataattgcgtaactcgtttacgtttaacaatcgcagatatgggattgattgacgaagttgcaataaaaagagctggcgggattgcggttgttaaacttgatcaaaataccctacaagtcattatcggcactaaagtcatcgccctgcgtcgggatatggataactatatggggatatactgatggatgtttttaatactcctgtttcccgcaaaggaacatattgtacccaatgggacttttgcgaggacagatttggtgtaaaagatgtactaccattctctatttcagatatggatcttccgataccagacgctatcaccagagcattaaaaaaacgcctggaacacccgattttagggtacagtcgttggcaacatggtgaatatctgaatgcgatagtaaactggtattatcaacaatatcaaacagatattaaacctgaatggataacctatagccccagtgtgatgtactctattgcaaaagcaatagagttattgacatcgcatggtgataatattctcgtttttacacctgtctataatgcattttttgatgtaattaaacatagcgagcgaaatattctgacagcctctttgattataaaaaatgaggggggctacgctatcaactggcaagattttgatcttaagattaaaagcgcaaagatggtgttattatgtaatcctcataacccgacaggaacagtctggtcggaagaagaactgcataaaatcgctgcaagctgtacaaggcataatgtctggttatgttcagatgaaatccatagtgattttgtttttaatcgtagctttacatccgcgcttaaaataaaaaaagaaaaagtagtagtatttaactcgatatcgaaaacatttaatgttcctgcactaacaggatcgtatatgatttcaactgacgataattttaatcataagttcagaacgatatcgaggtatcgcgattttgtaaactccccatcagtactgaatataattgcaactattattgcctataacgaatgtgagggatggttaaagtcattaaaggcacatattgcctctaacattcaattcacccagcagtatctgaatgaaaatattccagaattgatcgtaaggccagctgatggttgctatttttcctggatagattgttctgctattggttatccttttgatgaattctacagtcgattaattcatgaaggcaaagtgggcattatggcggggcatgtctatggaacggagggggagggctaccttcgtctgaacctggcctgcggtcgagaaaaattatatatggggcttacgcgtcttgtgagtgtaattaaaaatattaatcagggagaataaaaatgaataacacggatcttatctatctcattaaacattttatgcataacgaacttaaagcagtagaagaggttatttattccccactttctgaattcgctaatttaattaaagtattacaatcttgtcagggaaaagttgtttttattggtgttggtaagtccggtattattgccagaaaactcgcagcaacttttgccagtaccggaactccctcgttttttgttcacggtacggaagcggtacacggcgaccttggaatggtggcgaaagacgatgttgttattcttatttcaaacagtggtgagacggcggaaatcctggcgacactgcctagtttgaaaaaaatgggtaattatttgatctcttttacccgcagtcatcactcatcgcttgcgataagttgtgatttatctgttgaaatccccgtcaaaagtgaggcggataatttaggtttagcaccgtcatgctcgtcgactgttgttctggttgttggtgatgcggtggcgcttgcactctctgaattgaaaaagtttactcgtgctgatttcggcttatatcatccaggaggtgcactcggcattaaagcaaattcataatttcaaaatataaatacagtaaccggtcacgccatcttttggggtggcgttctttgaagtgagtgtccgctatgaaaaatgttctggtcaccttccccagcttttcagcacgctgtgtttccgccagcaagttgctaagagagaataattttaatcttattattaagaataatgtggagcatctgcttaaatcagaatccactgcattacgagaatctatttgcgcggtcatcgccggaaaagatggttatcaggcggacacgctatcattgctgcctggtgtgagaataatatcgagattcgggacggggatagacaatattgatcttcgtgcggcacagcaatccggtattgttgtcaataatgcggttgggattaattcaaatgcggttgcggaatttatcattggacttatcttcgcgagcatgagaaatatccctggcagctatcatgcgatgcaaaatggctactggggggagtcgcatggctgtgaattacaagggaaacggattggcctggttggctacggtaatataggtaaaactctggcgaaaaggttatccggttttgatgttgagcttttagcttttgacaaacaacccgactatcaggttgctgacaaagctggagttcagtttgtatcaattgaagatatctttatgcagtcgcatgtcatcattgttcttttgcctttttcttctgagctggagaacttcattagtcataaatatttgtcgatgatgcgcaatggtgctctgatcatcaatgccgcaaggggaaagttgctggatgagggcgctttacttcaggtgattgaagaacgaaatgtgtttgcggcgctggatgtgtttagctctgaaccgttggcgcaatttagcccactgctacatgccaaaaatatcattacaacgccgcatatcgcggccgccaccgttgagtcataccagcaaaccgggatacacgttgcccagtcgataattgattacttcgcaggaagggagataaaaaacgtgttgtgagttcagcgaacaaagattttaaatacaaaaaaaccgcaatttgtagaacacattgcggtttgtcagcattctaataaattggttgcgggggccacagtcaagaggttaatccaatcttttgaaacttaaggtattcactgttcccgaacccaagctatctaccgaaatatacactcattatctgatgtgaatcaacgagtagatcgaatggcctgttcctctctttttttgtacacagagactccattttaaaaaatggcaaggtcacatatcccttattggtacataaatcccccgatgtttactgactttgttccaccttcgtatccagtaaaatgacatagcgattcaacaactgatttaaccgggtatcaatttgcgtcaacagcgttggcgaaacctctccggtctgtttttgctcttccagttgccgaagcagttcttccagcggcggctcctttaacgactgccggatgccgtacaccgccgtttttagttccgaaccggtcagatatctccccttacgttcatccagtgcatccagctgcgccgacaggcgctgtagctggctctgcgcctgagcatagccattcagtgcctcagcagacagggcgctcagctcccgctgtttgcgccactgcgcgttcagcgccctgacctgaggattatccggccacagggcatcaagctggcgtagctggcgatatccttgctccagtggccagcgggcaggcaatttgtttaactgctccagttgcatctgacttgccgcaattgttctgtcctgagccagcagcgccttatcctttacatccagctttgccagttcgccgctctccagcgactgcggcaacggcatgacagacagttgtattcgctggattagcgcgtccggctgattaagctgcgaccagccccataatcctgttccgccgagaccggccatcacaaccattccggccataaatatcggccatgtccgctgccgggagatttcaggggatggaacgggtggactggcatccttatcgttttgctgaacggatctggttgcaaaaaccggctgtggactttcctctgactttttcggttgattcatttcccggcggggtaattcagggggagtgatagtggtttccgctccctgaggcgccagccgttccagacgcaatgcggtattgcgaaactgcccggacaatacgtccagcttcgtcatatgccacagttcacactgttgcagcgtggtttctatggtagaaagatgctgtacacaacggtagatctgcggcagatcctgatactgaatatccagcgttctcagtgcctgctgcattttttctgtgacccagctgagcagtgatattctggaatgtacctgtaccggccagaagtcagcccagcgctggagcagtatatccagtgaaccgagtccgtctgccatccctgccagcccctgccgtctggttatcgccagtacgtaacagaccagcgtctgtagttccacgccattttgccggaacagcgcgaggctgagtttttccacttggcgccagtccacgtctggccgggccgggtgagtcagtttactcatttcagcctgcagttcaccggattccttatacgtacagggatcgccgcccatgacgaactggctgataaaattcgcgttacttgccatcagtacgcccgctcctgctgtttgagatgacgcagaacaattcgtccttccggagaaaatacgccatcaaagcgtatccagccggtatcgggaagctgcgcgtggatcaggtaattaagatgccccggacggggctgggggagtaattccacctgtatctgactcaggcgtggttcataacgcagcagtgtttcttcaatctgacgcatcaggccatgaatacccgcagccatcccctgatggatcagactgagatccggcagaccgtaatccggcaaatgcgccagcgtgcctgcccggcagttgataatgcgttgcatattgtccatcacggaaaggataagctgatcccgctcgctgatctgttccagcggtaactcgccgctgaaactgaacgtcagcatttcatataaggaaggtgtcgacatcggttatttatccttgagaggcagcagtcgcaggtcgcttctcatcagttcaatcgagcgcggcttgtcggcctccagttcgtcccttttgatcaccagacgccagctgtcgcttttttcatcagggtgataaaactgcccaataatggcgacaaactgcgtctctttatccagcggcacattcagggatgccgtgccttccggttttacccagacggtgtgttttgccagtacgtccttctccagcgtcttctcttcctgcataaacagggtgtcgtaatccgccttgtcaaaatcttcgcgggttttcagttgccagacatgcaccatcgtggaaagcggcgtatcttccgcatccgtattcagggcgctgcgggagaagaaatcgagatgcagtattttgatttgtttgtagaaaacggctgaggccacgcttttcgattcatccaccactttctgaatcagcccgcagccactcagaacaaccgtcagcatcgccatacagagcaacgccggacgtttaaaacgaataggaaacatgagtcatactctccctgttacgaatggaaaaagcgggtattaatccctgataacgccccagactgaccgtcactgttccggtcgcgggcgcggcaaaggaggcgcgaaggatgccggtacggctaatctgtacacgctgttttcccagccgggcagcaggcaacaggctgacgggcagcgtcagttgcagacgggcctgacagcgccagcccagataaacgcgcagcagcaccagcaaatcgctgtgcagttgcccgccgggcagccagccacgtgcttctgcggcatcttcggtatacagtttcagcagcaactggctgttgacgtcggtaccggtacgccccagcagcgttcgcgttttcaggctgatgcgtgaattttttgacagacccgcaggggccgggagaattacaggctgcggatcgtgaggcaccaccgtggctttcgtcagcggggcaagcagccccaccagtgccgtgacgccttcagccgtgcgggtgggcaggcgcatcacgctgagcagggccagaaaacgggatacaggcgtggcgatatggttctcgctgccgggaatacccagcccgattaaccccagcagacaacgggaaatgtcatccacggcacctgcttcaaacgacgccgggtagttatatttgcgccagatgcggtaatactgggtgataaagcgatggttaaaaatatcgagaaacgccatcactgcgtcatgtccgtcatgacgctgggtaatgtagtccagataggcggtgggcagcggtgaatccacgccgtacaggccgagaaaggtggtgcgcaccgtgggtggcgcgtcgggattgtccacgtcacgttcaacgttctttaactcgctgaccggaaagcccattccgggatgggggcgaaaacgcaccgcatcggcggcggggttgtcggtactgcccagcggcgctttctgctggctctgttccagcaactggcaaaaacggtaaaaattgatccgcgcaatatccggggccagccggtcggtcagcccggtacgcgctggctgtgatgctctgtccattgcaggcactttcctgtgggttgcagaattaaggtcagttgagtgaataagtggatatcggcatacagtgcgaagaagcggtgcagcagttcaccaaacagcgtgatatcaccttctccggcaaagccgttactgtccagcgtcacctgaatatccacgccacgcagcagaaagcctctttcaaaacgctgtatcaggctgtgctgaacgtcgacaatcgcctccagacgacggcggttcatctcgctttcggtccagtcgtacagcgccagcgtgccgcgcagaatttcggcgttatccatcatcgataaaaagttagaaccgaggtggctgagcacccgccagtggaagcggtcacgcgccgggggatagcagggctgcgtcggggcgcacaggttgcgcacccgcaggacgttctgtgaggcatgaactggcgtatcgagcagggtgctctgtaaggctttacggggaagctgcccgttggtgccggtcagacttaaggacagggtttcatcctccagcatccggtcggaatcaaacgcatcgccgcccagaatcagccatgtgtcgtgcaagccggaagggccgcgctttacccgcgtgtggtaatagcgttccggcgcatcgtggcgcagcatcccgccccggtgacgaaagctggaaaaggggacatatgcctgactgccggtatggcgcgaagaaataatgttgtcgacggaataaatctcggtatgcccgtcctgaatgcgcatcgggcgtagcagaaattcgttttccagtggcgaaaggtgtaacggatcggcttcgagcgggaacaggttgatgaccggcacgcagtgcagacggatattatcgctgtcaaacggcaggtcgtgaggccagttctcgttcagcaccacgtcaatctcaaagccggttatcccctccggccatgcaacctgctccagcccgttcagcgccacgaacataaacttctcgcggaaggtgaaatactccagcagcaactggtaaccgctgaaggctgactcaccttttggccagagcctgtcatcatcctcaaagcccatcggggaaaagtgtgcgccaagcatccggcgatcctgccccggcagacgcagccagaactgctgcgtgccaagcgttaaagcccggtgcaacgcacaggctaccgggctgtcggcattgagatagagcggcaggcgggataaatcgatctgcgaccagtcaccaaccagcgggccgcacgcaaagcgcagacggataaccgagcgtccgtccggttcatattgcaatgacacgtccggcaacgccagcggatgcagcgtgatatcacgcgtggcactgtagacgcagcgggttctgcgctcgccaacagggcgcgacaatacctgaaaatcgctcagcgtttcgctctgcttcatctgccggtgatctgtcgacagttcaaccacggaaagtgacgggatggttcgcaggtagtggggccacagcaggctgaccagcccttcagtcagttccggcagatcgtcgtccagcttttcgcgcaggcggcccattaaaaaagcgaagccctcgaacaggcgctccacatagggatcgcgtgcgccgggtttatcaagattaagcatcgcagcacggtcgggatacgcctgtgcgaattctttacccgcttcacgcaggtagcgcatttcggcttcatagtagcgttgggtcaggtcgtccattcagagagttatttcccatttaactaaaaagttagataacagtaaaaagaaaatatattttacagttcataaaacaccagtaaaaaacaacaataacccataaagatgagcgcaattaaaaaaccattacaatcatctgttaaaaataaacaatgactactttgcttatagtattgccggtcagttacttcatcttcctgggtattacatctttaatatagtgtgtgatatttacatttcgttttacatgacattgatttatttgccatgtaagattaagcaatctcacactgaaaataaaattaactgttactgatacatcgctactctattgttttttagataaaacatcataacctcatcattgatttaattattgccatttttttcgcataatgatttttctttaacgtatttcgttgccagacccggcatccacccagacgggataccactacaagcaatataatttctagataataattcttttttgtaaattgaagaaaaaatcaacactgcgcaaatagagaaagcaataataattttaattatcaaccaaaggcgcaccattgttactttagacaatcgtcgcccactaatagcaaaaaacaaaatctcaaacgacattacatataatgtgaaaggtaaaaagacaattaatatatatccccagctatatacaataatatcattccataaaaacaattcataaatagcataacacccaaaagaaacaaaagccgaggacagaaagaatataaataaaaaactacaaattaaatttaccatttcttttattgcctgaatattcatctctaatttagtccccacttaattatattatcaagattttctcttagatattacttcacctcatgctccagtacctcccttcctttaattagcacattttttgcccacatagttcccaagtcccagatatcatctgcagtctctctggctttctcaacaaattcctgctgagctgcttcaatataggccacaatacaatcagtaatccaaactaagctgcgtatcgcacagtaccgccgcctgagtatcctgacacttatttcacagccttaccattctggtaatctctataggaatacgcagccggatctgtgttatgccaatagcctgcttcgtggacagtattatcaaatgcccacaaaaaatacccatcatcacttgttttagatatttttctttctgtctcaaattcataccacttatctttataagtaaaagaaataaggaaataatcattgacaggctttaatgtttccgcatcaaatgtcgtcctcagatattcacatttaattttaccgcgcatcaggtctttaaatttctgagcatccatctcagcaaggccatatagtgcaggaagtcttttatccgacccatttaatgcgttctgtaattttaatgtaataccaaagtcatccaaattagcaattggagtatattgagtattcaatatataatgatcatctattttaatatattgaagttgctgtagccattcgctggtatcaaactgtatccttttatttggccagttgggatcgttcgcgtcagcagttggtacagtgacaaccatctgatattcttgcctgtacatataatatcctccaccacacaaagtaatgacgacagatgtcgtcactgcgtaataccattttctttttaagaacattattgaacccactcctcaggctgataatcctgtaacccgcttttcagccctttcggcgaatcccctgttcttggcatatgccatgcaccattaggagctattggtcctccgccagacttttcatttttgtctctggtagtaacatctgcatggcgttttgatttctcatcatatccctctggtttcactggaggggaaacttcagtattcccctttgctttttctttattatacatatctatatcttttttatatttttctaccacactaccatattcctgagcttctttaatttccttgcctgtcccataagccagactgtagtccgatctcatctcaaacgctttaaccatgacatcccagttatcagccattttctgtgccgggctgtccttttgccctgcatcatccttcccggaaaaatctttatcaccatctgagataccggcccgacaggcatatgttgtcacatgggcatcataatcaaaaactgactcgtgaactgctgcaatatcttcatgtttaaacattccatttttttcaatatccttgtcttcatgatgataatgatatgaagctgttttaataacaccgtggcacagaataaccagttccttaatcactcttcctttttctttgcgttgattcaggaatgaaactaattcatccttattcttgacatagataattcttccatcgtgcgctttagtataatcattaattctatcaatatctttttgcgtatacccaagcgaaaaaaccaccataattcgctgcgaactggaatcctgtttactggctggaggaaactgttgtaattgttctaatccacaatttataaatcgatactgatttccttttgagtcctccattcctatccagtttgttacggctgttctggccgccacaatcacaatataatcacgcccattaatccagttgacatattttacaggttcattctcttcagttgttaattcgatctttctattgtcaatttcttttaatgaaccaaaatttttccctcttttcagccaggaatcagccagttttcctgtaagtgcaattaccttttgagcagtatctgtatatattctctcagtctcgccatcctgattagtcttgccactgagagacatgttattatttaggataaagacataaggtatgtcctgtacactaacattattttcgccatgttgaagttttatctgatgactgtattttttatctggattaccggaagtcagatttttcctcgccgactgcgcatgttgttccggctcgcttcccccgtcatccgtttcataggtatcatccatcattgacgcaataaaccgcgccttgcacgggcaactgctctggctgtccagagatcccgccatcagcctgccgtgaatatccgtttccggcacgccgcccacaataataaacattcccggatatctgccgcaggtgacccgatccatatcccgtgcctgtgggatacccatgatcgtatggtcgtccgcgccttcaataatcttcccgccgcaggtggttttgtcccccctgaccagaaagtagcctgttcccattgccatcagtccttatgttgcgtatcacacagtaccgctgcccgtgccggatcgattgccaccagcgttcccagcaggatttccatttttcggttcagcagggctttatccgcatagcggtgcgcccgcagacgcagcagtttcagttgccgggcttttacttcaaacagcagttctggctcccactgcgtcagcgttattccctgtgcggcggtatccagttcttccagcagcaggagcgccatctcgtttttaccgtactgttccgccacccgcgccatcagcagtcgcaataacaggcgctgtcgtgccgtggtgatgcccggacgggtctgtatccagcccagcgccgcttccacgccctgactgtctgccatcgccagtgcttccggctccagcgccagtacgtcatttgtggcgtcgtctgtcggtacagcggctttccccgcaagccatgcgccgtcttcccgcatcatgacctgctgcgctatccagttgcgcgtcacctcatcggcgaacggcgtgccgtcgttccatgccagattttccagccctggcaggcgttccagcagtaacgccaggtcctgacggataacagctgtccacctgtcccacggtacgcccgccttagtcagcgcctgatgcagataccactggatatccagccagaaatggctgacgccggtgctgaacatcaggtcggcctgctccagcagttccgtccagttctgctgggcatacagccgcttaagctggttgcgtgactcggtgcgcggcggggccagccgggttttgccgtccacatccggcggcagttcatgcaccgtgtcccagcgcagggttttcatcagccggtgcgccgaaagccagccctgcggctgttcgttcagataacgggccagcactttcgcctggtcgagcaggtcacgcccggaggtgatggtctgtacctgtggcgcatccaccggggatgacggtgcagtaacgctgctgctgttttgcggcaccaccgcgttcatcccgcccgactgcgccagacgtgattccagcgcgttaatcagtggcatcagggagggggaatgctggtcttcgggccatgcagtgaaggaaaccgtcagttgattaagagcggcaacaatgttcgcaaaatcctcttttgccacttccgggtagcgggcaaggctgtcgagcatcttttcccctgccagccactccagcgccattttccggctggccggacgcgagggcagcagttgcgtaccgaagcgttccaccagtccggtcagcagcgccagtccttccgccagtccgcgctcaccgtcgcggtgcagtcgcgcccagatgtagtaagtggcgatgcgcacgtctttggcctgcgtcagcagcagggattcggcaagctggcagataaggccggtatctgtgccggaaagtttgttcatttcgtcgcgtatacgcaggaaatcgtcgtggtagccggggtcttccccgaccggcgtgtctgccgtcaccggcagcagccatgtctgccacagcgccgcctgtgttcgcgccacatccagtgcatcccggtcggcaaaacagctacgggtcagcttttgcaacagttcactcatcggcgtcttccccatactcttccgcatccttcatactcctgccggtcagaaatacctgtcccggcaggcggaagtttttcagctccagcagcgccagcggccctttaccctgttcaacccgcagcaggtaattcagcggcaggccatcctgcgctttccacaccaccttaaaggtgctgctgtccaccggtgtcacctgcgcctgttccagcaggcgaataaggctccagcttccccggtaatccgccagaatgcgttccatcgcctgcgtgctggtccagctcagcgatgcgccgggttgccactgttcatccggccagttgaaacgctgccagcgttccttctggttgaaatattccagctcctgcccgtcaatcaccagatgcgttttcatcacgtcacacgccggttttgcccgcagttcgaaatgtattcccgcatcgccgctggcaaaggcggtgtcggccacgtcacgcaggcggttcagggcgcggataaagtccgggttaaccgtcagcccctgcgtgttcatggcgtcagccacccagtagcggccttcacgtttcagaacaccggaaaggttggcggcgataaactggttgatgcgcccgtcatcgcgcagatactgtgccagcaggggaagagaggcatcgttttgtgaggctttgaacggatagcgcccggcgaagtcctgattccagtggctgactatcgcccgctgccactgacggttcaggctgtccgccgcaggcgtcagcacctgccgccacgactgctccaccgggcggacgaacagcgcctgaccgaagccactccattcctcgcccagactggcggcgattaaccgtccgtagtcgcgggtgtcggtgaggtcaacggttttgccctgtaaaaccgtctgcgccagttgctgggtcatctcctgcgggtcgggggcgttggtcacctgttgcagtttgagacgcacgcgggtgacgcgggtcagatacgtttgcaggctgagttgcgtatcaccaccaccgcctcctgccttatcgcccagcaaccgcagtagcggcgcgaaggttttatccagcggcccgacaggctcgttgccttcacgggattgctgcggcgttttctccttgccgttaaacagttcctgtgccgatttcgccagcgagtctgacaggccacggttttccctgcctgccgccgcctgccacgcgagggtgtccgtcagcgcaatcagtggcgactgacgggcatcggccatcagtgtcagctggtcgagaatgccggagagcgagtcttcctttttccagcgaatgctgttgagaaacgccagccagcttccggcaaagtcggtaaagtagcgtgaggtgagacggttacgcagcgtatccggcgagatatccgcagaggtatcctgctggcggtcgctgagtacccagtcgatttcctcgcgccgcgccgtcaccacctgctcgatggcttccctgacctgtccttcccacgcctgacgggtgaacatccccggcaccgtctgttccgtactgaaaagagattcggtgagggtatccccggtcatgtccgccagcgtcatatcggcgtagttgcgggacacctgttgcagcacgttctggtagagggtgttttcggcattacgcacaccaatctggcgcagcaggattttacgcactgcgccggtcagttccggtggcggcgatgttttccactgcgggtgttccggcaggttcgccgtccagaaggtcagcagtgacggcaacacgctctgccgcacaccttccgggatattctcgtagcgcagaccgtccgccatcagcgtggtactgaaaaaggcagcgtcggccttttccgggcgggaagtcatcagcaatgccttaagctgcttatagcgttgttcaccggtggcggtacgctgaggactgttgggcggcagcgcgacaaaggcattaagttgctgttgcagatggtcaacggccacgtcgcgcaccagccggtttgccgcctgcgcatagccgggaaaagcggcggcgagcagttgttggttacgttcaaggccaaaacgctgataccacggcgcaccttcgcggatacggtattgcaggcgttccagttcgccctgcagggtatgcagcgccaccagttgttctgccagcggcaggcgggtatcgagcgcacgcgccgtctggataccggtttcctgaacaagagcgcggttggcgaagaacgaggtcgtcattccggccccccatatcaccagcacgcagacagcggacatcagtgcggtacgcagccacggaaaacccaccgtgcgcccgcgcgcgttatcacccgtcacgcccgcccagaccggtgacggcagccacgcatgaggtgcggcctccggcacggcggcaagcggcgggctgaacatcaggccacgcaggcgcagggaagaaaatgcgccgcctgccagcagcggtttcagaacgctttgccagtgagcgataccccgctctgcaagggtatgggccagacgcagcaggaaatcatggcggttatccgccagcagttgcgacatgccctgttccgtcagcggcagggtttgtgcttccagcattacagccagttgttccggggtacagcgttccggcagcaggcagccgacgctttgcagggggcgtccggtctgataatcaccgtcgtcacagacctgccacaaatagagtggagcctgaaaaccgagtcgcttaccgccgtttatcagttcgcgccagcctttgtcgagttgtgcggtctggcggctttgttcttctgtcagcggccagatgatgccgtccagcggacggctgcggcgcagtttttttaaggcggtcagcagtgtgacatcaggctccgctgttggcctgccgccatatatcagcacggtgtggtcgccctccagccagtgttgcccggtcagccccggcgcgatggcctctgcctcttcaggctcgccggtcaccagcagcaggcggactttacgccgccagaacggaccatagcgtaaccgaatatttgagctgagatcggttaaaatatcctctgatggagaagatacgggttggtcgttttctgccgaattttttggtctgtaaataaattgcgctttcctttgcttccggatccaccagaacggcgaacacacaaccccaagtaaaaaaagagaaaataatcccgcccatattccccatatcagacgagcagacactccgctctttatcagaacatcctgattaataataattaacagagcgcaaatccctgccaaaccaataatcagaattaaatatccccagaaaccgtaacgctgagtatgcattatttttcctcatgtccttaaataaagcttccgggtaatcaggcaaaggctctttttctgagcatactgtgctgactgatagataattaaatgattttgttcagtttctttggcagcctctgacagcattgccagagagacaggaaaaataaactctcctgtagggccaaaggaatgatcaatcatgtgtaggggccgttttttaggaagtgaccattgatgttgttcagcatactgcataaggttttctatcgttccctcatctaaaccagagacccagacatgctgtagttgtttgttatccaattggttatattcaaataacacatccagattatgctccaactcctcgggttctaatggcattacacgccccagaccagcaataacgggtatctggtgctgccgtacaaatgacgatgaggagataagctgtgctgataccagttcactcgtatcttcaggtttattctccggccagttttgtaaacaaacaaccagaattagaccgtcaaatctttcatcataaagagactggatttgattaagagtattggtccgttcaggtactaagtcccattgatggaaaatagcctgtctcacggtttctccacgccatttctcaggctgtaatacgtagatagtatgtagataatgacgataatcaggaaattgttgtgtcagttgctggtgaatatcatggaatatagacgaaagagaataacgggatgcagagaataacggtcgtgcctttttaggatatgcagggatctcttcctgtggccccagtaaaacactcatgcctttttcttccggtgtaaaaagaacattcccaactattgccagttgtttttggctccagtgttgccagagttgtttaacttgttgtctttcagactcccaacttatacaggctgcaacggattgttcatatttgttcagcgcaataccaaacaaacatagccaaagaaacagcattggcagaacgccataaataaaaatatcccagtatgtcgcagaattccagaccgataaaataaacagagtaccaactgttaacatagatattaataatataatccagcgtcgataaacaggctcaggtagcatttttctttctggaatatcgggtacaggccatcccatattatgactcgatactattttctggttgagaactgataaccctacagccacatgcacattggcaatgattaacaacgacattacgacctttttccgtcgctgtcgggtcaccttcttgtatgggattcacgccgtgctttgggcaggaaaccagatcacctacgagagctacctgaatgccattgataaaaagcgttgaagttgcggtaatcaccttaccaccatgagtcgtggcatcacctaaacaaacgatcccaggcataatttttacctctgatttatttacaacaggaaaataatttaaaaaatgaaagtatagttgcctattcccggtcattgatataaatgagataccattatctttatgttttgtgagagggggtatttcagcgtactggtcatttgctgcaacacggcaaccagttcatgttcggttaagacttcttttgaattcagaaggtctgatgctataagtcatcgtaagtattaaccgttgaccaccattctttttatcatcatggactgtcagataaaacctgtaattttgcagcgggtcagtacttagcgtgatctgctgtttaatctactatacccgataaacttgaagatgcacgtaaatgagttctgtagcccaagccctttccgacaagggccttgtgcgtaccatgcaacttgaagtaccacgagtatattccgatatctccagactgttctgattatctgctttaccactgcgtgggatgatatttaattgtccctgttatactttcccacagcgccatcagttcatgttcagttaatgcattgtcagcgtgtaagatgtcaacactgtaattcataacaagttttaataactgtttgttgtttttcttatcctcatggattgccagattgaattcataatctcgtgatggttctgagttcaacattatttgcttacgaacccaccattcagatatctccagaccattaattttcttacgacctttatatagagttataccatgctctgtttccattactcggatatcttatatctaataatgagtcaatataactattattatccgtctgcaaacttattttaatattattgctatttttataatctacagataattcatactctccaagtagtgaagcgtcaacctgtgcatattgtatcgccaatttattttctgatgggggttggttatctgcacgaggttgtagtcctgaaagaatagtaagtaactgtacttttttttctggaatattatatccataactgtattcggcaatcttactaattccatcatagcgggttgctctaccatctttagcttctatttttactgaaaacgtaacgccattttcccatttccatgcatccaatactcgtgcaaaatctggggtgtatttcgctttcattcgttcaaaaatgactccattcataggtggacttagtgggtgaacttgcttcaaataaggcgtatccagtggatctaatgctgaggtgttttttagttctgcctcatatcgtgtcatatattgcagaaaaggaggataatattgtagctttgtttctacagggatcatcgccgatccttgtatgaacataaccattcctgttggtttgtaatcagccggaagttctatggaataaaatccaaagtaccgagtttcaggatgttgtgataacattatgagcatctctttttctttatcatttagtgaataagtatatgctttaggtctgaatataatccatccaataaggactataaaaacaatcagcagacatttatttctacggttaatcagagtatgacattttaccatccttttttacctcctgagctatttttataatagaacgtaatgcaaatgcctgactaacgggatttcgataagcagcctcgtgagaaacctgtacagccaaacgctctaggatgttcttgtgtacgatttgtcctgcacgaagaggtactgtaccatccccgttttcacaagagtctcgtaatgtaaaacgctgtcctatcttaacatatgtatcaccgtcgtcagtatttatttcccacgcctgttcttcaggagaaaattcatccttaatagttctaatgttaccaacttcatttaaatcaagacgaccatcaatgaattttggttctaaagatatatcacttttttttcccattgataatgagcctttccaaagaacattttcctgcgttaaatgcgcttcaggaatatctcccaatttcgctctcccatagaaagagtaagtattgatatgatattttccagcaatttgcttatgaaatggattgacactctcagtaattaaattttcatatatattccaatcagtatcaatttgcttttgatttaatgaagtattaaaaggattcaatagattctcatccaccaatttccaccaattttctctatttagataaagttcagcgtaggtgcgttcttcgggggcaataccttctttaatgggaagatttttagggagcgttaatgtactaccatcacgatcgacaatattaagccactcttcaccataatcattcatgggtagtaattccattggtcctggcgactgggaaaaaacagctaccatttcagctgcattacgacctaagatatgactgataacatacccttccggatttgactctgggttttcagttccacgtttcattcgggtatatgtcgccgcagcaccaattgatggtaatacgccatgaacaataccgtagacatccgtattccccgaaagacactctgaaaagtaccttgccactagtcctcccattgaatgcgtaaccagaataactttatggcatttcattcctcgtttttgatagcctccaacaattttcttgatctgttcttgtagtctgattgctgagagcatattagaaccaagccagttatagccaacgacatggaccggaaattgatacaaccttatgacttcaagatactcttcatcaagtgagtcaggaccatactccaaacccaaaggtacatcgagtagttgctggtaggtcgcacttaacgtctcacctttctttgtaggtttgtcccggtacaatgctgtttgtaatacatcgagaaaggaaccgtagctagcatttgcaacctctccccagccgcgatcttttcttgaaccaaataatttcgcttctggctctatattatccaaaatgtcacgtactgcctgagtgtaattatccattgcttctttatcggatgggtcctccggatattgttgacctaactgaataagtttttcttgggcatccggaggtgcgggaattctcccacgattatcgacctccaccctgtcaggatgcaataatcttttcctctcttttggtcctgatgtaggtagtgaccagcccatcagactcatagagtcatcatatcgccagatggattttcctttcttatccataaggtttgaacccatgactccgggcagaaaaataaccggaataacccgtagatcctcaatttcaacggtgccaactttattcttatcggccctgtccatatgcatcgtcgatgtcataatttccccctgtatgcactcagttttcctgactatccggcagatcaatttttattgactcaacgaaaagccctgactgtatgggcaatcgtccttgttcatcggtggtcatttccaccactgagccatcaccccgtgtgacctgtaccttttgattttttgcaggtttgccagtttgttgccagagtatttctggtgtgacagcaaaatcagcagaatcccactgttgcatcgcctgactgatgctctggccgctgaacttctgccatacggccccacgctctatgatcttgtctggggctgcgcattccaccgtaccatcaccaatacgaatatatccgccgccgctggtcagaatgatttcgttttttgcgctaataaggattcgcccctcactgctgctgatgcggatatctttcagcgcatctagcaacatttcatctccctgcgcctgaatctctacttttcccttaccggcaaaaatttttatccccagcttttgggcaaacagacttaccgtttctccagcagcaacggtaaacttcttcaacacgctgaaatctgaattttttccactggtgctaatgatgttttctcctgcggacagctgcaggctttttggcgtaacctgagctattccttccggagccgaaagcaacatcgctgattttttgagttcctccagagcctctgacatcattactttctgagtctgcaaatctgcaagttcagcctttgccacttcagtagcactacatagtgcctctaccaaagactgtgcctcgcgaagttgagctagtgcatcagtcatatccagaacctgaccctgcgccttgtcctgcgcatcggcgctgataaaaatccctttcttcgcccgcactgcgccccacatatcggtacgcagttcaaagccttccccgcgctgctgtttcccggcatccaccagatgaccgaggtttagctggctcttgccgccgtattcggtgctgaccttgatatgctccttcccgcgttcgtcatccagccggattttgttgttggccggggtacgcagtacgttgcgcttgtagttctgaatggtcacatggtcggtgtgcgccgagtcgtgttttacgcctgcaatataaggtcggtccgggttgccttcctcaaaggcgatgctgacctccgttcccgccagcagcggcaggtgcaggccgtaggtgtctcccgcatacgggcgcgactggcgtacccacaggctttcataacccggtttccatgcgtcgcggtcaaagtcgagattgacccggtagcgcccgtccttgtcgatatgggcataaatatcgttcttcaccgtgctggtgacccgcgccgggagcgtgccggccattaccgggcgggggataagcgccgggcggtagccgtagcgttctgagtagggtatcgccgtgaacgtcagttcatagctgcggtcacgcgccgcgctggccgtcacgccggtaatcagcacacccttgcggaacaccgctggcgcgtcgtcgccctgaaccctgatttccagccccggcatcagcagtgaactggtgctctggcctttgagaatggcctgttcattcaggtagcgttcgtggcggatacgggcataaaacgcgccgctttccgctgcctctttatcgcctttttgcaggaagttgtcagcatagtggtaggcttcgccgtaggtggtgttatcgcccccggtggcgtcatgctgctctgtcatcatctccgctgtggcggtgcggtagttgtagtcccgcgtggtgacgtttttctccaccacgctgtatgccgtgttcagcccccatacggcttccgtttcaccatcaaacagcccagaaggatggcgaagcggcagcgtcagcccgcgctcatagccgctctggtcgtcgtaaaattcgataacttcgattttcagccgggcgtcggtggcgaagcggaaccagatacccacttccgacagcaggcgtgagacaaacgtcaggtcgtcctcgccatactgcatcacctgttcgcgggccgggtattcgcttttgaggttaaacacgaagtcctgaccgcgcatctggtgtcgctcgcgcaggattttttcgacgatttgcggcaccgtctggttctggtagatggcgttctggcggctgcgggtaagcagcgccatacggggttcaaggcgcacttcgtaacgggcttcgtcctgtgacgatgagagatgtttaaagccggtaatgacgccgtgcagggtgcgcagggcagtctgtaccggcattccctgtacgggcggtgccgtcaggctgaatgcgccgtcctgcatcagcaccgattccggcgcgatggctttatcgctgctggtaaactgaatgtcgtagcggaagggtgagctgagctgttcgtggcctgtaaaagtcagcacgtccaccgggcttttcaggccgcgaattttgagcttgtggtgtgagtggtcgaaattctgaatacccatgacagcctccgttattgcatctcttccgtagcgaactccagtacaatcccgtcctcctcatcccagccaagccgtagttgggctggtttacggtgcgcggcctgctgtgccagcaactgctggcttaagaccggcaggatttgctggttcagcaggctgtcgatattacgcgcaccggtgtccggcagcaggcaggcggcggtaagctggtcatacaggctgtcgttgatttccgtttccagtccgtagtgctggtgaagacggcggaccacctgcgccagtttcatttccacaatggtgcgcatcgcttcctgtcccagcgggcggtaaatcaccgtctgaaaacgcgccatcagtgcaggctgaaaatggtctcgcagaaggggatacagcagttcatgcaggtctgcgtccgtggcgtccggtttttcctccagcagctgcatgatgtggtcgctgcccagattggcggtcatcagaatgacggtgttgcggaagtcgatttcccgcccttcgccgtcgcgcataaagccccggtcgaacacctgatagaacaggttcatcacgtcgcgatgcgccttttccacttcgtcgagcagcaccacgctgtaagggcgtttgcgaacggcttcggtaagtacgccgccctgaccgtagccgacatagcccggaggcgaacctttcaactgggaaacggtatgcggttcctggtattccgaaagattaatggtgataagggatttttcaccaccaaacagggtgtcggccagtgtgagcgcagtttcggttttgccggtgccgctggggccggtcagcaggaataccccctgtgggccgttctccggcgtgaggccggttttagccgcccgcagccgctgtgcgatggcgcagagcgccgggcgttgcccgaccacgcggttttcaaggctctgttccatactgagcagatcgctctgctcgtccctgagcagggatgagagcgggatgccggtccagtccgccaccaccgtagcgacggcgcgggcgtccacatccagcgccagcagcggtgcaaagccctgatgcgttcgcagttgctgttgcagttcagtgctgtctgttccttcctgacgcaacgtcataatctgctgcgccagtgccttttcctgctgatactgcgcttccagatgcccggcttctgcctgtagctcatcacgcaaatcggtcagttccgccagccgctccgggctggcttcgggataaaatacgctgtcctgctcaatcgcttcccgctcaatatccagtgccgccagtcgcgcatgaagctgcgtcaacggttccggcagggtgtcaaggctcatgcggactcttgccccggcggtatccagcaaatcaaccgccttgtccggcagctggcgtccggtcagatagcggcgcgacaggcgcacggcggtctgaatggcgctgtccagcatatgcacgccgtggtgctgtgcatagcgagccttcagtccccgcagcatcagacaggcggtgtcatcatccggctcgtcaaccttaaccatctggaagcggcgctccagcgcggcgtcgcgctcaaaatactgtttgtattcgctccacgtggtcgccgcgatggtgcgcagttcgccccttgccagtgccggtttcagcaggttcgccgcatccgcgccgcctgcctgattacccgcaccgataatggtatgggcttcatcaataaacagcagtaccggctccggtgatttctgcactgcatcgatgacatttttcagccgctgttcaaattcacctttaacgcccgcgccagcctgtaacagaccgaggtccagtgtgcggatatgcaccgttttcaggctgtccggcacgttgccttcggtgatacgcagcgccagcccttccaccagcgcggttttgcccacccccggttctcccaccagaatcgggttgtttttgcggcgacgggagaggatatcgaccatctggcgaatttccgtgtcgcgcccgaataccgggtcgattcgcccgctgcgggctttttccgtcacgtcttcggtaaagcggttaagcaccgccagcagggcgtcatcctgtttctccgtcagcgtttttgccggtgcgtccgccgttgccgtctccggcagtgcagaggtcagcggttcggtgacctgtggctgacgtgccggacattcatccgactgcgcatccagcaggggacgcagccgctcaagctgcacgcggctcagactcagcaatacccacaggtcattacaggcgggcagcatcgatttttctgtcagcgccatcagcaggtgctgactgcggatttgcgggtcgtcgccttccagcgaggcaatcagccacgcctgcctgataagcgccgtcaggggttcagaaagctgcggacgttcgcggaccgagcggggtaaggtgtccagatgtgccagcagagactgccagagcgtgtcgatatcccattcatagcggcgggcaatcaccgtgatatcgccttctccctgctccagcagtttcagcagccagtgttcaatggttatctccgcatgggcgcgggtctgacacagtgaggcggcagcgtccagcgcccgtgcacagtatgggttaaggcgacgcagcagcgcggcggggtgatttcctgtcatagaagggtttccttatcgtgttctgtattcctgcgatccgcgttcaggcacgctaccgcccatagccgttacctcactcaggcccatcaggtttcaccagattgtgggtatgctttgctcagtaccggtgcctgcggcactggacaaagcacacaacaaaaaggcagacagtttcctgtctgccgcagttatcaggcggaaggacgctcattccacgagtcggaatgaatgatgttgccgtctttgtaagtccaggtgattttctcgtagcggaactcaatgcgttccaggtggttatgcttctctttacccggatctttgatgtcgtgcatcagcggagctactctgaccagcttgacgttatccagcgtggtattgaaatactccacttcctgaccggcatcgttgatgcggtagaatttaaactccgccgttttcagggtctgtccggtggtcacagctttgtagagatacgggctggaggcatcgatttctttggtaaacgtaaaaggcttgtgagtacgggtaccggtcagtttgccggtgttattgtcggtcgggatgtacacatcgtgatccagcgccaccacttcgatgctaccttcgcgcccctgaacgtccacggaacctttgatatccgcgccgccgtcatctttcagccagagataagcaggaatagccatgagaattactctccttgttagtgtgattgaagcaccgccttcttccggcggtatgttttatttcacgtcctgacaggcgtcagaacgcggaacaagactgatttcgacacgccggttgactgcccggccctgtggcgtgtcgttggtcgccgcaggctggctctcgcccagtccctgtacggcaaaacaggtggccgggatgtcgctggtctgcagcatccagttgcgcaccgcttcggcacgccgcagcgataactgctgattgcttttttcatcgccggtggcatcggtatatccggccacgaggatcagccagcccggttttgcccggatgttcaccagtgcgtccaccagcacttttgtcgagccgtctttcaggcgggcctgtccgacgtcaaacagcgacatactgtcaagacgcacggtctgaacctgaagcgaagccgtcacctccattttttgttcaggcggacgccagtcgcgaatggcgcgtaataccggctggcggatgcgttcgccggggtataaccccagaccgaggcgcagtggttctccttcccggtaatacccatcgagcatggtcgcatcgtctttcagcaccgacaggtgacgggctttggtgataaattcctccaccgggacggcataaaaccggtgcagatcgtcaccgacctgccgtaataactggcgatttgccgtggctgacaggcacagcgcggcgatacccgccacggtggtgacgcccagcatggtcacgcaggcccgtcgcagcggggtaaagcccgactgacgcggcaaccgccgtaacagggcatccgggaatggcagcgcatcgtctgtgccggtgtccgcgatatccggcgtcaggccggttctggcggtgatccacaactgccacaggttgttatccaccgcaggcaacgaggggaccagccccacggccatcgccagtggtggacatttcgcctccgggccgttcagttccgccagcacattaagatccagccactgcatcaggctttcggctttcagcagataagagagtcgctgactgcgttcctgtacgccggattgtgcaatccactgcgcgggcatcgcgttctctgtggatgttgctacctgaacttcgccgccggtacagataaaccacggtgaactcgctctttccggcaacggcgagccggacagcccgctccagagaagccaggggacgtttacgcctgcccgacgacgcaccgtcgccatactgtgggcgaaccgtcgcagccgtccggccagaaccgccacatcccggtgtatgccgggcatgatggtatacgccacggcaagctgcgatgcccacgccgggcgaagggtcagcaatcgctccacctgcgccacaagctgttcttcatcaggaacatgcagatacagcccttctgaaacctggcggaccgggctgtcagtgaacaggtgcgccgacagaccgccacagaccagcactaccggctgtcggtaggtttccggcggcagcgatgacaacccggcatcgccggtcatctccgtccacgcctgcctgcgccgataaatcaacaacgcagcaaccgccagaacgatagccgccgcaccggcccatctcagcacgccagacggactgataaacactgaccacagcaccagcagtaacaccattccccacagcacgatggcctgtttcagcgtgttcctcactcacgactccctttaacgcaggctttgcggcagcagttcatccaccagtacattcagccagtggtgtagcccccaccagacgcccgccagtagcagcgccagtgttaccagccagaaaaatggcgaatgcagcaaagggtgctgacgggtggataacggcacgttcagtaccgccgtttccggcagcacaccaaatggcgcgacctgcccgttgagcgtcgaaataagctggtcgcgctccggggctgccggatcctgataacgcccgcgaaatcccagcagcaggacacggtgaaagcaggtcagcacggcctgcgcgggggcgggttcctgtagcacctgcttcatccgctcgtacagcagctcaccggcctgcagggtgttgaagaaatgcgactggagtgggtttttcatccagatggcctgaccgtcgtccatgccactacggctgagcaccgtttcgtccagcagggcgcactgcgcgtaagttatgtgctccacgttctcccgactgaatccggcatctttcagacgttcgcggaccagttccacctgccgctgacagtggcgatacagctcgataccgtgacgcacggtggttccctgacgcagttccaccaccgtcagaaacgtgtcgcgcagcagcgcatcgatattgatatccatatcttttttcatgtgcgcagcaccgcaaacagttcaggtttcaggtcgcccatggttcccggcgcataaatcatgcagctcccggactccagcatcgatttagccgcgtcactgtgcatatccagcgcaaaatactggttctccagccgcagcggcagcgccgccggaaccgaggtaagcggcaccagttgaacaccgttcagcgccacgttgataagcagcgtgacatcatcgggcgcaccgattttgcagaccagcggtagctgatgcagtacctgatgcgcaggcagtgaggaacgaacggacagataaaaatcggcctcttcccgcagtcgcggatcgtgcaggtcggctttccagcggttgcccggcagggacgccagatccagcgcgatcacccgcgacggcaggctggcttccagcagctcgctgagcagggagaacaggggcggaaagacggtggacggcgattcgtggacatagggcggaacggcgctgacgttatgctcaagggaaaacgtcagcagcgcaccggcaagcctcgccagctcccgccagaccagttcggggtggacagccgggtagcgcaggaaatcgctcagcaccggctcggcggaattcagcgcgttaagcagccagaacagggagacatcggcgacggcaaagtccgccatacgctggttgctttcccggcgcatcgccatcagacgctggcacttcgcccgtagctgcaacagcaatgtgtccagacgctgtaccagcccgtcatgggcgttaaacgccagtaacggcggaatatagctctcatcctgtgtccagttgccctgaacatcccgcaccagacgcgccagtgggcaggtgatgtaatcctgattgttatcatgagcaaagcgcagggacagcgcatgacgctcaacggccatatcttcactgtcactgccgtagatatcctgcaccttttgccattcctgacgatagcgcagcggtctttcagtctgctcaccctgaccgagattaccgccgttaccatgtgcaagcggcagcgccagcaaaacaatcgcgctgtcgttcttcagcgcgcgcagatcgcaggcgagcggcagaacgtcactcacgtctgaatcgatcagcgtgccatcagcaaaacgcaggcgtactgcctgcgttttcagctttccgggcgtcagggcatcccggtcaaagagcacgtttgcgatcccccacggatggcgaatacaaagctgcgcaatacagtcattgctgaacgcttcccagcgggcctgctgctgaaactgctgagaggacaggaatgtcccctcagcccacagtggtcgatgaattttcatatcacaccacggcccggtcaggctttcgctttcggcatctgggaaaccagagaaaggttgatatccatcccttcaatctggaaatgcggcacggcaaagagtctgacgcggaagaagcccggattgtcctcaatatcttccacgataaccttgccgtcgcgcagcgggtgagacgcctgcagttcatcacccggatcggtcatctccgtcaccagtgtgcggatccaggtgttcagttccagttccagtacgcggcggtctttggtggtaccgatattctcgcgctgaatgattttcaggtaatgcgcaatgcgggacagcaggaagatgtaaggcagacgggcgttaatacggctgttggcggtggcgtcagcggtatcatacaacgccggtttctgggcggagtttgccgagaagaagcaggcgtaatcgcgattcttataataagagagcggaataaagccaaggttggcaaattcaaattcgcgggtttccgggatcatcacttcggacggaattttgacctgattgccggtgccgagatcgtaaagatggatgggcagatcggctactgcgccacctgcctgtggaccacggatctgcacacaccagccattattcacaaagctcttcaccatattggcggcaaaggcgaacgaggcgtttgtccacaggtacttttcgtgatccgggcctttgacttcttccacatagttaaagctgcgtaccggcaccgtgtccggcccatagggcagacggcccagcactcgcggcatcactaatcccacatagcggctgtcatccgtatcgcggaacgacttccatttaatatattctgcgcggtcaaagtagttgccgatatctttaatcgcggcgacttcttccatcgaatttttaaggaagaatttcggtccgacggaaccgataaaaggcatatgggaagcggcagacactctggaaatattgcgcagcagggcaatatcctgcgggctgttatcaaattcatagctggaaattaatgaggcaacaggttcgccacccggcgtatcgtactcctgaatgtatgtatgacgatataaaccgctctgaatgatttccggggagtcgtcgaaatcctgacgcagatgctctttgctgatatccagcaattcaattctgacatttttgcgaaaatcagtgcgctgtacgacgaaccatgtaccacgccacagcgactcgactttctggaattcagggtggtgcatgaccgcatcaagctgtttactgattttctgatccagatcgtcgatatgaaaatccagcaggctcttgtcgagcttaaccacgtcctcgcctgatttcgccagacaggaaagcagaacgtgaatcgctgctgtcacgcgctcatcgggtgaggcatcagccagcgtttcgctgttttgccataaatctatttcctgaatggaagagaccggggttaaattaattttatcgaacagggactgataaacgccgccggactcagtggtggtgagtgttgcagtttcagaggtggaatgttcttgttgtacagacatcagcatttccttttcagtgatcctttcttctccggtttaacctgaatacgtgttcgggttaaacgttctcctgcggcgcaattttcgccagttcatcacgcagttctgaactgagcgtcgggtctttcagaatattttccagttcacggcgaaacgttgcgttatccagcagattggatttcaggtcacgtagtaaattgcgcatagcgagtaatacacgaagttgcggaatattttttgctacctgttcgggttcaaaatccttcaggcttttaaattcaagcgcgatattttgttcattaccgtttccgtttagcgtatcttctactgttaaattaaccgcaggcgaaaactcagccatgacgctgttgaagttgtttttattgatatcaaccttgtcccgttcggacagcggacgttgctcttttccgttactgtaatcgcctacggcaagaagcttgagggggagttcaactttctttttagcattgcctgtatgcagatcaagcttgatatttacacgagcggtgggaacttcattctggaaactgtcagccatatccttttcctcatcatccactttttctgatggttattgacataattatattcaggggattatcggatgatttaaataaaaagcaatgatgaggaaaatatacaaatgaataatgtatttttcaggggaatagatacagttgtatcattttagatattgtttggcctcttgattatttttcggaagagggcggcattatctggtgagagaatttggcatgaaacttaaaataataacaggataagcttcacaaatttgcacttttaagaaattgggtagtatgagagtctattaagatattcattaaacttattgtccgggctttcacaaaaaattattaatttttctactaattaaaaagttgtgtgctttttgtacaatgattatataagcgtagcgccctgttgtgatattgaaatgttaacataaccaaaataaattgatttatagaatatataaatgaaattcattaatggggtatatgtttaatatataaataagatggatggctttgatggagggatattaacggtttactcattgtctcaggcttcactgaaacgggtaaggaagcgtaaaaacgaaaaaaccgcaagccaatagcagctttgcggtttgtcagcattctaataaattggttgcgggggccggatttgaaccgacgaccttcgggttatgagcccgacgagctaccaggctgctccaccccgcgtcaccgtactgctttatttcatcaaattttgattggttgcgggggccggatttgaaccgacgaccttcgggttatgagcccgacgagctaccaggctgctccaccccgcgtcaccgtactgctttacttcatcaaattttaattggttgcgggggccggatttgaaccgacgaccttcgggttatgagcccgacgagctaccaggctgctccaccccgcgtccgtggatgcgcactatactctgctcgcgttttcatgcaaccttttttttaccccgatcacggattcggcatgattttgaacaaaaacaaatcactaaagcctattttttgtgcaaaatttgcgtcagggagaggctgctcatttcattaaacgcggtggtttgttatcttcgttgcgccttattttttaacctgaagaagagaacaatgaaaggacgttgggtaaagtaccttcttatgggcacggttgtggcaatgcttgccgcctgctcttccaaaccaaccgatcgcggacagcaatataaagacgggaaatttacccagcctttctctctggtgaaccagccagatgccgttggcgcgccgattaatgccggtgattttgccgggcaaattaaccatatccgtaattcgtcaccgcgtctgtatggcaaccagagtaatgtttataacgcggtgcaagagtggctgcgcgcaggcggtgatacccgcaatatgcgccagttcggcattgatgcctggcagatggaaggtgtcgacaactatggtaacgtgcagtttacaggctattacacgccggtaattcaggcgcgccatacccgtcagggcgagttccagtatccgatttaccgtatgccgccaaaacgtggtcgtctgccgtctcgtgcggagatctacgcaggagcgctgagtgataaatatattctcgcttacagtaactccctgatggataacttcattatggatgtgcagggtagcgggtatatcgactttggtgatggcagtccgcttaactttttcagctatgcagggaaaaacggtcatgcctatcgcagcattggtaaggtgttgatcgaccgtggcgaagtgaaaaaagaagatatgtcgatgcaggcgattcgtcactggggcgaaacacacagtgaagctgaggttcgcgagctgctggaacagaacccgtctttcgtcttctttaaaccgcaatcttttgcaccggtgaaaggggcaagtgcggtgccgctggttggccgtgcttctgttgcctccgatcgttcaattattccgccaggtactaccttgctggcagaagtgccgctgctggataataacggcaaatttaacggtcagtacgaattgcgtctgatggtggcgctggatgtcggtggcgcaatcaaaggccaacacttcgatatctatcaagggatcgggccggaagccggacaccgcgcaggttggtacaaccactatggacgtgtctgggtgctgaaaaccgccccgggcgcaggtaacgtctttagcggctgatgtgatattctgtatgccgtttttacggatatgacagggtgaggggtaacctcaccctttttaattctgaggtgctatgtctgtggtaattagtgatgcatggcgtcagcgttttggtggcacagcgcgactgtatggtgaaaaagcattgcaactgtttgctgacgcgcatatttgtgtggttggtatcggtggtgtcggttcctgggcggcggaagcgctagcgcgcacggggattggcgcaatcacgcttatcgatatggatgatgtgtgcgtcaccaataccaatcggcaaattcacgctctgcgcgataacgtcgggctggcaaaagcggaagtcatggcggagcgtattcgccagattaacccggagtgccgtgtaacggtggtggatgacttcgtgacgccggataacgtagcgcaatatatgaatgccggttattcgtacgtgattgatgctattgatagtgtacggcccaaagcggcgctgattgcttattgtcggcgcaataaaatcccgctggtcacgaccggtggcgcgggtgggcagattgacccgacgcagattcaggttaccgatctggcgaaaacgattcaggacccgttggcggcgaagttgcgcgagcgcctgaaaagcgattttggcgtagtgaaaaacagtaaaggtaagctcggcgtggattgcgtgttctctaccgaagcgctggtgtacccgcagtcagacggcaccgtctgtgcgatgaaagccacggcggaagggccaaagcggatggattgtgcctcaggatttggcgcggcgacgatggtgaccgccacttttggctttgttgcggtttctcatgcgctgaagaagatgatggcgaaagcggcgcgtcaggggtaaacaatcaggtcggatgcgacgcgaacgtcttatccgacctggttctgtgcttaaacctgcttcgccgcagcgataatcgcctcgcttaacgcattcaacccctggctgcgtgaggcgctaagttgcgcacgtaatcccagctcatcaaacaatgccagcggcgactgtgcctgcaattcggcggcggttttcccctcaacggcagtcaacaacaccgccaacaggccgcgcacaatgcgcccttcgctgtcgccaaagaaatgcatcttgccgttttcagccacggtatatcccagccagacgcggttttcgcatccggcaatctctttagcctgcgcttttaactcctctggcaaagccggaagctgttttcccagcatgatcaactggcgatatttatcttcccattgcgtcaacggtgcgaaggtattgcgtaacgtttctgcggttacggttgtgccgaacggatgtccggcgaattgcgggtttgtcattaatccaccaataattccagcgcgcggtcaacggcattcaccagcgcatccacatcactctttgtattatatggcgcaaatgaggcgcgcagtgtgccggttacgcctaattctgccagtagcggctgagcgcaatgctgcccggcgcgcagggcaataccgtactccgccagcagtgtcaccatatcgctgtgatgaacacccgcaaaatcaaaggccagcaggctggaatccaggcagcggaatgaacgaaagcctggacgtttcgccagcgcttcttctgcaagcgttgctaagctacggctccagctttcggcctggttgatatcgtaatctgtcagccattccagcgccgcgcttaatcctatgacgccagcgacatttggcgttcctgcttccagtttccacggcgcagattgagtcgtgaagtcgtcaaaactcacttcgtgaaccattttgccgccgcccagccagggcgacatcgcttccagcagttctggtttgccatacagcacgccgatgcctgtcggaccatacagtttgtgacctgaaaaagcatagaaatcaatatccagttgctgaacatccgcggggaaatgcaccgccccctgagcaccatcaaccatcaccactatcccggctgaatgagcaaaagtaatcgctctcgccagatccgggcaaccgccagtgacgttcgacatctggcccaacgccagaatccgactacggggagtaatcagttctggcaacaaatcgacatccggcagtcgctgcgcattaagcggcaatttcaccactttggcccccgtttgttgggcgaccatcagccaggggacgaggttggcgtggtgttctgccacactgacaataatttcatcgcccggttgcagacgcggacgggcatagcattgcgccaccatgttgatggattcagtggtgccgcgcgtccagacgatatttttgtcatccgatgcattcagtaattgtgccactttttcccgcgcagcttcgtaacgcgcggtcaggcgttgggcttcggcaaactggctgcgatggacgtttccggcgctcaggctataaaactgtcgggtagcttcaaccacggcttcaggtttaagcgcggtcgcggcgctgtcgagatagacgcccgcatcctgtagcgcgggaaactgggcgcgaaactgcgcgggattaaaaacgttcatggtactcctcggcttgatgcaccgatcgtgacgcaaaattcactttgatacaaggagagtgctaaccatcagaattatctggatatcctggcgaagccgcgtcagtaacatatgctgaatagtgttaggcgttaattttagcctgttaatcaatactattaagatttattaatcgctttaaggagaagatgatgaaaaagactgccgcaattatttctgcctgtatgctgacttttgccctgagcgcctgttccggttcgaactatgtgatgcacaccaatgacggacgtaccatcgtctctgacggcaaaccacagactgataacgataccggtatgatttcgtataaagacgctaatggcaacaaacagcagatcaaccgtactgacgtgaaagagatggtcgaactggatcagtaattcgcgatcgcaaggtaaaaaaaagcaccgcaattaggcggtgctacattaatcactatggacagacagggtaaatgtacaggaagtgaaaaaaggtagctttgctaccatggtctgaatcgcagaccaattgcaaacacaacaacacaacatcacaaccgtaagccaaaagttcaccagaacacgcattccgataaaacttttcgttccggctcaggaagtgccgccactataggtatttgctggtagaagctcaacggacaatttataatggctcagattaaaaaaactaataggttacacagtgtgatctaattgttaaattcatttaacatcaaagtttaaaagccatgtctaaacgattaccaccgctaaatgccttacgagtttttgatgccgcagcacgccatttaagtttcactcgcgcagcagaagagctttttgtgacccaggccgcagtaagtcatcaaatcaagtctcttgaggattttctggggctaaaactgttccgccgccgtaatcgttcactcctgctgaccgaggaagggcaaagctatttcctcgatatcaaagagatattttcgcaattaaccgaagcgacgcgtaaactccaggcccgtagcgctaagggggcgttgacggtcagtttactccccagtttcgcgattcattggttggttccgcgactttccagctttaattcagcttatccgggaattgacgttcgaatccaggcggttgatcgtcaggaagataagctggcggatgatgttgatgtggcgatattttatggtcggggcaactggccggggctacgggtggaaaaactgtacgccgaatatttattgccggtgtgctcgccgctactgctgactggcgaaaaacccttgaagaccccggaagatctggctaaacatacgttattacatgatgcatcacgccgtgactggcagacatatacccgacagttggggttaaatcatatcaacgttcagcaagggccaatttttagccatagcgccatggtgctgcaagcggctatcca

SEQ ID NO: 10019 - DNA, 59250 bp, Escherichia coli
tccatctccgcaccgctataggtaacgtcgaggatctcttccgcttcttcctgttctgggttgttggcggtgattttcagctggttttcgctgacatacagacgcacgccgcggaatttctcgttagagagaattgccgcacgagcaaacgcctgcttgagcagatcacagccagcttccagatgtttgtccgggttcttcggcagaacgcgacggtaatccgggaagcgaccatccaccagtttcgaggtgaaaataaagtcgccaacgtgggcgcgaatgttgttgctgccaatctgcacgcgcagcggattgtcgccgccgtcgagcatacgcatcagttcaatcacgcctttacgcggcacgatcaccgaatggcttggcaaagattgaccaattggcattgaacagactgccagacggtggccgtcggtcgccacggtgcgcagttcttcaccttcggtttcaaacagcataccgtttaagtaatagcgaacgtcctgatgcgccatagaaaactgggtcgcttcaatcagacgcttcatcgtcgcctgcggcagggtaaattcgacttcgctctgccagtcatcgaggttcgggaaatctgccgctggcagggtagacagcgaaaaacggctacgcccggagcgcaccagcatccgctcaccttccagctgcacggcaatttccgcgccttcaggcagaccacggcagatatcaaagaatttgcgcgccggaacggtcgtcgcccctggttcgtgcggctgaaccagcgcaacgcgtgccaccatttccatctcgagatcagtaccggtcagcgacaacgtaccgtcagcaacctgtaacagcagattaccgagaatcggtagcgtaggacgaccacctaacggaccgctcacctgttgtagcggttttaataaatgctcacgttctacggtaaatttcataggtttacgatgacaatgttctgattaaattagaaaaatcttctttgatatcgtggctctcttcacgcaactgctcgatcttccggcaggcatgaagcaccgtcgtgtggtcacgaccaccaaaggcatcgccaatctccggaagactgtggttagtcagctctttcgccagcgccatcgccatctggcgcggacgggccaccgagcgggatcgacgcttggaaaggagatccgcgactttgatcttgtagtactccgccaccgtcttctgaatattgtcgatggtgaccagtttttcctgcaatgccagcaagtcacgcagcgcctcacgcacgaagtcgatggtgatcgcccgtccggtaaagttggcgttggcaatgacgcggttcagcgcgccttccaactcacgtacgttagatcgtagacgcttggcgataaagaacgccacttcgcccggcaaacgaatgtcgttttcgtcggcctttttcatcaggatcgccacgcgggtttccagctctggcggttcgatcgccacagtcagtccccagccgaagcgggatttcaaacgatcctcaacgccgttgatctctttcggatagcgatcggaggtgagaatgatctgttgattaccttccagcagggcgttgaaggtgtggaaaaactcttcctgagatcgttctttattagcaaaaaactgaatatcgtcgatcagcagtgcatctacggaacggtagtagcgtttaaactcttcgatcgcgttgttttgcagggctttaaccatgtcctgaacaaagcgctcggagtgcatataaaccactttggcattcggcttgcgcgccataatgccgttacccaccgcatgcagcaggtgagttttacccaaacccgtgccgccataaaggaacaacgggttataagcaccgccagggttatctgccacctggcgagccgccgcgcgcgccagttggttagatttaccttcaacgaagttatcaaacgtgtgtttgacgtttacgttagaacgataggtcggttctgccggagccgggacgttatcccaacccgagcgcgtagaaggcgcagcacgttgcggctgcgtttgcgccacctgtgcaggggccgcgacgttgctcgtcactgccgcttgtggcgtttgcgtcaccggtttggtgccgacttcaaaacgcagctgtggggcatccgctccgcagaaactggttagcagtccattgatattattaaggtacttgtcccgtacccaatcgaggacaaaacggtttggcgcgtacagggccagcgtgttatcgctcagttccgcctgcaatgggcgtatccacatactgaattctgtggctggtaactcatcctgcaatcgggcaagacactgctgccaaagcgaaagtgacacggcggactccactcgaacaaaagtcgataatgactaaggctgaaacattcatgattgttgacgtacgtcgaaaagaccctgcatgagggtgacgcacgaaccgctgtctgcggttatatgcccgatcaagatcctgcaaaacgatcgggaccgcggatcatagcctaaactgcgcaagagatcttctgtttctcacagattttcccgatttatccacaggatgatccagaactcgctaagtgtaaacgatcctgccgcgggccgggcacgatttacgccgcatattggaaaatttaatgaccatagacaaaaattggcttaatcgatctaataaagatccagaacgatccttgcgctttacccgtcagcccgtataatcctccacccggcgcgccatgctggtttacactggtgtgaggccgtacgttttccccgcgaaaaggtgcggaaaagcgcggtaaataaggaaagagaattgactccggagtgtacaattattacaatccggcctctttaatcacccatggcttcggtgtccatcgtttcatttttcggcggatatccaataaagccattgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaataaagctaacccctgagtggttaagctcgcatttcccagggagttacgcttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctgatagccctcattcgggtctatcaacgcctgattagtccgctactcgggccgcattgtcgtttcactccaacctgttcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaacgatggattcgcaacgcaatcttttagtcatcgctttgctgttcgtgtctttcatgatctggcaagcctgggagcaggataaaaacccgcaacctcaggcccaacagaccacgcagacaacgaccaccgcagcgggtagcgccgccgaccagggcgtaccggccagtggccaggggaaactgatctcggttaagaccgacgtgcttgatctgaccatcaacacccgcggtggtgatgttgagcaagccctgctgcctgcttacccgaaagagctgaactctacccagccgttccagctgctggaaacttcaccgcagtttatttatcaggcacagagcggtctgaccggtcgtgatggcccggataacccggctaacggcccgcgtccgctgtataacgttgaaaaagacgcttatgtgctggctgaaggtcaaaacgaactgcaggtgccgatgacgtataccgacgcggcaggcaacacgtttaccaaaacgtttgtcctgaaacgtggtgattacgctgtcaacgtcaactacaacgtgcagaacgctggcgagaaaccgctggaaatctccacctttggtcagttgaagcaatccatcactctgccaccgcatctcgataccggaagcagcaacttcgcactgcacaccttccgtggtgcggcgtactccacgcctgacgagaagtacgagaaatacaagttcgataccattgccgataacgaaaacctgaacatctcttcgaaaggtggttgggtggcaatgctgcaacagtatttcgcgacggcgtggatcccgcataacgacggtaccaacaacttctataccgctaatctgggtaacggcatcgccgctatcggctataaatctcagccggtactggttcagcctggtcagactggcgcgatgaacagcaccctgtgggttggcccggaaattcaggacaaaatggcagctgttgctccgcacctggatctgaccgttgattacggttggttgtggttcatttctcagccgctgttcaaactgctgaaatggatccatagctttgtgggtaactggggcttctccattatcatcatcacctttatcgttcgtggcatcatgtacccgctgaccaaagcgcagtacacctccatggcgaagatgcgtatgctgcagccgaagattcaggcaatgcgtgagcgtctgggcgatgacaaacagcgcataagccaggaaatgatggcgctgtacaaagctgagaaggttaacccgctgggcggctgcttcccgctgctgatccagatgccaatcttcctggcgttgtactacatgctgatgggttccgttgaactacgtcaggcaccgtttgcactgtggatccacgacctgtctgcacaggacccgtactacatcctgccgatcctgatgggcgtaacgatgttcttcattcagaagatgtcgccgaccactgtgaccgacccgatgcagcagaagatcatgacctttatgccggtcatcttcactgtgttcttcctgtggttcccgtcaggtctggtgctgtactatatcgtcagcaacctggtaaccattattcagcagcagctgatttaccgtggtctggaaaaacgtggcctgcatagccgcgagaagaaaaaatcctgattcggtgagttttcgctaaaataagggcggtcagttgaccgccttttttcttttcgtagggcggataagcaccgcacatccgccacacaaagcaacaggaacatcatgagcgataatgacactatcgtagcccaggccacgcctccgggacgtggcggcgttggcatcctgcgcatctccggcctcaaagcccgtgaagttgccgaaaccgtgctgggtaaactgcctaagccacgctacgccgattatcttccgtttaaagacgccgatggcagcgtgctcgatcaggggattgcgctatggttccctggcccgaactcgttcaccggcgaagatgtgctggaactgcaaggtcatggcggtccggtgatcctcgacctgctgttaaaacgcattctgaccattcccggcctgcggattgcccgccctggtgagttttccgaacgcgcatttctgaacgataaactcgacttagcccaggccgaggcgattgcggatcttatcgacgccagctcggaacaggcggcccgttcggcgctaaactcgctgcaaggcgcgttctccgcacgggtcaaccatctggtggaagccctcacccacttgcgcatttacgtcgaagcggcaattgatttcccggatgaagagatcgatttcctctccgacggcaaaattgaagcccagctcaataacgtaattgccgatctcgacgcggtacgcgccgaagctcgtcagggtagtttgttgcgcgaagggatgaaagtggtgattgccggacgtcctaacgccggtaaatcgagcctgctgaacgcgctggcgggccgtgaagcagcaatcgtaaccgatatcgccggaaccacgcgtgacgtgctgcgtgagcatatccacattgacggaatgccgttgcatatcatcgataccgccgggctacgtgaagccagtgacgaagttgaacgtattggtatcgagcgcgcatggcaggaaattgaacaggcagaccgcgtgctgtttatggtcgatggcaccacgacagacgccgttgatccggcagagatctggccggaattcatcgcccgtctgccagcgaaactgccgatcaccgtggtgcgcaataaagccgatatcaccggcgaaacgttggggatgagcgaagtgaacggtcatgcgttaattcgtctttcggcgcggactggcgaaggcgtggatgtactgcgtaaccatctcaaacagagcatgggctttgacaccaatatggaaggcggcttcctggcgcgtcgtcgtcacctacaggcgctggaacaggcggcagagcatttgcagcaaggtaaagcgcaactgttaggtgcctgggcgggtgaactgctggcggaagagttgcgcctggcgcagcagaacttaagcgagatcaccggggaatttacttcagacgacctactggggcggattttctccagcttctgtatcggtaagtaaccgcgcttgcgaagccgcattctgactgtcagatgcggcttcgcttcattgttagcactcctgttattcctcaacccttttttaaacattaaaattcttacgtaatttataatctttaaaaaagatatttaatattgcgtcccgaacgattgtgattcgattcacatttaaacaatttcagaatagacaaattccttgagtattatactgtagcctcgtgtctttcgaggataagtgcattatgaatatcttacatatatgtgtgacctcaaaatggtttaatattgacaacaagattgtcgatcaccgcccttgatttgcccttctgtagccatcaccagagccaaaccgattagattcaatgtgatctatttgtttgctatatcttaattttgccttttacaaaggccatctctcgtttatttgcttgttttagtaaatgatggtacttgcatatatatctggcgaattaatgaatattgcaaatgtaatattcacagggatcactgtaattaaaataaatgaaggattatgtaatggaaaactttaaacatctccctgaaccgttccgcattcgtgttattgagccagtaaaacgtaccactcgcgcttatcgtgaagaggcaattattaaatccggtatgaacccgttcttgctggatagcgaagatgtgtttatcgatttactgaccgacagcggcaccggggcggtgacgcagagtatgcaggccgcgatgatgcgtggcgacgaagcctacagcggcagccgcagctactacgcgttagccgagtcagtgaaaaatatctttggttatcaatacactattccgactcaccagggccgtggtgcagagcaaatctatattccggtactgattaaaaaacgcgagcaggaaaaaggcctggatcgcagcaaaatggtggcgttctctaactatttctttgataccacgcagggccatagccagattaacggctgtaccgtgcgtaacgtctatatcaaagaagccttcgatactggcgtgcgttacgactttaaaggcaactttgaccttgagggattagaacgcggtattgaagaagttggcccgaataacgtgccgtatatcgttgcaaccatcaccagtaactccgcaggtggtcagccggtttcactggcaaacttaaaagcgatgtacagcatcgcgaagaaatacgatattccggtggtcatggactccgcacgctttgccgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcggcctgctgtgcatgaaagacgacagcttctttgatgtgtataccgaatgcagaaccctttgcgtggtgcaggaaggcttcccgacatatggcggcctggaaggcggcgctatggagcgtctggcggtaggtctgtatgacggcatgaatctggactggctggcttatcgtatcgcgcaggtgcagtatctggtcgatggtctggaagagattggcgttgtctgtcagcaggcgggcggtcacgcggcattcgttgatgcaggtaaactgttgccgcatatcccggcagatcagttcccggcacaggcgctggcctgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaagggttaacctttacctacgaaccgaaagtattgcgtcacttcaccgcaaaactgaaagaagtttaattaaaacactcagagtggctataaggatgttagccactctattaccctacatcctcaataacaaaaatagccttcctctaaaggtggcatcatgactgatcaatcagaaaaaaaacactctgcattttggggtgttatggttatagccggtacagtaattggcggtgggatgtttgctttacctgttgaccttgccggagcctggtttttttggggcgcttttattcttattatcgcctggttttcaatgttacattcagggctattattattagaagcaaacttaaattatcccgtcggatccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggctatcacgctaatccacgtattgtcgggatctgcactgccattttcgttgccagcgtattgtggataagttcgttagccgccagtcgtattacctcattgttccttgggctgaagattatctcctttgtaattgtttttggttctttcttcttccaggtcgattactccattctgcgcgattccaccagcaccactgcggggacgtcttacttcccgtatatctttatggctttgccggtgtgtctggcgtcatttggtttccacggcaatattcccagcctgattatttgctatggaaaacgcaaagacaaactaatcaaaagcgtggttttcggttcgctgctggcgctggtgatttatctcttctggctctattgcacgatggggaatatcccgcgagaaagctttaaggcgataatctcctcaggcggcaacgttgattcgctggtgaaatcgttcctcggcaccaaacagcacgggattatcgagttttgcctgctggtgttctccaacttagctgttgccagctcgttttttggtgtcacgctgggattgttcgattatctggcggatctgtttaagattgataactcccacgccgggcgtttcaaaaccgtgctgttaaccttcctgccacctgctttgttgtatctgatcttcccgaacggcttcatttacgggatcggcggtgccggactgtgtgccaccatctgggcggtaataattcctgctgtactggcaatcaaagcccgcaagaagtttcccaatcagatgttcacggtctggggcggcaatcttattccggcgattgtcattctctttggcataaccgtaattttatgctggttcggtaacgtctttaacgtgttacctaaatttggctaaatccttcaggaagccagccattcgctggcttcttgcctgtcaggaaatcacttatgtccaaatggcaactcgcctgattctccttcaccacgtatgctttgcgtcaccttactatcaggacgctttagcccatgtcccgctttttgatttgtagttttgccctggttttactttatcccgcagggattgatatgtacctcgttggtttaccgcgcatcgccgccgatctcaatgccagcgaagcgcagttgcatattgcgttctccgtttatctggcggggatggcggctgcgatgttatttgccggtaaagtggccgatcgttcagggagaaagcctgtcgccatacccggcgcggcgctatttattatcgcctcggtgttctgttcactggctgaaaccagcgcgttatttcttgcagggcgatttctacagggactgggcgcgggctgttgttacgtagtggcgttcgccattttgcgcgacacgctggatgatcgacgtcgggctaaagtgctgtcgttactcaacggcattacctgcatcattccggtgttagcgccggtgctcggacacctgattatgcttaaattcccttggcagagtctgttctggacgatggcaacgatgggcatcgcgttactgatgttgtctttgtttattttaaaagaaacgcgccctgcggcccccacaacttcggacaaaccacgagaaaatagcgagtcactgcttaatcggtttttcctcagccgtgttgttatcaccaccctcagcgtttcggtgatcctcaccttcgtcaacacgtcgccagtattgctgatggaaatcatgggttttgagcgcggagaatacgccaccattatggcgttgaccgctggcgtcagcatgaccgtttcattctccacgccgtttgcgctgggaatttttaagccacgtacgttgatgatcacctcacaggtgttattcctggcggcggggatcacccttgccgtttcaccttcccatgcggtttcgctgtttggtatcacgctgatttgcgccggtttctcggtaggttttggtgtggcgatgagtcaggcgttagggccgttttcattacgcgcgggcgtagccagctcgaccttaggtattgcgcaagtttgcggttcgtcactgtggatttggctggcggcggtggttggtatcggcgcatggaatatgctgatcgggattctgattgcctgtagcatagtgagcctgttgctgattatgttcgtcgcgcctggacgccccgttgccgctcatgaagaaatccatcaccacgcttgatctcaatctgctgctctgtctgcaactgctgatgcaggagcgcagcgtgaccaaagcggcgaagcggatgaacgtgaccccttcggcggtgagtaagtcgctggcaaagttaagagcgtggtttgacgacccgctctttgtgaactcaccgctgggcctgtctcccacaccgctaatggtcagcatggagcaaaatctggcggaatggatgcaaatgagcaatcagttgctggacaaaccactccacgaaacgccgcgcggtcttaagttcgaactggcggcggaatcgccgctgatgatgatcatgcttaatgcgctgtcgaaacggatctaccaacgatacccgcaggcgaccatcaaattacgtaactgggattacgattccttagatgccattactcgtggtgaagtggatattggtttttccggtcgcgaaagtcatccccgttcgcgggagctgttaagctcgctaccgttagccattgattatgaagtgctgtttagtgatgtgccctgcgtctggttacgcaaagatcatccggcactgcatgaagcatggaatctggacacctttttacgttatccgcatatcagcatttgctgggaacagagcgatacctgggcgctggacaatgtgttacaggagctggggcgcgaacgcacgattgctatgagcctgccggaattcgagcagtcactgtttatggcagcacagcccgacaatctgctactggcgaccgcgccgcgctactgccagtactacaatcaactccaccaactgccgttggttgctcttcctctcccgtttgatgaaagccagcaaaaaaagctggaagtcccttttacccttctgtggcataaacggaacagccgtaatccgaagatcgtctggttacgggaaaccattaaaaatctttacgcgtcgatggcataaccgaatcgtatgaaacgcgacccaatttcacaatgaaatgtaaaaaagttgtaataaacttatctgaatagaacttttagccgctttagtctgtccatcattccagtaaatgattactcttgtattcataatggaccattaagcatggagcgaaaaatggcgactcactttgcccgagggattttaacggaaggacatctgatttctgttcgtctcccctccctgtgtcatcaagaagcccgaaacattccccctcatcgtcaaagccgttttctggcgtccagaggtttactcgcagaactgatgttcatgctgtatggcattggcgaattgccggaaatcgtcaccctgccgaaaggaaaaccggttttcagcgataaaaatttgccttcgttttctgtttcctatgccgggaatatggtcggcgtggcgttaacaaccgaaggtgaatgtggcctcgatatggaactacagcgtgcgacacgcgggtttcatagcccacacgcgcccgataaccacaccttttccagcaatgaatcgctatggatcagtaaacaaaacgatcctaacgaagcgcgggcgcagctcatcacgctgcgccgaagcgtgctaaaactaaccggtgatgttttgaatgacgatccgcgcgatctgcaactactgcccattgccggacgcctgaaatgtgctcatgtaaatcatgtagaagcgttatgcgacgcggaggacgtgctggtgtggtccgtggcggtcacgcccacgattgaaaagctcagtgtctgggagttagatggcaaacatggctggaaaagcctgcccgatattcacagccgcgccaacaatcctaccagccggatgatgcgttttgcccagctctctaccgtgaaggctttttcgccaaattgatagacaaccacaggagtcatcatgtctgaaaaattgcaggtggttacgttactggggagcctgcgcaaaggctcatttaatggcatggttgcacgtaccctgccgaaaattgctccggcgagcatggaaatcaatgcgttaccttccattgccgacattcccctgtatgacgctgacgtacagcaggaagacggttttccagcaacagttgaagctctggcggaacagatccgtcaggctgacggtgtggtaatcgtcacgccggaatataactactcggtaccgggtgggctgaaaaatgccatcgactggctttcccgcctgccggatcaaccgctggcaggtaaaccggtattgattcagaccagctcaatgggcgtgattggcggcgcgcgctgtcagtatcacctgcgccagattctggttttcctcgatacaatggtgatgaacaagccagaatttatgggcggcgtgattcagaacaaagttgatccgcaaaccggggaagtgattgatcagggtacgctggaccacctgaccgggcaattgaccgcatttggtgagtttattcagcgagttaagatctaaataaaaacccgccagcaatcatgcatggcgggtttttaacgcgctatcgattttagtgagcgtcgataaagacaatcttcaggataaacagcagcgcaacgatgattacgcacgggctaaggtcacgcagacgtccggtaccaatcttcatcacgcagtaggagataaagcccagcgcgataccttcagtaatcgagaagctgaacggcatcatcacagcggtaataaacgccggaacagattcagtaagatcctgccagttcacgcgagcaagacttgaggtcatcaacacgccaacgtaaatcagcgcaccagctgcagcgtagcctggcaccatccccgccagcggcgacaggaagataaccagcaggaacagcagaccaacaaccactgccgtcagaccggtacgaccgccaacggaaacgccggaagaagactcgatatacgccgtaacagaagaagtcccgataaacgaaccggtcacggaagagatgctgtcgacatacagtgcctgcttcatgcgcgggaatttacctttttcatccgccagtcctgctttatcggtcacgccaatcagtgtaccggaggagtcaaacaggttgaccagcatgaaagagaaaatcacccctgccagcccgaggttaaacgacccggctaaatctacatgacccacgacagtcattacgctcggcggcgcagaaacgatgccattgtagtggacatcacccagcatccagcccagcagcgtcgtcaccacgatggaaaccagcaccgccgcgtgaatgttgcgtgaggccagaatagcaatgatgaagaagccgaggatccccagcagtacgctgtgagaagtcagattaccgatgctcaccagcgtttccgggttagcgacaatcacacctgcattcttcagtcccatcatgccaataaacaggccgataccgctggtaatgcccacacgcagactcaccggaatgttggctatcatccagtagcgaacgcggaaaatcgtcagtaacagcagaccaatcgcgccccagaagattgcgcccatcccgacctgccacggcaagcccatcgcctgcacaaccacaaaagcgaagaacgcattcaggcccattgccggtgccagtgcaactggcaggttagcaaacagccccatcataatactgccgaatgcagcaatcagacaggtcgtgacgaagacggcgctggtatccatgccagcaacgccaagaatttgcgggttaacaaaaacgatgtaaaccatcgtcaggaaggtggtaaaaccggcgatcacttcggtccgtgccgtcgtgccatgttcgcgcagtttaaacacgcgttccagcatcccctggccagaagcctgggttgtgtgttgttgactcattatctatttccgaacaaggagggaaaatccgtcgctatcgtataccaaaatgagacaatatggacggctgaatataactttttttcattgtatttgcttatacggcaacgattgcgtcatgcgaattggcatgacgaaaacgttaaactaacgataaaggaaagacatgtcccagatagaagcggtatttttcgactgcgacggtacgctggtcgatagcgaggtcatttgctctcgcgcctatgtcacgatgttcagggaatttggcattcacgttgacctggaagagatttttacccgttttaaaggcgtaaaactctacgaaatcatcgacatcatcagtaaagaacagggcgtgacgatggtccaggccgatgccgagcacgtttaccgcgcagaagtagcacgtctgtttgataccgaacttgaggacatcgcaggagcgaacgaattgctggcaagcattaacgtgccgatgtgcgtcgtctctaacggtccggtcagcaaaatgcagcattcgcttggtaagctcaacatgctgcactacttcccggaaaaactgttcagcggctatgatatccagcgttggaagcccgatccggcattaatgttccatgcggcaaaagcgatgaatgtgaacgttgaaaactgcattctggtcgatgactccagcgcaggtgcgcaatcagggatagatgccggaatggaagtgttttacttctgcgctgacccgcacaataaaccgatcgttcacccgaaagtcaccacctttacccatctttcgcaattaccggaactgtggaaggcgcgtggttgggatattacggcatagttattcacactcccttcacttactccacttaaattggcacgcaaaggtaagtaaagggagtttgatatgtctgtttcacgtcgggtaattcatcacggactgtattttgcggttttagggccgttaattggtgttctgtttcttgtcctctacatattcttcgcaaaagaaccgctgattcttttggtaataatacaggtacttccattgtttctcttaatgtcgataactacgggagctattcctgcaatgttaactggcgtaatggtcgcctgtctgccggaaaagatcgggtcacagaaacgttatcgttgtctggttggcggcataggtggagtcgttatcaccgagatctattgcgctgttatcgtacatattaaggacatggcttcctcagcgttgtttgaaaacattctttctggtgaaaatctcgttgtccgcatcatcccagcattgctggcaggcgtagtgatgagcagaatcattacacatctacccggattggatatttcatgtcctgaaacagactctttaagctaagcggaatgctttatctatttgtcattaaatgttggagaacaggccggagcgtaattcacacatccggccttatttttaagcttaaccgagcgctaattctgcggcagcggctttatcagcgattaccatcagcgaaggatgcagctgcaacacggaagctggaacatcttcggtaaccggaccttgcagaacatttttcagtgcctgcgctttacctgcgccactgacaattatcagcaagtttttcgccgccatgatgcttttcggccccatcgtcacgtagctgtcaggcactaatgaaaagtcgccgcccaactcgccatgcgccacaatatcaaccatctctccctggatcgggaactccacggtttgctcatggaaatgggtcgtatttggcagattgccacaaaaatgaccatctacacctaatcccaacaccaccaaatccaggccgccttcacgcgccagtttctgatcatgctcgcggtagttatcaatagtgagcttctggatattctcttctttgatccccgcaggggtgaaaaacagattacgcagattggtaatcgttacgccttctccctctttgccgcgaaatggaatttcatcgaaattatagaaatagcagttatcgtaccagggcttacctttaaccagagtgatgagatattcgtacatgcctttgggcgtgctcccggcggtaattgccaggttaacacgacgcgtcttcgacatataaccaagcagatggtgtgccgcgacacggctcatttcctggtaatcttcggtaatgattaatttcatcttaatgccttatattatttgaataatttctgtacgaaggctgcataggcaggccgccagacatccatttcatggttcagaccgggatattcctggtaatcaaacttaatttttttctgctcaagctcagttttcagcccgacgatatccttgccggttacaacatctttatccccaacaaccacagtaaaattacgtagttgctggttaatagctgccggctcgttcagccgggcagcgacaccttcatccggtacggttgtcgtggtaacaccactgaatgtggccagccagccaaagctttccagatgattcattccggaaaccagcgcctggtacccgccttgtgaaagccccgccagcgcgcggccatcggcatctttacggacattaaaacgcttgctaatcagcgggataatatcgttcatcagttcgcgatctgccgctttagcattcagtggataaaagactttacgtctttcctgaggcacgaaatcttcgggaataatgcccttcgcatcggtttcggtatcagggatcaccaccagcatcggtttaattttcccttcagccagcaggttatccatgatttgcgggatacgcccctgatcgatagcggaacgtccggtatcaccaaaaccgtgatagaaatagagcactggcaaaggctcgcccatgccggagtatcctggcggggtccagacatacatctgacgttcggattgcaatgcgctggagtggtaagttatggtgatcaaatcaccatgcgcaacagaacgcgtatccagataactgcctggcaccagaatcatactggagttaacctgcgctgaggtttagtcattgctgtacctgtatcaatgctgcgtacaccatcaacattgaaaaaatattcgtacaggttgcctttcaggacaggtgtgcgccacgaccagactcccgcttcgtctttggtcatcgggtgaatattatccggaaccggaacacccaccactacggagacattttttgccccaggggcaaagtagcgaaaggtcacgctgttatcggcattgacctgagtcacatactgtttaaccggaatagtgggtgccgggctggctggcatatccgctgctatggcccactgagcagaaataccgctggcaatagccagcgttaaagcagcaatttttatattcatcgtaatattcctttcattaagttccattaccaccagatttcagcctgggcaccgacagcaaactggtcgtctttattgtcttcaaaggtgaagccatccagttcgttttccagggctttgatatacgtggcgtagaaacgaatttccgggcgcgaggtcaacatactggtattgactttaaaggtatggaagagcgtggttttataaccagactcattaaatttattactattcgcatctttgttttgctgggtgaaatagcccaactcaacacctgtctggttatattggtcccaaatataggccgggcgaacaaccgcacgaatagattcgaaatcagagtgtgcgcctgtttcgtagctataaatatcgttaccgaaggagtaaacaatcgcgttagccacaataaaatgatcgccgatataggcttcgccctgcgaagtcagacgaactgctgttccgccggtgtgataaccataataacgaccattaaaggtggtaaatggacttgcgccagcataacggccaaagttactggcgatagagttattcgcgaccaggaaggagaattcgttgaagccacctttatcaaatttctgcgttaaagatgtgccaaacatccaggtatctttccagtcataatacccgttattatcctgattatctttttccgatgcgctttcgtttgccgtgacataacgaccactcaccattaaggtgactttatcccataacgggatatctttatagcgtaaatcaatggtattggtattaatctgctgtttgttttgcaggctgcgatcgtaatcatcgacatcttcgcgaaccagcgcgatatcaattttacccggaccgactttccagttttccagacctacacctgcggcagcatcggtacgctgcgttttccagtcaagcatctggatttcaattttcggcgcaccgtgtttacccacccagaaatcagcctctggcgcaaagggcaggaaacctttggtggtaacgtacatatcagagaactgcataaagttctcaccaccggcgttatcgccaaaccagccagtagagtactgctgacccacgttaccatccatcatcacgatggcatcaacccgtttgccgttttcgttgtagacacgttgttttaactgcaaatcaaaccagccggagtattcgttaccaaagcggcccagagaaccaattgcccatgatttaggtgaaccatgagaggctgttccccaaccagaacggtagtagccgttgtaactaaagccgatttcatctttcacaaatttactgaaatctttcagagtcatggaagaataaatcgagcctgtctcactggcatttttctcttcatttttaaccagtacagcatcaggctttgcggcacgactggtcgggaatggattggcggcatacccttgatcattcgtacttacgctacgattcaccgtcgctggcgtatactttttcttctcttcatctttatattttttcagttcgctttgcgtttctcttaacgccttttctaatagctcaaggcgttgttccactgttaatgattcagccaatgattgtgcggaaaaggctaacggtgccattaataagatggcagaggtaataatatttcgtctaaacataatatccctttatggtgcaaagaaagaattaatgcatcgcatccagactgttctgaatgcgacgataattaaggtgctttattggttatttttttaatgatagcccccgagttttgatcacttctgcataccatccgaagcttttcttgcgcgttcttgtgaggcttccttcaccattatcatcacgatccacataaataaagccgtagcgcttagacatttgtgaatgagatgcactgactaaatcaattggcccccaactggtgtaccccataatatccacaccatcggcaatcgcttcatttacctgtaccaggtgatcgtttaaataggcaattcgataatcgtcctgtatcgaaccatccacttcaacgctgtcttttgcgcctaatccgttctcgacaataaataacggtttttgataacgatcccaaagcgtatttaacagaatccgtaatccaaccggatcaatttgccacccccactctgaacttttcagatgcggatttgggatcatattcagtatgttgccctgcgcatttttattaatgctttcgtcgtgggaaacacaaccggtcatgtaataactaaaagagatgaaatctacggtatgttttaaatcttctgcgtcactttcagtcatctcaatggtgatattgtggtcgcggaagaaacgctgcatatagccgggatactgaccacgcgcctgaacatcaccaaagaacatccagcgccggttctcttccatggcctgcaacatatcctgtggctggcaggtgagggggtaaaccagcccaccgagaagcatattgccaattttcgcttcggggatcaggctatgacaggctttaactgcccgcgcactggcaaccagttgatgatggatcgcctgataaacttccgcctcgccactctcttctgccagccccacgcccgtgaatggcgcgtgtaatgacatgttgatttcattaaatgtcagccataacgcaactttatgttggtagcgggtaaagaccgtgcgtgcgtaatgctcgaagtgatcgatgaccgcccgattagcccaaccgccgtagtttttcaccagcccatatggcatttcgtaatgggataacgttaccagcggcttgatccccgcctgcgccatttcatcaaacagccgctcgtaaaacgctaaccccgcttcattcggttcggcttcatcgccctgaggaaaaattcgcgcccaggcaatggaaatacgcagacaggtgaagcccatctcggcaaataacgcgatatcttccgggtaacggtgataaaaatcgatggcgacatctttgatattctctttccccaggatgcgcggttccatttttcccattacgccatgaggctgtaaatctgaggtcgtgatccctttgccatcttcctgccaggcgccttccacctgattggcagctgttgcaccaccccaaagaaatgtttctggaaatgctttcataattaactccttttatcgttagcgaatgatggataacagcggctcaccagcgtttatctgcgccgtgccgtggggtaatacgtccgtaaaatcatcgctattactgattaataccggcgtcgtcagatcaaatccggcctcgcgaatagcagggatatcaaaagaaatcagccgatcgcctgtattgaccttgtcacccacgttgacgtgagcggaaaagaatttgccgtccagttttacggtgtcgataccgacatgaatcaggatctccacgccatcatctgactcaatgccaatggcgtgtaatgtggcgaacaacgaagcaatttgccccgccaccggagaacgcacttcaccaacagagggcagaatggcaatacctttacccaacaggccgctggcaaacgtggtatcagcgacgtgaatgagcggcacaatctctcccgtcatcggtgaacagataccgccctgctcaggtgtaataacctctggtgttttctcttgctgggcaacttgcgctggctgacgtttagcggtgatgaaatgaaacatcaccgtaccgacaaatgcgcaaccgatggcaatgacaccgccaataacgctggcccatacggtgaaatcaatccccgttgacgggatggtttgcatgaaggtgaaaatacctggcaaaccaaaggagtaaactttcgtttgcgcgtagccaatgatggtggcccccaatgccccacttatgcaggcgataacgaaggggtacttacgcggcagattgacgccatataccgctggttcggtgataccaaacaaacctgtcaacgccgctgatcccgccaccacttttttctgcgcatcgcgttcgcagaggaagacgccgagcgccgccccgacttgcgccataatggcgggcattaacagcgggatcatggtgtcgtagcccagcacggtgaagttattgataattaaaggtatcaaaccccaatgcagaccgaacatcacaaagatttgccagaaaccgcccattaccgcgcctgcaaatgcaggaaccgcctgataaagccagagataaccggcagcaatcagttcacttatccaggttgatagcggccccaccagcagaaatgtgatgggcgtgatgaccatcagacatagcaagggtgtgaagaaatttttgattgccgaaggtaaccatgtattaagtcggcgttccagaatgctgcacaaccaggcagaaaaaataatgggaataaccgatgacgagtaattcaacaatgtgaccggaatacccaggaaatccaggcccagcgcatccactttttgcccgttctcgaaggcagtcagaattaatggatgcactaacgctccgccaatcaccatggcagtaaatggattgccgctgaagcgtttccctgcggtgtagcccaggattatcgggaagaaccaaaacaaggcatcactggcgctaaataaaattaaataagtaccactttgttcggtcgcccactgaaaagtgagtgccagagccaacatacctttcaggatcccggttgccgccatcaaaccgatcagaggcgtaaaaatacctgaaataacataaaaaaagcggtttaacagattatctttatcatcattttccggtgcctgttgcgctttttcgccaaggcctgccacgctgttaaccgccaggaagacatcggccacatggttacctatgacaacctgaaactggccaccgctttccaccaccataataataccgggggtctttttcagtacctcagcttgcgctttgctttcatcctttaacttaaaacgtaatcgcgttgcacaatgcatcagactcacaatgttatctgcgcccccgactcctgcgactattgttctggctaactccgtcataacttgccctctaccgctttgcggcaaaactccaaaaaaaaacctgaaaaaaacggcctgacgtgaatcaagcaatttttttcaggttttgcccgcttagtgcggtaacaatcctttattcagtaataatatttcagtgttctttgcgcacgcgctctatatttatggctaaaaacataatctctgcaggtgagattttacgttgatactgcaaaccaataaaaatggcgatccgctccgcacattgccatgcttgcgggtaattttgctttactgcttgttgtaatgattcatcactatcgttaatcgatgcatgttcaagaatacgccaggataaaaatttcagatgcgtaaccagtcgctgataactcaagctttcttcctggtaattaaggctgaactgaaattttattaattgcagcatttctcgcattaattgcgtgacacctgcaacatcctccatatttccgctcatttgggcactgaccagatgcatggcaataaagcccacttcatctttcggtaactgcacgcccaaccgtttatcaataatggttaacgcttcttcccctagctggaactctttcgggtaaagtcgctggatatcccacagcagcgggttgggcagtagcacgttttgctgaaagcgtttaatcgcaaactggcaatggtcagttagcgagatataaatactgtcctgcaactttcccagacgctcctgcgccagagagataatacgatcacaggttgccatcacctcaagaggcatatgacttaagagttcgcttaatcgcccgttcagttcatgactgctcaaggcatactctttttctattccacttgagttaattctttcgcctgggcgtttttgaaagccaattccgcgccccatgacgactttttcccgctgttgatcatcaataaccaccacaacattattgttgagaattttggtgatttgcatgttcatagcaaggaccttttttataaacaaaaaaacccgacttcaccagtattctctggttatgtcaggttttgcctgcgaatgcagtaacaatccagtcattaattaatggtttttataacgaacatccaggttcgaaaattaatttagttgcgtgcagaaaaaatagcaatgctctatttataaaagtatgaccatgctcgcagttattaattttgtgtaattttaggattttataaagttatatataacaaatcccaataattaaattattgggatttacttggtgaattatttatcgctatctttttctgccagcagtttatcgagctcgtcaccaccgacgtgacggaaatcctgccccttcacgtagtagaagataaactcacaaatattctggcagcggtcgccaatacgttcgatagaacgcgcacagaataacgcggtaagtacgctcggaatggtacgcgaatcttccatcatgtaggtcatcagttgacgaacaataccttcgtactcctgatcgacttttttatcttcacgataaatacgtaccgcttcgtcaatgtccatccgcgcgaacgcgtccagcacgtcgtgcagcatctggatggtatgacggcccagcgactccagacttaccagcaatggctgatgctgctgggagaatttctccagtgcagtacggcagattttgtccgccacgtcgccaatacgctccagctcggcaatggttttactgatcaccataaccagacgcaggtcgctcgccgtcggctgacgtttggcgataatgcgcacgcaggcttcatcgatcgccacttccatcatgttgacgttcttgtcgccttcgatgacgcgcttcgccagatcgctgtcctggttatgcatcgcggtgattgcatcagaaagctgctgctccaccatgccgcccatggtcatcacctgcgtgcggatgctttccagttcggcgttgaactggccggaaatatgtttattaagattgagactgtccataacgcactcctgaatcaaccgtaacgaccggtgatgtagtcttctgtttgtttcttcgctggcttggtgaacagatcgtccgtgttgctgaactcaatcaattcgcccaggtacataaacgccgtgtggtcggaacaacgcgcagcctgctgcatgttgtgggtgacgatcaccacggtgtaatcctgcttcagttcggtgatcagctcttcaatacgcccggtggagatggggtcgagcgccgaacacggttcgtcgagcagcagtacttccgggcgaatggcgataccacgcgcaatgcacagacgctgttgctgaccaccagagagagagtaaccgctctggtgcaatttatctttggtttcgttccacaatgcggctttggtcaatgcccactgcacgcgctcgtccatgtcagcacgggagagcttctcaaacagacgcacgccaaaagcgatgttgtcgtagatggacatcgggaacggcgtcggtttctggaacaccatacccactttcgcacgcagcagggcgatatcctgagagttggtcaggatgttgtcgccatcgagcagaatttcaccttccgcacgctgttccgggtacagttcaaacattttgttgaaggtacgcagcagcgttgatttaccgcagccggacggcccgataaacgccgtaacctggtttttggcgatatccaggttgatgtttttcagggcatggaatttgccgtagtagaagttcaaattacgaacctgaattttactcggggcagtttcaaccatactcattgcaatcttttcctcatcgtgcctgatgcacttcgcgaatcaggcttaccgtaggccggataaggcgtttacgccgcatccagcaaagtgttaaccgtgtttattcttcgcaaaaacaacgcgcgccagaatgttcagcagcagtacgcacagggtaatgatcaacaccccggcccaggccagttgctgccattccgcaaacgggctcatcgcaaacttaaagatcgtcaccggcaggttggcgatcggctgcatcatgtccgtgctccagaactggttggagagcgcagtaaacagcagcggcgcggtttcaccagcaatacgggcaatcgccagcaggataccggtcatgatcccggacaccgacgctttcagcgtgatcgcggcgatcatcttccacttcggcgtacccagcgcataagccgcttcacgcaggctgtccggcaccagtttcagcatgttctcggtggtgcggataacaatcggcacctgcaacagcgccagcgcaatcacgcccgcccagccggagaagtgctccatctgcgccaccacaatggtgtaaacaaacagaccaaccacaatcgacggcgcagagagcagaatgtcgttaatgaagcgaatcacttctgccagccaagatttacgaccatattcagccaggtaaatccccgccataatgcccagcggcgtaccgaatacggtagcccacaaaattaacaggccgctacccgccagggcgttcgccagaccaccgccttccgtattgggtggtggcgtcatttcggtgaacagcgccagcgacataccgtcgataccgcgagtgatggtggacattaaaatccagatcagccagaacagaccgaaggccatcgtcgccattgagagcgtcagcgcaatacggtttttgaggcggcgacgcgcctgcattttgcggcgggattcagccagtgccgcagtggtttgcatttcaaccatagccattagcgtgccccctcattcttagccaggcgcataatcataaacttcgatgcggcgaggacgatgaaggtaatcacaaacaggatcaggcccagttccatcagtgcagcgacgtgcagaccggattccgcttccgcaaattcgttggccagcgcagaggtgatactgttgcccggcatatacagcgaggcgctgtcgagttggtaggtgttaccgatgataaaggtcaccgccatggtttcaccgagcgcgcgccccagccccaacataatgccgccgataacaccatttttggtgaacggaagaacgatacgccagataacttcccaggtggtgcagccaataccgtaggccgactctttcatcatcaccggggtttgttcgaatacatcgcgcattaccgctgcaatgtacggaataatcatgatggcgaggatcacgcctgccgcgaggataccgataccaaaggccgggccggagaacagcgcgccgacaatcgggatattcgacatgatattgccgaccggctcctggaagtaaacggcgaacagcggcgcaaagataaacaggccccacatgccgtaaacgatacttggaatggcagccagcagctcaatggcgatacccagcgggcgtttcagccagccaggcgcaagctcggtcaggaacagggcgataccaaaactcaccgggacggcgatcagcagcgcgataaacgaggtcaccagcgtaccgtagatcggcaccagcgccccgtagatatcgttcggcgcatcccactctttggtccacaggaaagccagaccaaatttctgaatgctcggccaggatgagatgatcagagagacaataatgccacccaacatcaatagcacaatcagcgccgccagttttaccagcacgctgaaaattatgtcgccctttttacccggtgggttaaaagcaggcttggttgcagccataagttactcttcagttaaacgcgtttacaaagtcattttgtaatgccggatgcggcgtaaaacaccgtacccggcctggagttttattagtacagcggcttgccgctactgtctttaatattggtcttccacgcagcgcgaacctgttcaactacgctatccggcaggctggcgtaatccaggtcgttcgcctgtttagccccggttttgtatgcccagtcgaagaacttcaacacttcggtgccttgttctggtttcttctgatctttatggatcagaatgaacgtggtagaggtaataggccatgcatcttcgcctttctggttggtcagatcctgagcgaatgttttgctccagtctgcgccttttgctgcattagcgaagttttcttcggtcggactcaccggtttgccatcagcggagatcagtttggtgtacgccaggttgttctgcttcgcgtaagcatattcaacgtaaccaattgcacccggcagacgctgaacgaacgcggcgataccgtcgttacctttaccgcccagaccgatcggccattttacggtagagccagtaccaacgttgtttttccactcttcgttcactttcgccaggtagctggtgaagacgaaggaagtcccggagccatctgcgcggcgtactacagcaatgttctgtgaaggcagtttcagacccggattcagtttggcgatggcttcatcatcccacttcttgattttgcccaggtagatgtcgccgagggttttaccatccagcaccagttcgccagacttcagacctggaatattaaccgccagcaccacgccgccaatcacggtcgggaactggaacaggccttcctgagccagtttttcatcagacagcggcgcgtcagaggcaccgaaatcaacggtgttagcgataatctgttttacgccaccggaagaaccgataccctggtagttaactttattaccggtttctttctggtaagtgtcagcccatttggcatacaccggcgcagggaaggttgcacctgcacctgtcaggcttgcttctgcaaacacagagaaagcgctcatcgataaggtcgcggcgacaacagttgcgacggtggtacgcataactttcataatgtctcctgggaggattcataaagcattgtttgttggctacgagaagcaaaataggacaaacaggtgacagttatatgtaaggtttatgacagttttatgacagagagagaatgtcttcagtccgatttaaataagagtttatattcagttaattacaaatattaataacgaagagatgacagaaaaattttcattctgtgacagagaaaaagtagccgaagatgacggtttgtcacatggagttggcaggatgtttgattaaaaacataacaggaagaaaaatgccccgcttacgcagggcatccatttattactcaaccgttaccgattttgccaggttacgcggctggtcaacgtcggtgcctttgatcagcgcaacgtggtaagccagtagttgcagcggaacggtgtagaagatcggtgcaatcacctcttccacatgcggcatctcaataatgtgcatattgtcactgctcacaaaacccgcatcctgatcggcgaagacatacaactgaccgccacgcgcgcgaacttcttcaatgttggatttcagtttttccagcaattcgttgttcggtgcaacgacgataaccggcatatcggcatcaatcagcgccagcggaccgtgtttcagttcgcctgcagcgtaggcttcagcgtgaatgtaagagatctctttcagcttcaatgcaccttccagcgcgattgggtactgatcgccacggcccaggaacagcgcgtgatgtttgtcagagaaatcttctgccagcgcttcaatgcgtttgtcctgagacagcatctgctcaatacggctcggcagcgcctgcagaccatgcacgatgtcatgttcaatggaggcatccagacctttcaggcgagacagtttcgccaccagcatcaacagcacagttaactgggtggtgaatgctttggtggaggccacgccaatttccgtaccggcgttggtcatcagcgccagatcggattcgcgcaccagagaagaacccggaacgttacagattgccagcgaaccaaggtaacccagctctttcgacagacgcaggcccgccagggtatccgcggtttcgccagactgtgacaaggtgatcatcaggctgttacgacgcacggcagatttgcgatagcggaattcagaggcgatttcgacgtcgcacggaatacctgccagcgattcaaaccagtagcgggaaaccataccggagttataagaagtaccacaggcgaggatctgaatatgctcaaccttcgacagcagttcatcggcgttcggtcccagctcgcttaaatcaacctgaccgtggctgatgcgcccggtaagggtgtttttgatcgcgttcggctgttcgtagatctctttctgcatgtagtggcggtaaatacctttatcgcccgcgtcatattgcagattggattcgatatcctgacgttttacttccgcgccagttttatcgaagatgtttaccgaacggcgagtgatttccgcaatatcgccctcttcaaggaagataaagcgacgagtcactggcaacagcgccagctggtcagaagcgataaagttttcgcccatacccaggccaatcaccagcggactaccagaacgtgccgccagcagggtatccggatgacgggagtccatgatcactgtaccgtacgcaccacgcagttgcgggatagcacgcagaactgcctcacgcagagtaccgccttgtttcagctcccagttcaccaaatgtgcaatcacttcggtgtcggtttcagaaacgaaggtatagccacgcgcttttaactcttcacgcagcggttcatggttttcgatgatgccgttatgcaccaccacaatgtgttcagaaacatgcggatgcgcgttagcttctgaaggttcaccgtgggtcgcccagcgagtgtgagcaataccggtgccgccatgcagaggatgttcttccgctgcctgagccagcatctgtactttaccgaggcgacgcaggcgggtcatatgaccttctgcatcaacaacggccagaccggcagaatcatatccgcggtattccagacgacgtaaaccttcaagaaggatttctgctacatcacgttgcgcgatcgcgccaacaattccacacatagtttttgattccgatttatatcgttgtcggtcaacctgtatgcccgtttttcgggcgccccgagccttgtagagagtggggttatttttatagttactgcttgtgggcgggagattatgttatctcctcatcccatatgaccggattacccggccagaattactttttctttaccggacgacgccagccttctttttgagtctgcggcacacggctgatcgccagggcattttcgccgacattacgcgtcacagttgtacccgcagcaatggtcgcgcctttgcctactgttaccggggccaccagttgagtgtcggaaccgacaaacacatcgtcgccgataatggtcttaaatttattcgcaccatcgtagttgcaggtaatggttcccgcgccgatgttaacgttatcgccaatttccgcatcgcccaggtaagtcagatgaccagctttcgagcctttacccagacgcgcttttttcatctcaacgaagttaccgacgtgtgcaccttccagcaactcagcaccaggacgcagacgggcaaacgggccaatagtacaggccgcagccagattcgcgtcttccacgacggtatatggactgatttcgcaatcatcgccaatcacgctgtttttaatcacgcaaccggtgccgattttcacgcgatgaccgagagtcacgttgccctcgatgataacgttagtatcaatttcaacatcgcgcccgtgagtaagcgtaccgcgcagatcaaaacgcgccggatcgcgcagcataacacctgctaacagcagtttttcagcctgttcggactggtaaacgcgctccagtcgggagagttgcaggcggttattcacgccttctacttcgcttaaacgttgcggatgaacggcgacgatttcacgtccttcctgatacgccagcgcaataatgtcggtgatgtagtattcgccctgagcattattgttggtcagcttcgccagccagcgtttcatatctgcgccgttggcaatcagaatgccggtgttgatctcctgaatctgacgctgctcgtcggtggcatctttgtgctcaacaatgccggtaactttgccgttttcacgggtgatacgtccataaccggtcggatcatccagttttaccgtcagcagaccaatgccaccctgcggtttagcatcacgcagacgctggagtgtttcgacagagatcagcggcacgtcgccgtagagcattaaaatgtcttcatcatcggcaaagaaaggtgcggcctgctgcatcgcatgacccgtacccagctgttctgtctgaagcacccagttcaggttgtcgtctttcagcgcctgcttaagcagatcgccgccgtgaccatacacaaggtgaacgtgcgctgcgcctaattcattcgcagcatcaatgacatgctgaaccatcgctttcccggcaagggtatgcagcactttcggaagatcggaatacatgcgcgtgcctttgcctgcggcaaggatcactacgctcatagcattattcaacatacgcgtcctgactgtaatttgagaacgaatttaaaccgcttcaccttgaaaaaactacatttttttcatcgtgaaatggacagaggataaattgttcaataacggattatccccgctgacgaaagcgccattttcgaccatcgtcacgccttttgtctgcagaaaattaaggcagtaccttcatttaagcgtcaggtggatgtttttgctcttatttcgatcaatgaataaacgggaaaacaggggtgttttatatcatcaggatctatgtgaacgcttttcaggacgggtcaatacgcgtaaaaaaaagccagcctgttgccagactggcttttgtgcttttcaagccggtgttacatcgcttttttggtcaactcgataacgcgcagctgcgcgatcgctttggccagttccgcagacgcctgagcgtaatctacgtcgccgtgagagctgctaatgtgctcttcagccttacgtttcgcttccatggctcgcgcttcgtcgagatcctggccgcgaattgcggtgtcggccagaacggtcacgttgccaggctgcacttcaagaatgccgccagacagatagataaactcttcgtgaccgtgctgtttcacgatgcgaatcataccaggcttaatggcggtgagcagcggtgcgtggccagggtagatccccagttcaccttcgctacccgttacctggattttctcgaccagaccagagaacatttgttgctctgcgctgacgacgtccaggtggtaagtcattgccatatcaccctccgattaaggcgttaaagttttttggctttttccacagcttcttcgatggaaccgaccatgtagaacgcctgctccggcaggtgatcgtattcgccttccatgatgcctttaaagccacggatggtgtctttcagggagacgtatttacccggagaaccggtgaatacttctgccacgaagaacggctgggacaggaagcgctggatcttacgagcacgcgctaccaccagtttgtcttcttcagacagttcatccatacccaggatggcgataatgtctttcagttcctgataacgttgcaggatggactgaacgccacgcgcagtgtcgtagtgttcctgaccaaccaccagcgggtccagctgacggctggtggagtccagcgggtcaacggccgggtagatacccagagacgcgatctgacggctcagtaccacggttgcgtcaaggtgcgcaaaggtggttgccggagacgggtcagtcaagtcatccgcaggtacgtatactgcctgtacggaggtgatagaaccggttttggtggaggtgatacgttcctgcagaacgcccatctcttccgccagggtcggctgataacctaccgctgaaggcatacggcccagcagtgcggatacttccgtaccggccagggtgtaacgatagatgttgtcaacgaacagcagaacgtcacgaccttcgtcacggaatttctcagccatggtcagaccggtcagagcaacgcgcagacggtttcccggcggctcgttcatctggccatacaccagggatactttgtcgataacgttggagtcggtcatttcgtggtagaagtcgttaccctcacgagtacgttcacctacgcccgcaaacacagagtaaccggagtgctcgatcgcgatgttacgaataagctccatcatgtttacggttttacctacacccgcaccaccgaacagaccaactttaccgcccttagcgaacggacacatcaggtcgataactttgataccggtttccagcagttcctgagagtttgacagctcttcgtaggaaggtgctgcgcggtgaatcgcccaacgctcttcttcaccgatctcgcctttcatgtcgaccggttcacccagtacgttcatgatacggcccagagtcgctttacctaccgggacttcgatcgggtgttcgaggtcttttacatccagaccgcgacgcagaccgtcggaggaacccattgcgatggtacgcacgataccgccgccgagctgctgctgaacttccagcaccagacgctcattaccattttgcacctcaagagcatcgtacacgcgcggtacggcatcctgagggaattcgacgtcaactacggcgccgattacctggacaatctttccagtagccatcttaaatcctctacgaaataacctgtttaaaccgcggcggcccccgagacgatctcggtgagttcctgagtaatgctggcctgacgagctttgttgtataccaactgcagctctttaatcaggctgccgccattgtcggtcgcggctttcatcgccaccatacgggcggcctgctcgctggccaggttttcaaccacgccctgataaacctgagattcgacataacgacgcagcagggtatccagcaacgccttcggatcgggttcgtacaggtaatcccaggatttatgtttcagatcatcatcatctgatgccggtaacggcagcagctggctgatggtcggaacctgagacatggtgttaataaatttgttgctgacaatgtaaagcttgtccagacggccttcgtcgtaggcctgcaacatcacttttaccggaccgatcagttcggacagggaagggttatcccccatgccggtgacctgggcaacaacattgccgcccacggagttgaagaacgacacgcctttcgagccgatcattgcgaggtcgcattgaacgcctttgtcggtccaggtcttcatttccgccagcagttttttgaacaggttaatgttcaaaccaccgcacaaaccacggtcggtcgacaccaccaggtagcccacgcgtttaacgtcgcggtcttccaggtaagggtgcttatattccagattaccgtgtgcaaggtgaccaatcactttgcgcatggtttctgcataaggacggctggccgccatgcgatcctgcgatttacgcattttggaagcggcgaccatctccatcgctttagtgatcttttgcgtgttctggacgcttgcgatcttactacgtatctcttttgcgccggccatgagcttctcctcaatgccttgcggcctgccctaaggcaagccgccagacgttaccaggattgggttgctttgaaggaatcgaggatgcctttcagcttgccttcgatttcgtcgttgtagccaccggtctggttgatctcttgcatcaacggagcgtgatcacggtcgacgtaagccagcagagcggcttcgaagctgccgattttcgacagttcaacatccgccaggtaaccacgttctgctgcgaacagaaccagagactgttgcgcaacagacatcggcgcatactgtttctgcttcagcagttcggtcactttctgaccgtggtcaagctgcttacgtgttgcatcgtcaaggtcggatgcaaactgagagaacgctgccagttcacgatactgtgccagagcggtacggataccaccggacagttttttcatgatcttggtctgtgctgcaccaccaacacgggatacggaaatacccgggttaaccgcaggacgaataccggcgttgaacaggttggtttccaggaagatctgaccatcggtaatggagattacgttggtcggaacgaacgcagaaacgtcacccgcctgagtttcgataatcggcagcgcagtcagagaaccggttttccctttcacttcacctttggtgaaagcttcaacgtattcggcgttaacacgcgcagcacgctccagcagacgagagtggaggtagaatacgtcgcctgggaatgcttcacgtcctggcggacgacggagcagcagggagatctgacggtaagcaacagcctgtttagacaggtcatcgtaaatgatcagcgcatcttcaccgcggtcacggaagtattcacccattgcgcaaccagcgtacggtgccaggtattgcagtgctgcggattcagacgcggttgctaccacaacgatggtgttagccagtgcgccgtgctcttccagtttacgtaccacgttagaaatggtggacgctttctggccgatagcgacatagatacatttgataccggaatcgcgctggttgatgatggcatcgatagccagtgcggttttaccggtctgacggtcaccgatgatcaattcacgctgaccacgaccgattgggatcatggagtcaacggctttataaccggtctgtaccggctgatctacggactgacgttcgataacgcccggagcgattgcttctacagcagagaagccgtcgtgatccagcggacctttaccgtcgattggtgcacccagagtgttaaccacacggcccagcaggccacggccaaccggaacttccaggatacggccagtacacttaactttcatgccttcggcaaggtcagcgtacggccccataacaaccgcacctacagagtcgcgctcgaggttcagtgcgatagcgtaacggttacccggcagggagatcatttcaccctgcatacaatcggccaggccgtgaatgcggataacaccgtcacttacagaaacaatagtaccttcgttgtgagcttcactcacaacattgaactgagcaatgcgctgcttgatcagttcgctgatttcggtggaattcagttgcatgctccagtccccttaagactgcaagacgtctgcaaggcgctcaagacgaccgcgtacgctgccatcaatgaccatatcacccgctcggatgataacgcctgccattacagacttatcgattttgcaattcagcttaactttgcgtgacagacgtttttccatcgcagcagaaattttcgcgagctgttgttcactcagtgcggcagcggaaatgacgtctacctcagcggtagcctcactcacggcacgcaggtgaataaactgctccagaacatccgggagcgcgttaagacgaccattttcagccattacccgaatcaggttctgaccgttttcgtccagttgctcaccacaaactgcgataaacgactcggcgagcgtttctggcgcaagcgcgccagagagaagctctgccatttgttcgtttttggttacctcggcggcaaacgccagcatgtcctgccagcgttctacactttggtgttcgacggcaaagtcaaaagctgctttggcgtaggggcgagctaccgtaataaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcacgtttacgctcggcttcaatttccgcctgcgcctgggccacgattttagtacgttcctgttctgcctcagctttcgcttcgtccagaatctgcgagcggcgtttgttagcctgctcgatgattacctgggcttccgctttcgcttttttcagctggtcggtcgcgctggcctttgcaaggtcaaggtccttatgtgctcgttctgcggaagcaaggccgtcagcaatttctttttgacgtttttcgatggctgccattaatggcggccatacgtacttcatgcagaacagaacgaacaggacaaacgcgatggcctggccgaggattgttgcgttaagattcacagcacaatgcctctatttagttaacgttctgatattgctctttaaataaaagcaacgcttactacgcgacagcgaacatcacgtacagacccagacctacagcgatcatcgggatagcatccaccagacccataacgataaagaactgagtacgcagcagaggaatcagatcaggttgacgcgctgcgccttccaggaatttacccccgaggatgccgataccgatcgcagcaccgattgccgccagacccatcatcacagcggcagccatgtacagcagatccatattcaggttttccatgacagtctccagtttgtttcagttaaaacgtagtagtgttggtaaattaatgttcttcagacgccatcgacagatagacgatcgtcagaaccatgaagatgaaggcttgcagcgtaatgatcaggatgtggaaaatggcccacggcacattcaggatccactgtgaccaccacggcaacagaccagcaatcagaatgaaaatcagctcaccggcatacatgttaccgaacagtcgcaaaccgagtgaaactggtttggacagcaggcttaccccttcaaggattaagttgacaggaatgaacgcccagtgattgaacggctgcagcgtcaactctttcgtgaagccgccgatgcctttcattttgatgctgtagaacagaatcaggataaatacgcccagtgccatagacagcgttacgttcacgtcagcagacggaaccacacgcagtgcaggcagacccagtacatgttcagcaatgtacggcagcaggtcgataggcagtaaatccatcaggttcatcaggaatacccagacgaagatcgtcagggccagcggagcaatcagcttgcttttgccatggtacatgtctttcacgctaccattaacaaagccgatcaccagctcaatcgcggtctgaaacttacctggcacgccgctggttgcctttttggctacactacggaataaaaccaggaacaacagacccagcaccaccgagaagaacatggagtcaatattgattgtccagaaggtggctggggggttatgtggatccaccagcgagaatgtacgcaggtccagctgaaggttattcaggtggtgtcctatgtaatcctgcggcgtcatattttctgaagccatgatgccttttaccctttgttgttaattacagccggtgccagtatctgaaccaccagcaccaaaacccacgtaacgatcagcggcaagaataccgcctttaaaaccgccaacgccaccaccagtaacaccaacatcgccagaactttgaaagcttcgccaaatgcgaatgtccaggccacccggcctttcgctggtgtatgcgcctggtgacgccaggcaaatatcataaacaaaacgttaggcagaaagactgccaggcccccgcttattgcagagacgccccagaaggggtctttgaggctgaacagcaatccacttgctatcaccaccagtaactgaacgagcagaagcttccgagcaacgtttcgactcacgagcgacacagacatcacgtttttcactcctgctcccttcgaggtatgccgcgtgtcgtataaaactttctttaaggcttagagtcaagcatcaaaaagcggtcaaattatacggtgcgcccccgtgatttcaaacaataagtagccaaaaggtgaataaatgtttaaatatttttccagtgcatacaattgcgacttttctgcaaaccctgttcgatcatgaaaaactgtaaataacgcgtaaacactggtgataaagcgtgcttcagatcacatattgcgcatgttcgcgcacagcatatttatttacttggcaaatgatgcctttgcaagtttatgatatttcagtctaaaaacagatactgttttaataaatgacatttacataacaaaaaccacccattgacatttttaataatgttttaacagtcaatgatgattcttagcgccgatttttagcagactgatattttcacttatgacttattttctgcttaccaaaaaaagccacgttatcttgttgatacaaaagagtgaacgtggcgttaaatgtaaccagttatatcagtagaaaacctggttgttgttaacagtctaaccggtcaattttttatgatttttttgataaaaattaaattttatttgctttaatcaccaccagatgacgttcgccatccagggctggaacctgaagtttaaccactgattcgacctgatattcctcgggcaacaaagcgatttcatcttccggcatttgccctttcagcgcgtagaaacggccttgctcaccaggaagatggtggcaccagctcaccatatcgttcagagaggcaaaagcgcggctaattacgccatcaaatggcggctctgacggaaactcttctaccctgctctgtactggctcaatattctccagtttaagctcatgttgcacctgacgaaggaaacgcacgcgtttaccaaggctatccaacaacgtgaaatgagcttcaggacgcacgatagagagtggaatgccaggcagtcccggtccggtgccgacatcgataaaccgttcaccttgcagatacggtgccaccacaatgctatcgagaatatgtcgtaccagcatctcattaggatcgcggaccgaagtcaggttgtacgctttattccatttatgcagcatattcacgtaggcaataagctggtttttctggtgatcggtaagcgaaatacctgcgtctttcagcagtaaggagagtttgttgagcacggtgattacctgttcttgatgcgttgcctggtaagcgggtgcttaccaggcatttttaatgcgttatgcgctacgacgcagcataccctgttttttcagccacaccagcagaatggagatagccgcaggcgtgacgccagaaatacgcgaagcctggccaatagaggccggtttgtgatcgttaagtttggcgatcacttcgttagaaagaccggatacctggcggtaatccagcgtcgctggtagcagggtattctcgttacgcagctgcttttcgatctcatcttgctggcgcgcgatataaccttcgtatttaacctgaatctcaacctgttccgcagcctgttcatctgtcaacgcaggggcaaacggtgtcagcgtggttaatttttcataagtcatttcaggacgacgtagcagatcttcaccactggcttcacgggaaagcggcgcagtcaggtgagcattcacttcggctgcagcttccgccgacggggttacccaggtcgatttcagacgctgacgctcacgctcgatattctcaagtttctcgttaaagcgcgcccaacgttcgtcatccaccaggcccagttcgcgaccgatttcagtcaaacgcagatcagcattatcttcgcgcagcatcagacgatattctgcgcgcgaggtaaacatacgatacggttctttggttcctaaagtgcacaggtcatcaaccagtacgccgagatatgcctgagaacgcgccggagcccaaccttctttgtcagcagacagacgggcagcgttaagaccagccagcaaaccttgcgcagcggcttcttcgtaaccggtagtgccgttaatctgaccagcaaagaacagcccctggataaacttgctctccagcgtcggtttcaggtcgcgtggatcgaagaagtcatactcaatggcataacccggacgcacgatcttcgcgttttccatcccctgcatggagcggacgatttgcatctgcacatcgaacggcaggctggtggagataccgttcggataaatttcgtttgaggtcagcccttccggttcaaggaagatctgatgctgatttctttcggcgaagcgcatgactttgtcttcgatcgacgggcagtagcgtgggccgacaccttcgatcacccctgcatacattgggctacgatcgaggttactgcggatcacatcatgggttttctcgttggtatgggtgatataacacggcacctgctgtggatgctgggacgcattacccataaacgagaataccggcattgggttatcgccatgctgttgcgccagcacgctgaagtcgatagtacgtgcatcaatacgcggcggtgtcccggttttcagacgaccaacgcgcagcggcagttcacgcaaacggcgagagagcggaatggacggcggatcaccagcacggccaccgctgtaattatccagaccgatatgaattttaccgtcgaggaacgtcccaacggtgagcacgacagctttggcacggaacttcagtcccatttgggtaacggcaccgaccacgcgatcgttttcgacaataagatcttcaaccgcctgctggaagatcatcaggttcggttggttctccagcgccgtacgtaccgcctgacggtagagcacacgatctgcctgagctcgggtagcgcgaaccgccggtcccttgcttgcgtttagtatcctaaactggatacccgcctgatcgatcgctttcgccatcagaccgccgagtgcatccacttcttttaccagatgtcccttcccaataccgccgatcgccgggttgcagctcatctgccccagagtgtcgatattgtgtgtcaaaagcagagtctgttgacccatacgcgccgcggccatcgcggcctcggtgcctgcatgacccccgccaatgatgatgacgtcaaaaggatccggataaaacatggtgattgcctcgcataaagcggtatgaaaatggattgaagcccgggccgtggattctactcaactttgtcggcttgagaaagacctgggatcctgggtattaaaaagaagatctatttatttagagatctgttctattgtgatctcttattaggatcgcactgccctgtggataacaaggatccggcttttaagatcaacaacctggaaaggatcattaactgtgaatgatcggtgatcctgggccgtataagctgggatcagaatgaggggttatacacaactcaaaaactgaacaaccgttgttctttggataactaccgtttgatccaagcttcctgacagagttatccacagtagatcgcacgatctgtatacttatttgagtaaattaatccacgatcccagccattcttctgccggatcctccggaatgtcgtgatcaagaatgttgatcttcagtgtttcgcctgtctgttttgctccggaatttttgagttctgcctcgattttatcgatagccccacaaaaggtgtcatattcacgactaccaataccgattgcgccaaagcggaccgcagaaagatcgggcttctgttcctgcaatgcttcatagaaaggagaaaggttgtccggaatatctccggcaccgtgggttgagctgataaccagccagatccccgaggcagataaatcttccaacagcggaccgtgcagcgtttcggtggttaaacccgtctcttccagcttttcagccaggtgttctgctacatattcggcaccgccgagggtgctgccgctgataagagtgatatctgccataaaccgccacctttattaagagtggcgtattgtacgctgtgaacgcgttgggatctacctgtggaaaagtatgggattaaaaaagccgatcagggcttaatggtacgcatgatcggattctgcaggacgatcagtgtctcggtggactgaatttcatcaattgtttggatcttgttgataagtacatgctggagagcatcgatcgaacggcacatcacttttataaagatgctgtagtggccggttgtgtaataggcttcagtgacttcatcgaggctttccagctttgccagcgcggaaggatagtctttggcgctctttaatataatgccgataaagcagcctacgtcataaccaagctgcttcgggctgacatcaatacgcgccccggtaatgatccccgcctgcttcattttctctactcgaacgtgaatcgtccccgggctgacgccaaattgtttcgccagttcggcgtaagcggtgcgcgcattgcccattaatgcttccaggatgcctcggtccagattgtcgatcagataattttccataggattttcttatgcggattgatgattcattctattttagccttcttttttaatgaatcaaaagtacgtgaggctttttattgaatgattattgcatgtgtgtcggtttttgttgcttaatcataagcaacaggacgcaggagtataaaaaatgaaaaccgcttacattgccaaacaacgtcaaattagcttcgtgaaatctcacttttctcgtcaactggaagaacgtctggggctgatcgaagtccaggcaccgattcttagccgtgtgggggatggcacgcaggataacttgtcgggctgtgaaaaagcggtgcaggtaaaagtgaaagctctgcctgatgcccagttcgaagtggttcattcactggcgaagtggaaacgtcagaccttagggcaacacgacttcagcgcgggcgaagggctgtacacgcacatgaaagcccttcgccccgatgaagaccgtctttccccgttgcactcggtctatgtagaccagtgggactgggaacgcgtaatgggcgacggcgagcgtcaattctcgactctgaaaagcacggtagaggcgatctgggagggaattaaagcaaccgaagctgcggttagcgaagagtttggcctggcaccgttcctgccggatcagatccacttcgtacacagccaggagttactgtctcgttatccggagctcgatgccaaagggcgtgagcgggcgattgcgaaagatcttggcgcggtattcctggtcgggattggcggcaagctgagcgatggtcatcgtcacgacgtgcgcgcaccggattatgatgactggagcaccccgtcagagctgggccatgcgggtctgaacggcgatattctggtatggaacccggtactggaagatgcgtttgagctttcttccatggggatccgcgtggatgccgacacgctgaagcatcagctggcgctgaccggtgacgaagatcgcctggagctggagtggcatcaggcgctgctgcgcggtgaaatgccgcagaccatcggcggcggtatcggccagtctcgtttgaccatgctgctgctgcaactgccacatatcggccaggttcagtgtggtgtatggccggcagctgttcgtgagagcgtcccttctctgctgtaataatttatcgccgccagcgtctgagcaggcggcttcgcatcccggtatcaaagcgccagatatgatcgaaaatgcgcatgatgccgggtttgccatgtgccgacatcgccacggcatgaaagcgatgctgatgtacccgctgcaactctttcactttgctcgtcacgtcgtcaggtaaccgctgggcgataaaatcagaaatcaccaccgcatcggcatcaaaccattcccggctttgcaagcgttccataatggcgcgaaaacaactggccagatcggtgccgccacgaaactgctggcttaaaaaacggattgcttgttcgatgccttgtgggcctgaaagctcataacggacgatctcggtggaaaatagcataatatagcagcgccggttttcagcgagggctatgcgcatcaaggccaggcagaacgctttcgcacactgttcattaaagccgcccattgagccggaagtatccacgcagacaataaacggtccgcgcggctgttcgtcgtaatctttatgcaccaccgggcgttcgatcattttttcacgccacgactcaccatgcaggcgataggtgagcaactgtttttccaccagccgacggtaaaactcatactccagttccgttatccctagtgtcgccagttctggcggcaagagacgtaaaatatcatcgctttgctgcagaccatcaacctgctcaggaactgtcgccggttcgcgcaccatggtgcggaaggtttccatctgcgcatcgttgcgcggtattgatttggcttcccgggaacgccccagctgttctgccagacgtttcagttccggctgttcgttaagaaattcaccgtatttcacaatcaactgatagtcgccacgtttaagctgaccggcgctcatatcccacagacgaccagctgcggtattgttatctgcgagaatcggttcaagttgcccgctcagcgtcatgcgttcctgaacttcactcaacagttgttcgcgttcttcttctaatagctgctgatttaacgtcgttgcttgcacgatcaggcttaaacgccagcgctggagaaaaagcgtgtgtaacgctgaagtgatcgtgctgttagcatcaaccaactggcgggcttgttctgcccatggggaattcagacgatgcagtaagtccaggatttgtggtagctgcacaataaactgcggcgtggagaggagctggctttgctgatagcacatcacctcttcggtgagttccggcgggactcgggcatctttcagccgactgcgcagcgcctcacgccagcggggaacatcatcagtgattgccgccttcagtcgtgggaatttttcaaagaagactgccagctgcggtgaggccagcagcgcgatgatcatctcttcgatcaatccctcttcgctgacggccagcatcacattaagcgtatccagcgttagcattgttgtgcctggcgaatctgtgcgccgacatcctgtaggctggcttcaatgcgacctaaccagtcgccagggataaacagacatttttgctgttcgctgaataaagcgtgttgcttgcgccagtcgctttcaagctcttccagttgttgttttatttcacctggcagaccttcagccgatgaacctggaagtgctagcgtactgccttgtaaacttacatcgcgtacaacaagatgttgggcgctatcgacttccagattcagtttctgggcaaagccgataccgttcagtttgccgcgaatctcaccacctttactcagccactgttccagcgcgctacgctcaaaggagatatgaaccacttccatatcatgcagttttaacggtttttgcagcagcagagtcagagtggaagcagtaacgttaacagggagttgatactgctgacgacggctaaaaatgccgcccagacgaattaccgttaaggctgttttatcgctttgttgctgctgaagttgcaggtgacgttgcacaatcgcgcccaggcgggtcaacatcccttgctgttgccaggcgtgaccggtcatcaatacatcaatttgttgttgtatcaaattcaggctttgcgcgtcataccacaggcaatctttcagcaaaatgagatcaaccggggcgacagcactgcgaccgctaaaaaaggcgctggcctgcaataagcggatcgcttttttccagcgacgatccgagacataaggcgcatccggtaatttatccagttgctggcgcagcataaaaatcagctcaaatacatgatcgggcagcgtaatttcaccaatctctttctgccagcgttcatattcttcatctgtgatctgcaaggaggcaggaaccggattgtcattttcatcctgttgactggtcagcatggagcggaaattcgctttatcctgcactttatctaaccacagacgaatcagcatgcggtcatataacgcttccagactgctgtctgcttccggcagctcgttggaggccgccaccagcagacgcatcgggattttttctacgagtgcgccgttgcggaactggcgctcgttaatggcggtgagcagggtattaagaattgccggacccgctttccagatctcatccagaaagacgatttcagcttccggcaggtaaccgctggttaaacgttcatagcgcccttcatcttttagcgcctgaatagaaaggggaccaaaaacttcttccggcgtggagaagcgggtcatcagatattcaaacgcgcgggcattctgaaaggcgaattttaagcgccgggcgatcaaacttttggcaatacctggtgggccaaggaggaacacactttcaccacttaatgccgctaataaacacaagcggatggcgtggctacgttcataaagccccttttccaacgaactgctcaggcgggaaattctttccgctaataaatgagggtgagccataatgaagtggcgtcctttcgtcaaaagttctgcgtaaattgcgagtatagacgtttcttgctggtggctaaaatagtctcaaaggaggggtatttttctttgagccaggttaatgtggccgcatttaggagtacgattttgccgttaatcgtgcatactgtgcgcttttttgtgggccaagggactaagcacacatttcatatttcaacgaaagactagtctatgagcactgataataagcaatcattgcccgcgattaccctcgcggcgattggagttgtctacggcgatattggtaccagcccgttatatacacttcgtgaatgtttgtccggccagtttggttttggcattgaacgcgatgccgtgtttggctttttatcgctgatcttctggctgctaatctttgtggtttccattaaatatctcaccttcgtgatgcgggcagataacgccggtgaaggggggatcctgacgttgatgtcgcttgccgggcgtaatacgtcggcgcgaaccacatcaatgctggtgattatggggctaatcggcggcagctttttctatggtgaagtcgtcattactcccgctatttcggtgatgtccgccattgaaggtctggaaatcgtcgccccgcagctggatacctggatagttcccctctcaattatcgttctcacattattattcatgattcaaaaacatggcacggctatggtcggtaagctgtttgcgccgatcatgctgacctggtttttgattctggcagggctggggttacgtagcattattgctaacccggaagtgctgcatgcactgaatccgatgtgggcggtgcatttcttccttgaatacaaaacggtttcttttattgcattaggggcagtggtgctgtcgattacgggggtcgaggcgctgtatgctgatatggggcactttggtaagttccctattcgtctggcgtggttcaccgtcgtattgccttccttaacccttaattacttcggccagggagcgctgttgttaaagaatccggaagcgattaagaacccgttcttcctgttggcaccggactgggcgctgatcccgctgctgatcatcgccgcactggcgacggtaattgcctcgcaggcggttatctctggcgtcttctcattgacgcgtcaggcggtacgtctgggatatttgtcgccgatgcgcattattcacacttccgaaatggagtcagggcaaatctatattccctttgtgaactggatgctctatgtcgcggtcgtgattgtgattgtcagctttgagcactccagcaacctggcggcggcgtacgggattgcggtgaccggaaccatggtgctgacgtctattctctcgactaccgtggcacgtcagaactggcactggaataagtattttgttgcgctgatcctgattgctttcctttgtgtcgatattcccttgttcaccgctaacctcgataaactgctctccggcggctggttgccattgagcctcggtacggtgatgtttatcgtgatgaccacctggaagagcgagcgtttccgcttgctgcggcggatgcatgaacatggtaactctctggaagcgatgattgcttcgctggagaaatcaccgcccgttcgcgtgcctgggaccgcggtgtatatgtcgcgtgcaatcaacgtcattccctttgcgctgatgcataacctgaaacataacaaggtattgcatgagcgggtgattctgttaactctgcgcaccgaagacgcgccatatgtccataacgtccgtcgggtacagattgaacaactgtcgcccactttctggcgcgtggtggcaagttatggttggcgagaaacgccaaacgtggaagaagttttccaccgctgcggtctggaaggattaagttgccggatgatggaaacctccttctttatgtcgcatgagtcgttgatcctcggcaaacgcccgtggtatttgcgtctgcgcggcaagctgtacttgctgctgcaacgtaatgcgctgcgggcaccggatcaatttgaaatcccgccaaacagagttatcgaactgggtactcaggtcgaaatctaacgccagacgcctcctttctccataagggggcgtttttgttttcatggttaatcaccatgtaaaacgtttcgaggttgatcacatttccgtaacgtcacgatggttttcccaactcagtcaggattaaactgcgggtcagcgaaacgtttcgctgatggagaaaaaaatgaaaaaaggcaccgttcttaattctgatatttcatcggtgatctcccgactgggacataccgatacgctggtggtgtgtgatgctggtttacccatccccaaaagtacaacgcgtatcgatatggcattaacccagggtgtaccttcttttatgcaggtgctgggtgtagtcacaaatgaaatgcaggtcgaggctgtcattatcgcggaagagatcaaacaacataatccgcaactccacgaaacgttgctcactcaccttgagcagctgcaaaaacaccagggaaacaccattgaaattcgttacaccacgcatgaacaattcaaacaacaaaccgcaggaagtcaggcggtaattcgcagcggagaatgttctccgtatgcgaatatcattctctgtgctggcgtgacgttctgaggccgtcatggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggtatctatactcgcgatgccggtacgcttttatggttggggaaagaaacgacatttaccgggccgaaatcttcccaggaagccgggattgggattatccaccaggaactgaacctgatcccgcagttaaccattgccgaaaacattttcctcggtcgtgagtttgttaatcgctttggcaaaattgactggaaaaccatgtatgccgaagcggataaattgctggctaaacttaacctgcgctttaaaagcgacaaactggtgggcgatctttccatcggtgaccagcaaatggttgaaatcgccaaagtgctgagctttgagtcgaaagtcatcattatggatgaaccgaccgatgcgctgaccgataccgaaaccgaatccttgttccgcgtcatccgcgagctgaaatcgcaaggccgcggtattgtctatatctcccaccgcatgaaagaaatcttcgagatttgcgatgacgttaccgtttttcgtgacggacaatttattgctgagcgcgaagtggcatcactgaccgaagattctctgattgagatgatggtgggccgcaagctggaagatcaatatccgcacctgaacaaagcgccgggagatatccgcctgaaagtcgataatctctgcggacctggcgttaacgatgtctcttttactttacgcaaaggcgaaattcttggcgtctctggtttgatgggcgctgggcgtaccgaactgatgaaagtgctctacggtgcactgccgcgcacaagcggttacgtcaccctggatgggcatgaagtcgttacccgttcgccgcaggatggcctggcaaacggcattgtttatatctccgaagaccgtaaacgtgacggtttagtgctgggcatgtcagtaaaagagaacatgtcgctgaccgcgctgcgctacttcagccgcgctggcggcagtttgaagcatgccgatgaacagcaggctgtgagtgatttcattcgtctgtttaatgtgaaaacgccatcgatggaacaggcaattggtctgctttccggtggcaatcagcaaaaagtagcgattgcccgtggtctgatgacacgccctaaagtgttgatcctcgatgagcctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaaaaaaatgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattcttcagcaaacctcggtgaacgccattatggcggtcgggatgacgctggtgatcctgacgtcgggtatcgacttgtcggtaggttctctgttggcgctgaccggcgcagttgctgcatctatcgtcggcattgaagtcaatgcgctggtggctgtcgctgccgctctcgcgttaggtgccgcaattggtgcggtaactggggtgattgtagcgaaaggtcgcgtccaggcgtttatcgctacgctggttatgatgcttttactgcgcggcgtgaccatggtttataccaatggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaatgaagcggcaacgcgtctttctggtatcaacgtcaataaaatcaaaatcatcgtctattctctttgtggtctgctggcatcgctggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaataacgactacaggacatcttgaatatgaacatgaaaaaactggctaccctggtttccgctgttgcgctaagcgccaccgtcagtgcgaatgcgatggcaaaagacaccatcgcgctggtggtctccacgcttaacaacccgttctttgtatcgctgaaagatggcgcgcagaaagaggcggataaacttggctataacctggtggtgctggactcccagaacaacccggcgaaagagctggcgaacgtgcaggacttaaccgtccgcggcaccaaaattctgctgattaacccgaccgactccgacgcagtaggtaatgctgtgaagatggctaaccaggcgaacatcccggttatcactcttgaccgccaggcaacgaaaggtgaagtggtgagccacattgcatctgataacgtactgggcggcaaaatcgccggtgattacatcgcgaagaaagcgggtgaaggtgccaaagttatcgagctgcaaggcattgccggtacatccgcagcccgtgaacgtggcgaaggtttccagcaggccgttgctgctcacaagtttaatgttcttgccagccagcctgcagattttgatcgcaccaaaggtttgaacgtaatgcagaacctgttgaccgctcatccggatgttcaggctgtattcgcgcagaatgatgaaatggcgcttggcgcgctgcgcgcactgcaaactgccggtaaatcggatgtgatggtcgtcggatttgacggtacaccggatggcgaaaaagcggtgaatgatggcaaactagcagcgactatcgctcagctacccgatcagattggcgcgaaaggcgtcgaaaccgcagataaagtgctgaaaggcgagaaagttcaggctaagtatccggttgatctgaaactggttgttaagcagtagttttaatcaggttgtatgacctgatggtgacataaatacgtcatcgacagatgaacgtgtaatataaagaaaagcagggcacgcgccaccctaacacggtggcgcattttatggacatcccgaatatgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaagctgtggctgctgggcgtagcggtgcgaataccgcgtttattgcctgtacgggtgatgacagcattggcgagagcgtacgtcagcagctcgccactgataacatcgatatttctccggtcagcgtgatcaaaggcgaatcaacaggtgtggcgctgatttttgttaatggtgaaggtgagaatgtcatcggtattcatgccggcgctaatgctgccctttccccggcgctggtggaagcgcaacgtgagcgtattgccaacgcgtcggcattattaatgcagctggaatcaccactcgaaagtgtgatggcagcggcgaaaatcgcccatcaaaataagactatcgttgcgcttaacccggctccggctcgcgaacttcctgacgaacttctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgataccattgctgccggagatacctttaacggcgcgttaatcacggcgttgctggaagaaaaaccattgccagaggcgattcgttttgcccatgcagccgctgcgattgccgtaacacgtaaaggcgcacaaccttccgtaccgtggcgtgaagagatcgacgcatttttagacaggcagaggtgacgcttggctacaatgaaagatgttgcccgcctggcgggcgtttctacctcaacagtttctcacgttatcaataaagatcgcttcgtcagtgaagcgattacagccaaagttgaagcggcgattaaagaactcaattacgcgccatcagctctggcgcgtagcctcaaactcaatcaaacacataccattggcatgttgatcactgccagtaccaatcctttctattcagaactggtgcgtggcgttgaacgcagctgcttcgaacgcggttatagtcttgtcctttgcaataccgaaggcgatgaacagcggatgaatcgtaatctggaaacgctgatgcaaaaacgcgttgatggcttgctgttactgtgcaccgaaacgcatcagccttcgcgtgaaatcatgcaacgttatccgacagtgcctaccgtgatgatggactgggctccgttcgatggcgacagcgatcttattcaggataactcgttgctgggcggagacttagcaacgcaatatctgatcgataaaggtcatacccgtattgcctgtattaccggtccgctggataaaactccggcgcgcctgcggttggaaggttatcgggcggcgatgaaacgtgcgggtctcaacattcctgatggctatgaagtcactggtgattttgaatttaacggcgggtttgacgccatgcgccaactgttatcacatccgctgcgtcctcaggctgtctttaccggaaatgacgctatggctgttggcgtttaccaggcgttatatcaggcagagttacaggttccgcaggatatcgcggtgattggctatgacgatatcgaactggcaagctttatgacgccaccattaacaactatccaccaaccgaaagatgaactgggggagctggcgattgatgtactcatccatcggataacccagccggccctacagcaacaacgattacaacttactccgattctgatggaacgtggttcggcttagatttacgctgtcttttgatcaaattattaccatcggttgttttcagtagcatgaacattgctgctgaagcaacagtaataatgcccatcgtgataaacgtatagtggaattgttcgactgtcgttgtgccttccatcccttcgtaaacgcgaaggacggccgcacttacagcaacgcctaaactgatagacagttgctgcgtgaccgccagaacactgttaccgctgctggcgttgtcatcggtcagatcggcaagtgtgatggtattcatcgcggtaaattgtgtcgacatagccatccctaatataaacaacggcaagatcagcatccatatcgccattgctggtgattgcaaagagaactgagcgatcattagccctataatcaccgtgatccccactaacgtatggcgatagcccagacgacgtaagacttgggtaaccatcgattttgcaataatggaacctaacgctgtcggtgccatcatacagccagcaataaacgcctgatacccaaatcctacctgtaacatcaatggcataaggaacggtacacagccggttcccagacgggttgcaatattgcctacgataccgatcgagaaagtgcgggttttaaataaatctaatgaaattaatgggtttggcgtgcgtcgcgcatggagaatatagagaagcagtaacccgatgctggtgacaattaccgtcaaggcaatccagctggcgacaatcttttccccgaatagctctattccgcttgagaagagaacaaggctgaggccaaacagcaaaaagccagtggtatcgaatctgcgtcgtgcggtgatgaaattgggcatatgtttgtgcgcgtaaagaaggcccgcaatacctatggggatattgattaaaaatatccagtgccaggttgcctaggtgaccagcacgccgccaagaacggggcctaaaattggccccaccagacccggcatggcgacaaaattcaatacaggaagaagttcattacgaggataagcgcgcagtaaggccagccgagcaacaggcatcatcattgcgccgcctatcccctgaataacccggaagacaaccagctgtggtagcgagttggaaagtgcgcaggccagagaacccaacgtgaacagactcacggcaagggtaaaaatgcgacgtgtaccgaagcgatcggctagccatccgcttaccggaataagcatcgccaccgtcagcgtataactgatgatggctgattgcatcgcgagaggagaacgattaaggctatgagcgattgcgggtaaggcggtattcagaatagtggcatcaagtgcctgcatgaagaaggccatcgccgcgatccacggcaaacccgccatactgcgcttctttttatcgctcattcaatgtcctgttatcgggttatcacttatctggtgagcgtagcagcgcctgacaagctttaaatgccgcgtcgccatcgctttggataatcgcatcgacaatcgcctggtgcagatccagctttatcactgtgtcgctggtaattgacgtgaagtaagtgtgataaaccgaatggaatagcgaggcgaatgaggtcaaaaacggattggcgctcatttcatagatatgctcatgccaggccatatcgacttcgatccagcgttcacggcgaaagttctcttttaatgccgccatttcggccattaacgtattgagatgcgccttctgttccgcggtgccaacctttgctgccagtaggcaagcttgcggctccagacagatacgcataaccagaaagtgatcgatgacctgatgaaagttctcttctgtcatccaccaggtaagcaattcctgatcaagaaaattccagttcgattgtggcatgactcgggtaccaattcgcggtcgcggtaaaaccatcccttttgccgttaacgttttgaccgcttcgcgtaccgctgtacgactcactccaaattgctcgcccagctcaatctcaccaggcaaaatggtgccgggttcatattcaccttttaagatccgctgcgccagcttctcagccagaacatacgaaaggtttttctgtgcagctaactgttgtgcgcttaaaggcattac

SEQ ID NO: 10020 - DNA, 56302 bp, Escherichia coli
gacgtgcggtgctggcaaacctgactgccggacgcacggtgcagggggcgagtacgctgacgcaacagttggttaaaaacctgttcctctccagcgagcgttcttactggcgtaaagcgaacgaagcctacatggcgctgatcatggacgcgcgttacagcaaagaccgtattcttgagctgtatatgaacgaggtgtatctcggtcagagcggcgacaacgaaatccgcggcttcccgctggcgagcttgtattactttggtcgcccggtagaagaattgagcctcgatcagcaggcgctgttggtgggtatggtgaaaggggcgtccatctacaacccgtggcgtaacccgaaactggcgctggagcgacgtaacctggtactacgtttgctgcaacagcaacaaattattgatcaagaactctacgacatgctgagtgcgcgtccgctgggtgttcagccgcgcggtggggtgatctctcctcagccagcctttatgcagctggtgcgtcaggagctgcaggcgaaattaggcgataaggtaaaagatctctccggcgtgaagatcttcactacctttgactcggtggcccaggacgcggcagaaaaagccgccgtggaaggcattccggcactgaagaaacagcgtaagttgagcgatcttgaaaccgcgattgtggttgttgaccgctttagcggtgaagttcgtgcgatggtcggtggttctgagccgcagtttgcgggctacaaccgtgcgatgcaggcgcgtcgttcgattggttcccttgcaaaaccagcgacttatctaacggccttaagccagccgaaaatctatcgtttgaatacgtggattgccgatgcgccaatcgcgctgcgtcagccgaatggccaggtctggtcaccgcagaacgatgatcgtcgttatagcgaaagtggcagggtgatgctggtagatgcgttgacccgttcgatgaacgtgccgacggtgaatctgggcatggcgttggggctacctgcggttacggagacctggattaaactgggtgtgccgaaagatcaactgaatccagttccagcaatgttgttgggggcgttgaacttaacgccaatcgaagtggcgcaggccttccagactatcgccagcggtggtaatcgtgctccgctttccgcgctacgttcagtcatcgcagaagacggcaaggtgttgtatcagagcttcccgcaggcggaacgcgctgttccggcgcaggcggcgtatctgacactatggaccatgcagcaggttgtacaacgcggtacgggtcgtcagcttggggcgaaatacccgaacctgcatctggcagggaaaacagggactaccaacaataacgtagatacctggtttgcgggcattgatgggagcacggtgaccatcacctgggtcggccgtgataacaaccagccgaccaaactgtatggtgccagcggggcaatgtcgatttatcagcgttatctggctaaccagacgccaacaccgctgaatcttgttccgccggaagatattgcagatatgggcgtggactacgacggcaactttgtttgcagcggtggtatgcgtgtcttgccggtctggaccagcgatccgcaatcgctgtgccagcagagtgagatgcagcagcaaccgtcaggcaatccgtttgatcagtcttctcagccgcagcaacagccgcaacagcaacctgctcagcaagagcagaaagacagcgacggtgtagccggttggattaaagatatgtttgggagtaattaacgtctaagcgtgatataccggatggcgagctgccatccggtaaaataacatcccctccaaagtattaaccctttcttttcatctgattgtttattgacccttcaggaatgcgcagattgcgtaccgcttgcgaacccgccagcgtttcgaatattatctcatctttataataatcattctcgtttacgttatcattcactttacaccagagaaataccaatggcaccttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggccggctgcaactattgcggcgcgacagtcagctaccggcactaaaaccgatacgccgattcaaaaagtacctcaatctatttctgtcgtcaccgctgaagagatggcgctgcatcagcctaagtcggtgaaagaagcgcttagctatacgccgggtgtctctgttggtacgcgtggcgcatccaacacctatgaccacctgatcattcgcggttttgcggcagaaggccaaagccagaataactatctgaatggcctgaagttgcagggcaacttctataacgatgcggtcatcgacccgtatatgctggaacgtgctgaaattatgcgtggcccggtttccgtgctttacggtaaaagcagtcctggcggtctgttgaatatggtcagcaagcgtccgaccaccgaaccgctgaaagaagttcagtttaaagccggtactgacagcctgttccagaccggttttgacttcagcgatgcgctggatgatgacggcgtttattcttatcgcctgaccggtcttgcgcgttctgccaatgcccagcagaaagggtcagaagagcagcgttatgctattgcaccggcgttcacctggcgtccggatgataaaaccaatttcaccttcctttcttacttccagaacgagccggaaactggttattacggctggttgccgaaagagggaaccgttgagccgctgccgaacggtaagcgtctgccgacagactttaacgaaggggcgaagaacaacacctattctcgtaacgagaagatggtcggctacagcttcgatcacgaatttaacgatacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacactctgctgaccggtgtcgactttatgcgtatgcgtaatgacatcaacgcctggtttggttacgacgactctgtgccactgctcgatctgtacaatccggtgaataccgattttgacttcaatgcgaaagacccggataactccgggccgtaccgcattctgaataagcagaagcaaacgggcgtttatgttcaggatcaggcgcagtgggataaagtgctggtcaccctgggcggtcgttacgactgggcagatcaagaatctcttaaccgcgtagcgggaacgaccgataaacgtgatgacaaacagtttacctggcgtggtggtgttaactacctgtttgataatggtgtaacaccatacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatcttactaaaaccaacaacctgatggcggaccctgagggttccttcttctcggttgaaggtggcgagatccgcgctcgtggcgtagaaatcgaagcgaaagcggcgctgtcggcgagtgttaacgtagtcggttcttatacttacaccgatgcggaatacactaccgatactacctacaaaggcaatacgcctgcacaggtgccaaaacacatggcttcgctgtgggctgactataccttctttgacggtccgctttcaggtctgacgctgggcaccggtggtcgttatactggctccagctatggtgatccggctaactcctttaaagtgggaagttatacggtcgtggatgcgttagtgcgttatgatctggcgcgagtcggcatggcgggctccaacgtggcgctgcatgtcaacaacctgtttgatcgtgaatacgtcgccagctgctttaacacttatggttgcttctggggcgcagaacgtcaggtcgttgcaaccgcaaccttccgtttctaatttctcttttggggcacggatttccgtgcccgtttcacaagttggctgttatgcaggaatacacgaatcattccgataccacttttgcactgcgtaatatctcctttcgtgtgcccgggcgcacgcttttgcatccgttgtcgttaacctttcctgccgggaaagtgactggtctgattggtcacaacggttctggtaaatccactctgctcaaaatgcttggtcgtcaccagccaccgtcggaaggggagattcttcttgatgcccaaccgctggaaagctggagcagcaaagcgtttgcccgcaaagtggcttatttaccgcagcagcttcctccggcagaagggatgaccgtgcgtgaactggtggcgattggtcgttacccgtggcatggcgcactagggcgctttggtgctgcagatcgcgaaaaggtcgaggaagctatctcgctggttggcttaaaaccgctggcgcatcggctggtcgatagcctctctggcggcgaacgtcaacgggcgtggatcgccatgctggtggcgcaggatagccgctgtctgttgctcgacgaaccgacctcggcgctggatatcgcccaccaggttgatgtactggcgctggtgcatcgtttaagtcaggagcgaggcctgacggtcattgccgtgctgcacgatataaatatggcggcgcgctactgtgattatctggtcgccctgcgcggcggtgaaatgattgctcagggaacgcctgcggaaattatgcgcggcgaaaccctcgaaatgatttatggcatcccgatgggtattctgccgcatccggcgggtgctgcacctgtgagttttgtttattgatgagcggcttacctcttatttcgcgccgccgactgttaacggcgatggcgctttctccgttgttatggcagatgaataccgcccacgcggcagttattgatcccaatcgtattgtggcactggagtggttgccggtggagttactgctggcgctcggcatcgtgccttacggcgtggcggacaccatcaactatcgcctgtgggtcagcgaaccgccattgccggactcagtgattgacgttggtttgcgtacagaacccaaccttgaactgctgaccgaaatgaaaccgtcgtttatggtctggtctgcaggatatggcccttcaccagaaatgctggcacgtattgcgccggggcgcggatttaacttcagcgacggcaaacagccactggcgatggcgcgtaaatcactgacggaaatggcagatttacttaacctgcaaagcgcagcggaaacgcatttagcgcactatgaagactttatccgcagcatgaaaccccgctttgtgaagcgtggtgcacgcccgttattgctgacgacgcttatcgatccgcgccatatgttggtcttcggtccaaacagcttgttccaggaaattctcgatgagtacggcatcccaaatgcctggcaaggggaaaccaacttctggggcagtaccgccgtcagtatcgatcgtctggcagcgtataaagacgttgatgtgctctgttttgatcacgacaacagcaaagacatggatgcgctaatggcaaccccgctgtggcaggccatgccgtttgtccgcgccggacgctttcagcgcgtacctgcagtctggttctatggtgcgacgctttctgcaatgcactttgtgcgtattctggataacgccatcggaggtaaagcgtgagtaaacgaattgcgctttttccggtgttattgctggcgctgctggtggttgctgctgcggcgttgacctggatgaacttctcgcaggcgctgccgcgcagccagtgggcgcaggccgcctggtcgccggatattgacgtcatcgagcagatgatttttcactacagcttgttgccgcgtctggcgatttcgctgctggtgggcgcgggcctggggctggtgggcgtgctgtttcagcaagtgctgcgtaacccgctggcggaaccgacgacattgggtgttgcaacaggcgcgcaactggggattaccgtcaccacgctctgggcaatccccggcgcgatggcgagccagtttgctgcgctggcaggggcttgtgttgttggcttaatcgtctttggcgtcgcgtgggggaaacggctttcgccggtaacgctgatcctcgcggggctggtagtgagcctttattgcggcgcaatcaatcagttactggttatcttccatcatgaccaactgcaaagcatgttcctgtggagcaccggaacgctgacgcaaaccgactggggcggcgttgagcgtttatggccgcagctgctgggcggcgtgatgctgacgttattgctacttcgcccgttaactctgatggggcttgatgatggcgtggcgcgcaatctcgggctggccttgtcgctcgctcgtctggcggcgttgtcgctggcgattgtcatcagtgcgctgctggtgaacgcggtggggattatcggctttatcggtttgttcgcgccactgctggcgaaaatgctgggggcgcggcgtttgttgccacggttgatgctggcatcgctgattggtgcgttaattctgtggctttctgatcaaatcatcctctggctgactcgcgtgtggatggaagtgtccaccggttcggtcactgcgttgatcggtgcgccgctgctactgtggttgctgccgcgtttacgcagcattagcgcgccggatatgaaggtgaacgatcgtgtcgcgactgaacgccaacacgtgctggcgtttgccctcgcgggcggcgtgctgctgttgatggctgtggtggtggcgctgtcgtttggtcgtgatgcgcacggctggacgtgggcgagcggggcgttgctcgaggatttgatgccctggcgctggccgcgaattatggctgcgctgtttgcgggcgtcatgctggcggtggcgggctgtattattcagcggctgaccggaaacccgatggcaagcccggaagtgctggggattagctccggcgcggcgtttggcgtggtgttaatgctgtttctggtgccgggtaatgcctttggctggctgttacccgcaggcagtctcggggcggcggtgacgctgttgatcattatgatcgccgccggacgtggtggattttccccacaccgcatgttactggcggggatggcgttaagtaccgcgttcaccatgcttttgatgatgttgcaggcaagtggtgacccgcgaatggcgcaagttctgacctggatttccggttcgacctacaacgcgaccgatgcgcaggtctggcgtaccggaattgtgatggtgattttgctggcgattaccccgctgtgccgccgctggctgaccattttaccgctgggtggtgataccgcacgagccgtggggatggcgctgacgccgacgcgaattgcgctgctgctgttagcggcttgcctgacggcgaccgcgacaatgaccattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatccccgcggggctgctgtcgacctttatcggcgcgccatattttatctatttgttgagaaagcagagccgttaattgaatgcctcgcccggtgggcgaggcaaaatcatcacaacttcgcaaacacccgacgtgcagcatcgatggtgttattgatatcttccatgctgtgcgccacagacataaaacccgcttcaaacgctgacggtgccagataaacaccttcgtccagcatcatatggaagaaacgcttaaaacgttccacgtcacaggccatcacatcctgatagcacgtcacggactcggcgtcggtaaagaaaataccgaacatgccgccaacgtggtttaccaccagcggaattccggcttcttctgccgcttcccgcagaccttctgccagacgtgttgtcagctcatccagcgtctcgtgaacgcccggctgtgcgacttcattcagacaggcgaaaccagcagccatcgcaatcgggttaccggaaagcgtacccgcctgatagaccggaccggtcggggccagcgcatccattacatcacgacgaccaccgaatgcgcctaccggcattccaccgccgatgattttgccgaggcaggtgagatccggttccacaccgtaataatcctgtgcgccagctagcgctacgcggaaaccggtcatcacttcatcgatgatcagcaacgcgccaaattcgtcgcacagcgcgcgcagacctggcaggaactctggcagcggtggaacgcagttcatattgcctgccaccggctcgacgataatacaggcaatctcttgcgggtattgctcaaacgcggcgcgtacagaggccagatcgttataagtacaggttaaggtatgtttggcgaaatctgccggaacgcccggcgaatttggctggcctaacgtgagtgcgccagaaccggctttcaccagcaggcagtcagcgtgaccgtggtaacaaccttcaaatttaataattttgtcgcgaccggtaaaaccacgggccaggcggatggcgctcatcgtcgcttcagtgccggagttcaccatgcgcaccatatccatggtcgggaccagttcggtcaccagttgcgccattttcacttccatttcggttggtgcaccaaagcttaaaccacgctcggcggcttcaatcacggcattgcggatcgccggatggttatggcccagcaccatcggcccccaggaaccgacataatcgatataggctttgccatcaacatcgtacagataagcgccgtccgctttttcgataaacagtggagtgccgcccacgccagtaaaggcgcgaacaggggagttcacaccgccagggatcagctcgcgcgctgcgctgtaaagattttcagacttactcatggagggttcctgattcgtagaaaaagtgaatggctgctattctatgttattcataacaagttaaatactcgtcaaacatcaggctgcttgtactggtgcaatcctgatttcttagagtataaaagttttgtgcatttgaaacattacgctttgcaaaggattttcatggaacgtgcgagtaaaatgccgtcatcttatttgtatgaccaataagtgatcattggatgaaaactgatactccctctttagaaacaccgcaggccgcgcgcctgcgacgcagacaactgattcgccaacttcttgagcgcgataaaaccccgttagccattttgtttatggcggcagtcgtcggcacgcttgtcgggctggctgcggttgcttttgacaaaggtgtcgcctggttgcagaaccaacgtatgggggcactggtacatactgctgataattatccgcttctgttaaccgtcgcttttctctgttcggcggtgctggcgatgttcggctactttttggtgcgcaaatacgcgccggaagcaggtggttcggggatcccggaaattgaaggggcgctggaagatcaacgtcccgttcgctggtggcgtgtgttgccggtgaaattctttggcgggctgggaacactcggcggaggcatggtgttggggcgcgaagggccaaccgtgcagataggcggcaatatcgggcggatggtactcgatgttttccgcctgaaaggtgacgaagctcgtcatacgctgttggcaaccggtgctgctgcggggctggctgcggcctttaacgcgccgctggcgggtattttgtttattatcgaagagatgcgtccgcagtttcgctatacgttaatttcgattaaagcggtatttattggcgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggtggcaatattaccaaatgggtactgatgggcggtgcgattggcggtctgtgtggattgctggggtttgtggcaccagcaacttcgggcggcggttttaacctgattcctatcgctaccgcggggaatttcagcatgggaatgctggtgtttatcttcgtcgcgcgggtcattaccactttactctgcttctcttccggcgcgccgggcggtatttttgccccgatgctggcgctgggtactgtgctgggaaccgctttcggaatggttgccgttgagttgtttccgcaatatcaccttgaggcggggacgtttgctattgccggaatgggggcgttactggcggcatctattcgcgcgccgttaacggggatcattctggttctggaaatgaccgataactaccagctcattttgccaatgattattaccggtcttggcgcaacactattagcacaatttaccggtgggaaaccgctatactcggcgattcttgcgcgcacgctggcaaaacaggaagctgagcaactggcgcgaagcaaggccgcatcagcccgcgagaatacttgaacgaaataccagggtattagataatggcgattattattgggttagaatttgcccaattgccgatgtcgtttggagcaaaatatgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgactataccgaaggtctggaaggttctcgtttcatcgtgaccaacccgaacgcgaaaagtacctgcggttgcggttcttcctttagtatctaatctgctgttcatgtgccggataaactatccggcacatctcctctcttcaacgaccattctcatccagcgcaaacgtcggtagcttaagatgccaacgaatagccgccagccgaatcaatagcgtcacgaccatgcccatcatactggctgtttccagtggtacggaaaatgtgtaataagccgtagcgtggacaataccgccgataatacaggcagttgcgtagatttctgtacgtaaaatcatggggatttcgcgggccagtacatcacgaatgatcccgccgccaacgccagtaatgacgcccatacaaaccgcgattaacggaccggcttccgcattaaaggctttattcacgccaatgccgacaaacaccgccagaccaacggcgtccagcaccggcaacatccattttggtaagcgtcttggctggcgcaccagcacgatggtcagcatgctggtgaccattgcaacgaccagatcggtgggatctttcacccaaaataccgggccgtgatccagcgccatgtcgcgaattgttccgccgcctactgcggtaaccacgcccaataccagaacaccaaaagggtccatacgcaattttccggctaacaaaacgccagagatagcaaataccgctgtgccgactatatccagccaatagacgagcattgttcaatccccactgagcacctgaaaaggtcaggcactaatctacctgtgaaagcgcattacagagctgttgtgcagcgaggataatacgtgggcttgcacgttcaaaccagtcactcgtgagaggaataacgggaattttgagctgttcaccccagtattgtttgattttaggaatttggtccggtccgcctgtaatgacaatcgcctgtggcgagcgtgctaacacctgttcgcggctaacttgcggccagggaacccggctgtctttaaagatgttttctccgccacaaacttcgagtacctggttctgaatcgactcttttccactggtaaatggcggattaatgccgaattgcagaaaaacacgttttttaggtttatcagcatattgcgctttcaattgcgcgtactgatccagcagggattgcgcggcttgttcggccttatccggttgcggactccagggggccagttgacgtaacgcattggcaatttgttcaatgcttgtcgcatcgacccacatcacttttattcccagcgaagccagctggtcaacctgccgctcggcattacctccacgccaggcaatcaccagatcgggtttcagcgcgacaatgcgttccagattcatcccctgccaggtggaaacctgcccaatcttttgcgcttgtggaggatagtcggaatagctgctgaccccaaccggcgtgatcccggcggcaaaggcaagttcagtgttggcgggagaaagcgtgatgacgcgcggcgcggcattgagccacagcggcgcgagaaaagacagggcgaccagcgccctgaacagtgacttagccatgtgccagtttctgcaccagtgactcaaccatcaggctggactgtttagcggcaacagccaggaactcatcgaagctaagatgagactgttgatcggccacgtcggagatggcgcgtactacgacaaacgggacgttgaaattgtggcagacatgggcgattgccgtcgcttccatctctacagcaatggcctgtgggaagttgtggcggattttcgccagaccaacagaaccgttgatgaaagcgtcgccgctaacaatcaggccacgtacagcgttaagattcagttcggcaatgcaggcctcagcggcagcgatcagtttatcgtcagctttgaagcctgccgggcagcctggtaactgaccgtattcataaccaaatgccgtgacatccgcgtcgtgataacgcgcttcgtccgagacaacgatatcgcccactttcagcgttggtgccaggccaccggcagaaccggtgttaataatcacatctggcttgcagtgttccaacagcaaagtggcacccagcgccgcagcgactttaccgatgcccgatttcagaagcgcaacctcggttccattcagttggccggtatagatttcgcaaccgcccagactgatagtttgacggttttcgattttgtcacgcagcagcgtaacttcttcttccattgcaccaatgatgccgattttcatagatttactcgcgataagcccgatttgaaggcatagtttaccatgcgcttacggggaagcgtatttctcacgcgggagaggacatggcacagattgatttccgaaaaaaaataaactggcatcgtcgttaccgttcaccgcagggcgttaaaaccgaacatgagattctgcggatcttcgagagcgatcgcgggcgtatcatcaactctccggcaattcgtcgtctgcaacaaaagacccaggtttttccactggagcgcaatgccgccgtgcgcacgcgtcttacccactcgatggaagtccagcaggtggggcgctacatcgctaaagaaattttaagccgtttgaaagagcttaaattactggaggcgtatggtctcgatgaactgaccgggccctttgaaagcattgttgagatgtcatgcctgatgcacgatatcggcaatccgccgtttggtcattttggcgaagcggcgataaatgactggtttcgccagcgtttgtacccggaagatgccgaaagccagcctctgactgacgatcgctgcagcgtggcggcactacgtttacgggacggggaagaaccgcttaacgcgctgcggcgcaagattcgtcaggacttatgtcattttgaaggtaacgcacagggtattcgtttggtgcatacattgatgcggatgaatctcacctgggcacaggttggcggtattttaaaatatacccgtccggcgtggtggcgtggcgaaacgcctgagacacatcactatttaatgaaaaagccgggctattatctttccgaagaagcctatattgcccggttgcgtaaagaacttaatttggcgctttacagtcgttttccgttaacgtggattatggaagctgccgacgacatctcctattgtgtggcagaccttgaagatgcggtagagaaaaggatatttaccgttgagcagctttatcatcatttgcacgaggcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctatgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcagcttgaattgcagggctatcgggtcattagcggattattagagatttatcgtcctttattaaacctgccgttatcagactttactgaactggtagaaaaagaacgggtgaaacgtttccctattgaaacgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataaccaggcttttgtaaagacgaacaataaatttttaccttttgcagaaactttagttcggaacttcgcgctataaaacgaatctgaagaacacagcaattttgcgttatctgttaatcgagactgaaatacatgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggagggttctccgttccagagctctccgttctgccaggggggcctgggcggtaatggcggcggccagcaacagaaattcatggcgctgggttccggcgttatcattgatgccgataaaggctatgtcgtcaccaacaaccacgttgttgataacgcgacggtgattaaagtccaactgagcgatggtcgtaagttcgacgcgaagatggttggcaaagatccgcgctctgatatcgcgctgatccagatccagaacccgaaaaacctgaccgcaattaagatggcggattctgatgcgctgcgcgtgggtgattacaccgtagcaattggtaacccgttcggcctgggcgagacagtaacttccgggattgtctctgcgctgggacgtagcggcctgaacgctgaaaactacgaaaacttcatccagactgatgcagcgatcaaccggggtaactcaggtggtgcgttggttaacctgaacggcgaactgattggtatcaacaccgcgattctcgcaccggacggcggaaacatcggtatcggttttgctatcccgagcaacatggtgaaaaacctgacctcgcagatggtggaatacggccaggtgaaacgtggtgagttgggtattatgggcactgagctgaactccgatctggcgaaagcgatgaaagttgacgcccagcgcggtgctttcgtaagccaggttctgccgaattcttccgccgcgaaagcgggcattaaagcgggtgatgtgatcacctcactgaacggtaagccaatcagcagctttgccgcactgcgtgctcaggtgggcactatgccggtaggtagcaaactgaccctaggcttactgcgcgacgggaagcaggttaacgtgaacctggaacttcagcagagcagccagaatcaggttgattccagcaccatcttcaacggcattgaaggcgctgagatgagtaacaaaggcaaagatcagggcgtggtggtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactgaacattcagcgcggcgacagcaccatctacctgttaatgcagtaatctccctcaaccccttcctgaaaacgggaaggggttctccttacaatctgtgaacttcaccacaactccatacatcttcatcatcctttgggcatttgcacaatgccgtacgttacgtacttccttatgctaagccgtgcataatggaggacttatggctggcatcttgataccaaaatggcgcaggatatcgtggcacgtaccatgcgcatcatcgataccaatatcaacgtaatggatgcccgcgggcgaattatcggcagcggcgatcgtgagcgtattggtgaattgcacgaaggagcattgctggtactttcacaaggacgagtcgtcgatatcgatgacgcggtggcacgtcatctgcacggtgtgcggcaggggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacctgttggcgcaggatagccgtttgcgggaagaactggtgatgaacctcattcaggctgaggagaatactcccgcacttactgaatgggcgcaacggctggggatcgatctcaatcaaccgcgagtggtggctattgttgaggtcgacagcggtcagcttggcgtggacagcgcaatggcggagttacagcaactgcaaaatgcgctgactacgcccgagcgtaataatctggtggcgattgtctcgctaaccgaaatggtggtgttgaaaccggcgttgaactcttttgggcgctgggacgcagaagatcatcgtaagcgagttgaacaactgattacccgcatgaaagagtatggccagctgcgttttcgcgtttcgctgggcaactattttaccggtcctggcagtattgcccgatcctatcgtacggcgaaaacgacgatggtggtgggtaaacagcggatgccagaaagtcgctgctatttttatcaggatctgatgttacctgtgttactcgacagtttgcgtggcgactggcaggccaacgaactggcgcgaccgctggcgcggctgaaagcgatggacaataacggcttgctgcggcgaactctggcggcgtggtttcgccacaatgtgcaaccgctggcaacgtcaaaggcgttgtttattcatcgtaatactctggaatatcggcttaatcgtatatcggaactgaccgggcttgatttgggcaattttgatgacaggttgctgctgtatgtggcgttacaactggatgaagagcggtaggtcgattacaaaattacagccgggtgagactttacccggcccacagaatggcattatttacgcgtcagtttttccagatcggcttcaatctcgctgatcttattggttactactgactccaggtgacgtaagtcgtcgaggatcttacgcttaagatcaacttcgctgcggtcacgctggcagatttgatcaagctcatcaatgatataccgtagattcgggctaatttcctggacttctttataaccctgacccacaccatcagcgacgaccgttttacgctgacgcgggtatttaaacttcacgctcttggcgaaaaactcgcctttgtctttctggaaatagattttcagaatatcgttgttggcttcctgccggaggctgtaacgatcaatttcttcaggattggtaatacccagacttttcagattgtcgtacatagtgttacctcaaaatgagtcagtaaattgtgcttattttagcatttggcctggcccgcccggctcgactgtgatcgcagaaagcctttttcttccagacttctatcatggcgtaaaaatcaaaaaattacctgctttattgtggtgatattccatgggatggattagcacatttatcttcattttgcgaattacatgacagtccgaaacaagatgaaaaagtatttaaaaaaaagggggaaaatgagtaggacgaattattctgagccagaaagcaatcgggcagcgtcgtgctgcccgtgtacatacttttagtcgatggtacgcagcagttcgttaataccaactttaccgcgagttttcgcgtcaactttcttaacgataactgcacagtagaggctgtatttgccatctttcgacggcagattacctgaaacaaccacagaccccgccggaacgcgaccgtagtggatttcgccggtttcacggtcataaatacgggtgctctgaccaatgtatacgcccatagagatgacggaaccttcttcgacaatcaccccttcaaccacttcagagcgtgcgccgatgaagcagttatcttcaataatggtcgggttagcctgcagcggctccagcacgccgccgatacccacgccaccggaaaggtggacgtttttaccaatctgcgcacaggaaccgacggtcgcccaggtatcaaccatggtgccttcatcaacatatgcgccgatgttgacgtaagacggcatcagcacggtgttacgggcaatgaacgcgccctgacgcactgccgctggtggcacgacgcggaagccttctttctggaaacgtgcttcatcgtagttagcgaatttcatcggcactttgtcgaagtagcggctttctgccccttcgatcacctgattatcattaatacggaaagagagcagcaccgcttttttcaaccactgatgcgtcacccactgaccgtcaattttttccgctacacgcagtgcgccggaatccagcagggcgatcacctgatttaccgcttcgcgggtaacggtgtctgcattggctggcgtgatctcggcacggcgttcaaaagcggtttcaataatgttctgtaactgctgcattgttaaactcttttcatatcagtaaacacatcaccctttatcgtttggattgagggcctctgtcaaccgctgatgcacttcctgctgcaactcgttattaagcgcacgccggtcagcggtggcaattatgaataaatcttctactcgctcgccaatggttgtaattcgggcgccatgaagcgaaattcccagatcggcaaaaattttcccgactcgcgccagcagtccaggttggtcgagggcgatcagttcgaggaacgatttgcggtcggtatgggtcggcaaaaacgtcacttcggtttcaacagtaaaatggcgcaatttggcgggttggcgacggggctgcggtggctgccagctactttgtgtcagtacttgctccagaccaaaccgaataacctcatgacgatctgcggatagcgggctaccatcgggttccagcactataaaggtatccatcgccataccgtcgcgagtggtgaaaatttgtgcgtcgtgaacacttaaattgcggcggtctaattcggcacagacggcggcaaacagataggggcggtccgggctccagataaaaatctcggtgcctccacgcgtagcctgcgggctaagcagtaccagcggtttgcttaaatcatgctgtaataaatggcgtgcgtgccaggccagttgatttgggctatggcggacaaaatagttagcgcgacagcgtgaccaaatttggtgcagcgcctcttcgtcgatgttatccatgcgcagtagtgccagcgcctggagttggtgatggcgaacccgttcgcgcatatccggcgtgttttgcattccgcgtcgtagctgcttttcggtggcaaaatagagttcgcgcaacagactttgcttccagctattccacagtgtttcgttggtggcgcaaatgtcagccactgtcaggcataccagatagcgcagacgattttccgtttgaacttcttcggcaaattgcttgatgacttccgggtcctgaatatcgcggcgctgagcggtcaccgacatcagcaagtgctggcgaaccagccatgcgaccagctgtgtttcgcgtgagttcagcccgtggagttcggcaaaatgcactacatcctgagcaccgagaatggagtggtcgccgccgcgtcctttggcgatatcgtgaaacagcgcggcgatgaaaatcagctcagttgacggcaggcgcggccagacgtccacacacaacggatggcgctggcgcgtttcttcactggcaaaactctccagtttcagcatcacgcggatagtatgttcatccaccgtgtaggcatggaacaggtcaaactgcatctgcccgacgatatgcgaccattgcggcatatacgcgccgagcacgctatggcgatgcattggcaatagcccgcgccgcaccgctccggggtgacgcagaatgctcaaaaacagttttcgcgcttccggaatattacacagaggttgttgcagatggcgacgggcgtggcgtaactggcgtagcgtggtggagtaaatgccggtgatcgcactgttgcgcaccatggtgtagaacatacgcaagatggcttccggctggcgcataaatagtgtttcatcacgcaggtcgatcagcgttccgcgtagctgaaactcatcgtcgattggacgtggtttttcgtcggcgggaagggcgaggatggcttcatcgaacagttgcagcagcatctggttgagttcactgacgcggcgtgtaacgcggaagtaatccttcatcatccgctcgaccggttcgttaccttcaccactgtaattcaaacgctgggcgacgctaagctggcgatcgaataacaggcgattatcgtaacgactgacgaccagatgcagggcaaagcgaatgcgccacaatatatgcaggcattcgtttaattccgctctctccgcagaggttaagaagccaaaccctaccatttcatccagcgatgttgctccaaaatgacggcgggccacccattgcagagtgtggatatcgcgcaagccgccggggctacttttgatgtctggttcaaggttgtagctggtgccgtggtaacgctgatggcgctggttctgttcttcaactttcgccgcgtagaacttgtcggaaggccagaatccttcgctaaaaatatgtttttgcagttcgaggaacagcgcaacatcgccaattaataagcgggattcgattaaattggtggcgacggttaaatccgataacccttccagcatgcactcttcaagcgtgcgcacgctatgacctacttccagctttacatcccagagcagtgttaacagctcgcccactttttgcgcctgatcgtccgggagctttttacggcttaaaatcagtaaatcgatgtcagaaagtggatgcagctcgccacgaccgtagccaccgacggcgaccaatgccaggtcggcaatctggctgaatcccgcttcaatccataatcgttgaagaagctggtcgataaactcggtacgcgcctcaatcaactgttctgcggagataccattgtcaaaggcatcacccagccaacgctggaaagtatcgatatgggcttttatcccaccgacggttaattcatcacggggccaggcgcatggattttgcggttgaccggacagggtggggagagcggtgtttgcgtactgttctggaagggtattcattgtgcgccacccataagattaaattattgcattaaaaaagccggcattcgccggcttcattttattcgtcgtgcgagattatcgccgggatggtgtcatccttgcgtagcgtcagaatttcgcagccgttatcagtcaccacaatagtatgctcatattgtgcagacaagctgcgatctttggtttttaccgtccagccatctttcatggtgcggatctcttttttacccgcgttgaccattggctcgatggtgaacgtcatccccggtttcagcacgacgttggtttcacgggagtcatagtgcagcacctgcggttcttcgtggaagccgcgaccaataccgtgtccacaatattcacgaacgacggagaagccttctgcttcgacaaatttctgaattgccgcaccgatttcgcgcagattaatgccaggttttaccatgcgtagcgccaggtacaggctttcttgcgtgatgcggcacagacgttcgcccatgatggtcggcttaccgacgataaacattttcgaggtatcgccgtggaaaccatctttgattacggtgacatcaatgttaacgatatcgccatctttcagcagcttggcgtcgtccgggataccgtggcacaccacttcattaatagagatgcaaacggatttcggatagccgtgatagccgaggcaggcagaaaccgcgtgttgttcattaacaatgtaatcattacagatgcgatccagctcgccggtgctgacgcccggtttaacatacggttcgatcatctccagcacttcggcagccagtcggccagcgacgcgcattttttcgatatcttctggggtcttgattgagatagccattaattctgtccatcagcgtcggtgataccgacaatatatatgtaagtgccgtcaatggtatcacacccgggcaaattgagaatcattctgaatttcgccaaacgtgccactgaaggttttctataatagaaaattcaacgtctgatgctgtacacagcgccaacaattattggtgtccacgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgtgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgacaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaggcaaacaacctgggtattccggtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaataaggcacgctcgtacgagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagtactgaaagcacagttcgaagaagaacgtgttgcgctggtagcgaaaattggtgaaaacatcaacattcgccgcgttgctgcgctggaaggcgacgttctgggttcttatcagcacggtgcgcgtatcggtgttctggttgctgctaaaggcgctgacgaagagctggttaaacacatcgctatgcacgttgctgcaagcaagccagaattcatcaaaccagaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcagcagaagttgctgcgatgtccaagcagtcttaattatcgaaaaggagccgcctgagggcggcttctttttgtgcccatcttgtaaattcagctaacccttgtggggctgcgctgaaaagcgacgtacaatgtcgctagtattaattcatttcaatcgttgacagtctcaggaaagaaacatggctaccaatgcaaaacccgtctataaacgcattctgcttaagttgagtggcgaagctctgcagggcactgaaggcttcggtattgatgcaagcatactggatcgcatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttactgctgatccggcgaaagatccaaccgcaaccatgtacgagcaactgacttacagcgaagtgctggaaaaagagctgaaagtcatggacctggcggccttcacgcttgctcgtgaccataaattaccgattcgtgttttcaacatgaacaaaccgggtgcgctgcgccgtgtggtaatgggtgaaaaagaagggactttaatcacggaataattcccgtgatggataaataagggtaagattccgcgtaagtatcgcgggggatcttacccgtaatatgtttaatcagggctatacttagcacacttccactgtgtgtgactgtctggtctgactgagacaagttttcaaggattcgtaacgtgattagcgatatcagaaaagatgctgaagtacgcatggataaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtactctgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaatgtgcgtcgtgacgcgaacgacaaagtgaaagcactgttgaaagataaagagattagcgaagacgacgatcgccgttctcaggacgatgtacagaaactgactgatgctgcaatcaagaaaattgaagcggcgctggcagacaaagaagcagaactgatgcagttctgatttcttgaacgacaaaaacgccgctcagtagatccttgcggatcggctggcggcgttttgctttttattctgtctcaactctggatgtttcatgaagcaactcaccattctgggctcgaccggctcgattggttgcagcacgctggacgtggtgcgccataatcccgaacacttccgcgtagttgcgctggtggcaggcaaaaatgtcgctcgcatggtagaacagtgcctggaattctctccccgctatgctgtaatggacgatgaagcgagtgcgaaacttcttaaaacgatgctacagcaacagggtagccgcaccgaagtcttaagtgggcaacaagccgcttgcgatatggcagcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgccatttttcagagtttaccgcaacctatccagcataatctgggatacgctgaccttgagcaaaatggcgtggtgtccattttacttaccgggtctggtggccctttccgtgagacgccattgcgcgatttggcaacaatgacgcccgatcaagcctgccgtcatccgaactggtcgatgggacgtaaaatttctgtcgattcggctaccatgatgaacaaaggtctggaatacattgaagcgcgttggctgtttaacgccagcgccagccagatggaagtgctgattcacccgcagtcagtgattcactcaatggtgcgctatcaggacggcagtgttctggcgcagctgggggaaccggatatgcgtacgccaattgcccacaccatggcatggccgaatcgcgtgaactctggcgtgaagccgctcgatttttgcaaactaagtgcgttgacatttgccgcaccggattatgatcgttatccatgcctgaaactggcgatggaggcgttcgaacaaggccaggcagcgacgacagcattgaatgccgcaaacgaaatcaccgtggctgcttttcttgcgcaacaaatccgctttacggatatcgccgcgttgaatttatccgtactggaaaaaatggatatgcgcgaaccacaatgtgtggatgatgtgttatctgttgatgcgaacgcgcgtgaagtcgccagaaaagaggtgatgcgtctcgcaagctgaggataatccggctacagagagtcgcgctatttgttagcgtagggcttcagtgatatagtctgcgccatctgatcgtaagtagttggctttataaggtcaggtatgccgtggttttacacggcttttttttgtataggcttcagtattcctgagtaccgtaaaccctgtcagggaataagaaacgcgtgatgttgtctgctactcaaccacttagcgaaaaattgccagcgcatggctgtcgtcatgttgcgatcattatggacggcaatggtcgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctagatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccattgtaacgctggtggtctgtatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgcattatttttggcgtgctaaccattgttcccttcttctggggcatgctggcgttacgggcctggcactacgacgagaatcattacagtggcgcaatatggctgctctatgtcatgatcctggtatggggcgctgactctggcgcatatatgtttggcaaattgtttggtaaacataaactagcaccgaaggtttctccgggtaaaacctggcaaggctttatcggtggactagtgaccgcagcggtaatctcatggggttatggcatgtgggtgaatctcgacgtcgctcccgtcaccttactcatttgctctattgtcgcagcgttagcctcagtgctcggcgatctgaccgaaagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgcaggtccggttgcaaacttcatttttgctatctttgcctactggctggtttttattattggtgtgcctggcgtacgtccggtggttggtgaaatagcagccaattcgatagctgcggaagcacaaattgcaccaggtacggaactaaaagccgtagatggtatcgaaacgcctgattgggatgccgtgcgtttgcagttggtcgataaaattggcgatgaaagcaccaccattacggtagcgccatttggcagcgaccaacggcgggatgtaaagctcgatttacgtcactgggcgtttgagcctgataaagaagatccggtatcttcgttggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaagggtaaagcgattggttttgtcggtattgagccgaaagtcattcctttgccagatgagtataaagttgtacgccagtatgggccgttcaacgctatcgtcgaagccacggacaaaacgtggcagttgatgaagctgacggtcagtatgctgggaaaattgatcaccggtgatgtgaaactgaacaacctcagtgggccgatctctatcgccaagggggctgggatgacagcggaactcggggtagtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatgagagttagttaggaagaacgcataataacgatggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacacggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgttaaagctgtcgtgaccccgctgccgcgcaaccgtgttgacctaaaactggtgttccaggaaggtgtgtcagctgaaatccagcaaattaacattgttggtaaccatgctttcaccaccgatgaactgatctctcatttccaactgcgtgacgaagtgccgtggtggaacgtggtaggcgatcgtaaataccagaaacagaaactggcgggcgaccttgaaaccctgcgcagttactatctggatcgcggttatgcccgtttcaacatcgattctacccaggtcagtctgacgccagataaaaaaggtatttacgtcacggtgaacatcaccgaaggcgatcagtacaagctttctggcgttgaagttagcggcaatcttgccgggcactccgctgaaattgagcaactgactaagatcgagccgggcgagctgtataacggcaccaaagtgaccaaaatggaagatgacattaaaaagcttcttggtcgctatggttatgcctatccgcgcgtacagtcgatgcctgaaattaacgatgccgacaaaaccgttaaattacgcgtgaacgttgatgcgggtaaccgtttctatgtgcgtaagatccgttttgaaggtaacgatacctcgaaagatgccgtcctgcgtcgcgaaatgcgtcagatggaaggtgcatggctggggagcgatctggtcgatcagggtaaggagcgtctgaaccgtctgggcttctttgaaactgtcgataccgatacccaacgtgttccggggagcccggatcaggttgatgtagtttacaaggtgaaagaacgtaacactggtagcttcaacttcgggattggttacggtactgaaagtggcgtgagcttccaggctggcgtgcaacaggataactggttaggtacaggttatgctgttggtatcaacgggaccaaaaacgattaccagacctatgctgaactgtcggtaaccaacccgtacttcaccgtagatggtgtaagcctcggtggtcgtctcttctataatgacttccaggcagatgacgccgacctgtccgactataccaacaagagttatggtacagacgtgacgttgggcttcccgatcaacgaatataactcgctgcgtgcaggtctgggttatgtacataactccctgtccaacatgcagcctcaggttgcgatgtggcgttatctgtactctatgggtgaacatccgagcacctctgatcaggataacagcttcaaaacggacgacttcacgttcaactatggttggacctataacaagcttgaccgtggttacttcccgacagatggttcacgtgtcaacctgaccggtaaagtgaccattccgggatcggataacgaatactacaaagtgacgttagacacggcgacttatgtgccgattgatgacgatcacaaatgggttgttctgggtcgtacccgctggggttatggtgatggtttaggcggcaaagagatgccgttctatgagaacttctatgccggtggttccagcaccgtgcgtggcttccagtccaataccattggtccgaaagcagtttacttcccgcatcaggccagtaattatgatccggactatgattacgaatgtgcgactcaggacggcgcgaaagatctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaagtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaatatgggcagcctgttccagcaggtagcgcagaaaaccggtgtttctaacacgctggaaaacgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaatgccgttgcttacaacagcagcgatgtaaaagacatcactgccgacgtactgaaacaggttaaataagtaatgccttcaattcgactggctgatttagcgcagcagttggatgcagaactacacggtgatggcgatatcgtcatcaccggcgttgcgtccatgcaatctgcacaaacaggtcacattacgttcatggttaaccccaaataccgtgagcatttaggcttgtgccaggcgtccgcggttgtcatgacccaggacgatcttcctttcgcgaaaagtgccgcgctggtagtgaagaatccctacctgacttacgcgcgcatggcgcaaattttagataccacgccgaagcccgcgcagaacattgcacccagtgcggtgattgacgagacagcgaagctgggtaacaacgtatcgattggcgctaacgcggtgattgagtctggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgtctgatccagtccggaacagtggtaggcgcagacggctttggttatgccaacgatcgtggtaactgggtgaagatcccacagattggtcgcgtaattattggcgatcgcgtggagatcggtgcctgcactaccattgatcgtggcgcgctggatgacactgttattggcaatggtgtgatcattgataaccagtgccagattgcacataacgtcgtgattggcgacaatacggcagttgccggtggcgtcattatggcgggcagcctgaaaattggtcgttactgcatgatcggcggagccagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaacgttccatcttttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgacggtaaagtagtttgcgaagcaacgatgatgtgtgctcgtagccgggaggcctgatacgtgattgataaatccgcctttgtgcatccaaccgccattgtggaagagggcgcgtcgattggcgcgaacgctcacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgcgtggaaatcggcgatcgtaaccgcattcgcgaaagcgtcaccattcatcgtggcacagtccagggcggtggattgacgaaggtgggcagcgacaacttactgatgatcaatgcgcacattgcgcacgattgtacggtaggtaaccgctgcatcctcgccaacaacgcaacgctggcgggtcacgtatcggttgacgacttcgcgatcatcggcggcatgaccgcagtccatcagttctgcatcattggtgcgcatgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaatgactgaacagcgtccattaacgattgccctggtcgccggagaaacctccggcgatatcctgggggccggtttaatccgcgctctgaaagaacgtgtgcccaacgcccgctttgttggtgttgccgggccacgaatgcaggctgaaggctgcgaagcctggtacgaaatggaagaactggcagtgatgggcattgttgaagtgctcggtcgtctgcgtcgcttactacatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtccgtctgggcgtggcgacagaaacgcgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatggtgcccgtgatgtgctggggatcccttacgatgcccactgtctggcattgttgccgggcagccgtggtgcagaagtcgaaatgcttagtgccgatttcctgaaaacggcccagcttttgcgccagacatatccggatctcgaaatcgtggtgccgctggtgaatgccaaacgccgcgagcagtttgaacgcatcaaagctgcagtcgcgccagacctgtcggttcatttgctggatggaatgggccgtgaggcgatggtcgccagtgatgcggcgctactggcgtcgggtacggcagcactggagtgtatgctggctaaatgcccgatggtagtgggatatcgcatgaagcctttcaccttctggctggcgaagcgactggtgaaaactgattatgtctcgctgccaaatctgctggcgggcagagagttagtcaaagagttattgcaggaagagtgtgagccgcaaaaattggctgcggcgctgttaccgctgttggcgaacgggaaaaccagccatgcgatgcacgacaccttccgcgagctgcatcagcagatccgctgcaatgccgatgagcaggcggcacaagccgttctggagttagcacaatgatcgaatttgtctatccgcacacgcagctggttgcgggtgtggatgaagtcggacgcgggccgttagttggcgcggtcgtcaccgctgcggtgatccttgacccggcgcgcccaattgccgggctgaatgattccaaaaagctgagcgaaaaacgccgtctggtgctctgtgaagagatcaaagagaaagcgttgagctggagtctgggccgcgcggaacctcacgaaatcgacgaactgaatattttacatgcgaccatgctggcgatgcagcgtgccgtcgctggactgcatattgcgccggaatatgtgttgattgatggtaaccgctgcccgaaattaccgatgccttcgatggctgtggtgaaaggcgatagccgcgtaccggaaatcagtgccgcgtctatcctggcgaaagtgacgcgtgacgccgaaatggcagcgctggatattgttttcccgcaatatggttttgcccaacacaaagggtatccaaccgcttttcatctggaaaaactggctgaacacggcgcgaccgaacaccatcggcgcagctttgggcctgtcaaacgcgcactgggacttgcgtcctgattcttgtgtcgagattaagtaaaccggaatctgaagatgtctgaaccacgtttcgtacacctgcgggtgcacagcgactactcgatgatcgatggcctggccaaaaccgcaccgctggtaaaaaaggcggcagcgttgggtatgccagcactggcgatcaccgatttcaccaacctttgcggtctggtgaagttctacggagcgggacatggcgcagggattaagcccatcgtcggggcggattttaacgtccagtgcgacctgctgggtgatgagttaactcacctgacggtgctggcggcgaacaataccggctatcagaatctgacgttgctgatctcaaaagcgtatcagcgcgggtacggtaccgccgggccgatcatcgatcgcgactggcttatcgaattaaatgaagggttgatccttctttccggcgggcgcatgggcgacgttggacgcagtcttttgcgtggtaacagcgcgctggtagatgagtgtgtcgcgttttatgaagaacacttcccggatcgctattttctcgagctgatccgcaccggcaggccggacgaagaaagctatctgcacgctgcggtggaactggcggaagcacgcggtttgcccgttgtggcgaccaacgacgtgcgctttatcgacagcagcgactttgacgcacacgaaatccgcgtcgcgattcacgacggctttaccctagacgatcctaaacgcccgcgtaactattcgccgcagcaatatatgcgtagcgaagaggagatgtgcgagctttttgccgacattcccgaagcccttgccaacaccgttgagatagccaaacgttgtaacgtaactgtgcgtctgggtgaatacttcttgccgcaattcccgaccggggacatgagtaccgaagattatctggtcaagcgtgcaaaagaaggcctggaagagcgtctggcatttttattccctgacgaggaagaacgtcttaagcgtcgtccggagtatgacgaacgtctggatactgaacttcaggttatcaaccagatgggcttcccgggttacttcctcatcgttatggaatttatccagtggtcgaaagataacggtgtaccggtagggccaggccgtggttctggtgcagggtcactggtggcctacgcgttaaaaatcaccgatctcgatccgctggaatttgacctgctgttcgaacgtttccttaacccggaacgtgtctccatgcctgacttcgacgttgacttctgtatggagaaacgtgaccaggttatcgaacatgtggcggacatgtacggtcgcgatgcggtatcgcagattatcaccttcggtacgatggcggcgaaagcggtgatccgcgacgtaggccgtgtattggggcatccgtacggatttgtcgatcgtatctcgaaactgatcccgcccgatccgggtatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattactgattttgcgccgctttattgcgatgaagagggcaaacatccggtcacccagtttgataaaagcgacgttgaatacgccgggctggtgaagttcgacttcctcggtttgcgtacgctcaccatcatcaactgggcgctggagatgatcaacaagcggcgggcgaagaatggcgagccgccgctggatatcgccgcgatcccgctggatgacaagaaaagcttcgacatgctgcaacgctcggaaaccacggcggtattccagcttgaatcgcgcggcatgaaggacctgatcaagcgtctgcaacctgactgcttcgaagatatgatcgcactggtggcactgttccgccccggtccgttgcaatcagggatggtggataactttatcgaccgtaaacatggtcgcgaagagatctcctatccggacgtgcagtggcagcatgaaagcctgaaaccggtactggagccaacctacggcatcatcctgtatcaggaacaggtcatgcagattgcccaggtgctttctggttataccctcggtggcgcggatatgctgcgtcgtgcgatgggtaagaaaaagccggaagagatggctaagcagcgttctgtatttgctgaaggtgcagaaaagaacggaatcaacgccgaactggcgatgaaaatcttcgacctggtggagaaattcgctggttacggatttaacaaatcgcactctgcggcctatgctttggtgtcatatcaaactttatggctgaaagcgcactatccggcggagtttatggcggcggtaatgaccgccgatatggacaacaccgagaaggtggtgggcctggtggatgagtgctggcggatggggctgaaaatcctgccaccagatataaactccggtctttaccatttccacgtcaacgacgacggcgaaatcgtgtatggtattggcgcgatcaaaggggtaggtgaaggcccgattgaggccatcatcgaagcccgtaataaaggcggctacttccgcgaactgtttgatctctgcgcccgtaccgacaccaaaaagttaaaccggcgagtgctggaaaaactgatcatgtctggggcgtttgaccgtcttgggccacaccgcgcggcgctgatgaactcgctgggtgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggtctgtacctgacgggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcgattgcgttttggcgcgacgtggcgtgtctctccgagcgatcgtttattaaacgatctccgtggcctcattggttcggagcaggtggaactggagtttgactaatacaggaatactatgagtctgaatttccttgattttgaacagccgattgcagagctggaagcgaaaatcgattctctgaccgcggttagccgtcaggatgagaaactggatattaacatcgatgaagaagtgcatcgtttgcgtgaaaaaagcgtagaactgacgcgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgttttaagatgcctatcatcacctttatcgacaccccgggggcttatccgggcgtgggcgcagaagaacgtggtcagtctgaagccattgcacgcaacctgcgtgaaatgtctcgcctcggcgtaccggtagtttgtacggttatcggtgaaggtggttctggtggtgcgctggcgattggcgtgggcgataaagtgaatatgctgcaatacagcacctattccgttatctcgccggaaggttgtgcgtccattctgtggaagagcgctgacaaagcgccgctggcggctgaagcgatgggtatcatcgctccgcgtctgaaagagctgaaactgatcgactccatcatcccggaaccgctgggcggtgctcaccgtaacccggaagcgatggcggcgtctctgaaagcgcagctgctgacggatctggccgatctcgacgtgttaagcactgaagatttaaaaaatcgtcgttatcagcgcctgatgagctacggctacgcgtaatcggcaaatgttctgaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaagtttatcgaacataacccacgaatttgcggcgtgatttttgactgggatgagtacagtctcgatttatgtagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccaacgaatatcttgataacattacgccgccgttcacgaaagccttgtttacctacgtcaaagagcggaagtacaccttttgtacgccggggcatatgggcggcaccgcatatcaaaaaagcccggttggctgtctgttttatgattttttcggcgggaataccctcaaggcggacgtctctatttcggtcaccgagcttggttcgttgctcgaccacaccgggccacacctggaagcggaagagtacatcgcgcggacgtttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattctgggtgggatcccgcgcggtgaatttactcgcgacagcatcgaagagaaagtcgctgccaccacgcaggcacaatggccggttcatgcggtgatcaccaactccacctatgatggcttgctctacaacaccgactggatcaaacagacgctggatgtcccgtcgattcacttcgattctgcctgggtgccgtacacccattttcatccaatctactagggtaaaagtggtatgagcggcgagcgtgttgcaggaaaagtgatcttcgaaacgcagtcgacccacaaaatgctggcggcgttatcgcaggcgtcgctgatccacattaaaggtgagtatgacgaagaggcgtttaacgaagcctttatgatgcataccaccacctcgcccagttatcccattgttgcttctgttgagacggcggcggcgatgctgcgtggtaatccgggcaaacggctgattaaccgttcagtagaacgagctctgcattttcgcaaagaggtccagcggctgcgggaagagtctgacggctggtttttcgatatctggcaaccgccgcaggtggatgaagccgaatgctggcccgttgcgcctggcgaacagtggcacggctttagcgatgcggatgccaatcacatgtttctcgatccggttaaagtcactattttgacaccggggatggacgagcatggcaatatgagcgaggaggggatcccggcggcgctggtggcaaaattcctcgacgaacgtgggatcgtagtagagaaaaccggcccttataacctgctgtttctctttagtattggcatcgataaaaccaaagcaatgggattattgcgtgggttgacggaatttaagcgctcttacgatctcaacctgcggatcaaaaatatgctgcccgatctctatgcagaagatcccgatttctaccgcaatatgcgtattcaggatctggcgcaagggatccataagctgattcgtaaacacgatcttcccggtttgatgttgcgggcatttgataccttgccggagatgatcatgacgccacatcaggcatggcagagacagattaaaggcgaagtagaaaccattgcgctggaacaactggtcggtagagtatcggcaaatatgatcctgccttatccacccggcgtaccgctgctgatgccgggagaaatgcttaccgaagagagccgcacggtactcgattttctactgatgctttgttccgtagggcaacattaccccggttttgaaacggatattcacggcgcgaaacaggacgaagacggtgtttaccgcgtacgagtcctaaaaatggcaggataacttgccagagcggcttccgggcgagtaacgtgctgttaacaaataaaggagacgttatgctgggtttaaaacaggttcaccatattgcgattattgcgacggattatgcgatgagcaaagctttctactgcgatattcttggtttcacgctgcaaagcgaagtctatcgcgaagcgcgcgactcgtggaaaggggatttggcgcttaatgggcaatatgtgattgagcttttctcatttccgttcccgccggagcgccccagccgaccggaagcctgcggcctgcgtcatctggcttttagcgttgatgatatcgatgcggcagtggcgcaccttgaaagccataacgtgaagtgtgaagccatccgtgtcgatccctacacgcaaaaacgcttcacgttctttaacgatccggacgggctgccgttggaactgtatgagcagtaaggcttgtcatcgccgcatttgcccggtaacgtgcccggcattgctactgtaaaatcgcaccatcatgacactcacgctcaatagacaacttctctcctcacgccagattctggtggcctttagcggcggccttgattctactgtcttactgcatcaactggtgcagtggcggacggaaaatccgggcgtcactctgcgcgctatccatgtgcatcacggtttaagcgccaatgctgatgcctgggtgaaacattgtgaaaacatctgccaacagtggcaggtgccgctggtggtcgaacgtgtgcagcttgcgcaagaggggctaggtattgaggctcaggctcggcaggcgcgttatcaggcatttgcccgcaccttgttgcccggtgaagtgctggttacagcgcaacatctcgacgatcaatgtgaaacctttctgctggcgctaaaacgcggtagcggccctgccgggctttcggctatggcggaagtttcggagtttgccggaacacagcttatccgcccgttgcttgcccgcacgcggggggaactggtgcagtgggcgttggcgcatggtttacgctggattgaagacgaaagtaatcaggatgatagctacgatcgtaactttctgcgcctgcgcgtagtgccgttattgcagcagcgttggccgcattttgccgaagcaacagcccgcagcgccgcactttgcgctgaacaagagagcctgttagatgaactgctggcggatgatttagcgcactgtcaaactccgcaggggacgctgcagattgcgccaatgctggcgatgagtgatgcccgtcgcgcggcgattatccgccgctggctggcagggcagaatgcaccgatgccttcccgcgacgcgttggtgaggatctggcaggaagtggcgctggcgcgggaagatgcctccccctgtttacgtttgggtgcgtttgaaatccgccgctatcaatcgcaactgtggtggattaaattcgtcactgggcaaagcgaaaccattgtgccgtggcagacgtggctacaaccgctggaattaccggcggggctgggaagtgtacagcttactgcgggaggcgatattcgccctccgcgtgcagacgaagcggtcagcgtgcgtttcaaagcgccaggactgctgcatattgtcgggcgcaacggcggacgtaagctgaagaaaatctggcaagagttaggcgttccgccgtggctacgtgacaccacgccactgctgttttatggcgaaacgctgattgcggcggcaggggtatttgtgacgcaagaaggtgtggctgtaggtgagaatggcgtcagttttgtctggaagaaaacgcttagttaagtgaaagccggataagacgcaacaaacgtcgcatccggcgaagtcaatcaggactcgctcaccaccaccgtaccgatttccgggtggctaaagctggtaattttatccagacgcagctcgcgggttgcaccagcggcttcgacgaccagatattccacatttttgcgggagactaaatcgctggccttcgcctgcaatttttcgccatctttcagctcaagtgtcagcattaaatgatgctggcaggcgagctcaagattatcgtaatcatcacaattgattggttgatacgtatcatttattgacataatcgctcaccagtaagtttgccgcagcgtatgctgctttttccctgacagcctcagaaagggcgtcgtcggcagccatttcattcagcactttcaaaacgcagcccagcgcgtccggaacgtatcctaagtctccgctggcgatttccgcgtaccgcttgcgtattaactcacaatatttttccacatgccctcctgtcagcactctgacttaaccgtggatgcaagtctaagcctacgaagataaactctgtttcgcaaggtgactataccacactcatttctgcaatatcagcgccgcaactgcacgtattccgttacaatggcctcctgattcgaaaggagttttcttatggcgcttaaagcgacaatttataaagcgacggttaatgtggccgatctcgaccgcaaccagtttctcgatgcctctctgacgctggcgcgccatccttcagaaacccaggagcgcatgatgctgcgcctgctggcgtggctaaaatatgccgatgaacgtctgcaatttacccgtggtttgtgtgccgatgatgagccggaagcgtggctgcgtaacgatcatttgggtattgatttgtggattgagctggggctgccggatgagcgacggattaagaaagcctgcacccaggccgcagaagtggcgctgtttgcctataatagtcgggcggcgcaaatctggtggcagcaaaatcagagcaaatgtgcgcagtttgccaatctttccgtctggtatctggacgacgagcagctggcgaaagtgagcgcctttgccgatcgtactatgacgctgcaggcaacgattcaggatggtgttatctggttatcggatgataagaataatctggaagtgaacttaaccgtctggcaacaaccttcatgattgtgatttcccgacatgttgctatccctgatggcgagtttgagatcaccgccattcgtgcgcagggcgcgggcgggcagcatgttaataagacctcaacggctattcatctgcgttttgacattcgggcgtccagcctgccagagtattacaaagaacgtctgctcgccgccagccatcacttgatcagcagtgatggggtgattgtcattaaggcacaggaataccgcaatcaggagctcaaccgcgaagcggcgctggcccggctggtggcagtgattaaagatttaacaacagaacaaaaagcccgacgacccacgcggcccacccgcgcatcaaaagagcgcaggctggcatcgaaagcacaaaaatcaagcgtgaaggcgatgcgcggcaaagtgcgcagcggtcgggaataaaaagaaggaatggatggtgaaaaaagcgatagtgacagcgatggctgtaatcagcctctttactctgatgggatgtaataatcgggccgaagtcgatacgctttctccggcacaggctgccgaactgaaaccgatgccgcaaagttggcgcggcgtgctgccgtgtgctgattgcgaaggaatcgaaacctctctgttcctcgaaaaagacggaacctgggtgatgaatgagcgttatctgggggctcgtgaagaaccttcctccttcgcttcctacggtacatgggcgcgaaccgctgacaagctggtattaaccgatagcaaaggtgaaaagtcatattatcgcgcgaaaggagatgcgctggagatgctcgatcgtgaaggtaatccgattgaatcgcagttcaactatacgctggaaccggcacaatccagcttacccatgacaccgatgaccctgcggggcatgtatttttatatggctgatgcggcgaccttcactgattgcgcgaccggaaaacgtttcatggtggcgaataacgcagagctggagcgtggctacctggctgcgcgcggtaacagtgaaaaaccggtgttactgtcagtagaaggtcactttacgcttgaggctaatccggataccggtgcgccgaccaaagtattagcgcccgatacggcaggtaaattttacccaaaccaggattgcagtagtttggggctgtaacccgtcttgagacagaaacaaatgaaatattgcctcatgcgctgcgcttatcagtcctaaagcatacaatgcaatattttgaattagcacaattttgtaggccggataaggcgttcacgccgcatccggcattttgcgcacgaggctggcttttatcactgagtcagtccaacaaagcgacttgctttaatataaatccctggcttcaggtgcccaatatactgtaactgcgtttctggtttaaatgcagagacatcaccactacgcatatgcatcagatcggcagggctaatccagcctgattgcgccagcgtaagcggatgcccggctttggcaaatgcatcagtgacaaattccgaacaaaaccacgactttttgtctccttcgcccacactgcttaactgcgctttcgccaggccgctgacgcactgttgacgaaaatcctcggagaacggatttagtgagcacatctggcgagtcaccataaatggaataaattcgacaatgccgcgatagttataaccgctatctttaattttgttggcgaacgcggtgatttctgtggcttgttgcggggtaagatccgggactcgtaagacgaaaagcttatcactatgctttatggcttttttaagggaaacaatctggacgccagcgcctgtcgcttcggcaacgttattatctcccaaatagattgcaacgtgactcacagaggaagtgctgaatacgcggataccaaatgaggttaccccaaggcttgaggagaaaagcaaatcgccgggtttgagatctggttccgttatttcttttattgattgttcggtgaaagagctttgatgctggaatttaacagcccatgttttcgcctcggcatttaccactgtggctgatgagtctggctggctgatatcaacggtacaggccgaaagtaaaagaaagcaggggagaagcaggcggcagtacgcctttggtttatccattttatacaatccatgtaaaaaagggccccgaaattcaggaccctttctggcatcagcctttaatctgtttcaccagataatcgacgatgtcaccagtcttaattaactgtttctcgccgttacgacgatatttatattcgatatcatcgttgtcgaggttacggtcgcccagcacaatagtgtgcggaataccgatcagttccatatcagcaaacatcacgcccgggcgctctttgcggtcatccagcagcacttcgataccttgtgcgcgcagttcgctgtacagtttctcagcaagttcctgtacgcggaaggatttgtgcatgttcattggcagaatcgccacctggaacggcgcgatagcgtcaggccatacgatgccgcgttcgtcgtagttctgctcaatcgccgcagctaccacacgcgttacgccgataccgtagcaacccatcgtcaggatttggttacggccatcttcaccctgtacggaggctttcagtgcttcggagtacttggtacccagctggaagatgtgaccgacttcgataccacgtttgatcagcagcgtaccctgaccatccgggcttggatcgccagccaccacgttgcggatatcagcaatttccggagtagcgacatcgcgatcccagttgataccgaagtagtgtttaccatcgatgttagcaccagcagcgaaatcactcatcgccgcaacggtacggtcaatcaccaccggaatcggcatgtttaccggacccagtgaacccggaccggctttaaccacggcacgaatttcttcttcggtcgcaaaagtcagcgggctggcaacctgcggcagtttttctgctttaacttcgttcagctcgtggtcaccgcgcaccagcagcgcaaccagcgggaagctactgccttcaacggctttaaccagcagagtcttaaccgttttctcaatcggcagattgaactgttcaaccagttccgcgatggttttcgcgttcggcgtatcaaccagcgtcatttcctgggtagcagcagcgcgcggttctttcggcgcgatagcttctgccagttcaatgttcgctgcatagtcagaagtatcggagaagaccacatcgtcttctccgctctgcgccagcacctgaaattcgtgagaggcgctaccgccgatagaaccggtatcggcctgtacggcgcggaaatccagccccatgcggctgaagattttgctgtaggccgcatacattgcatcgtaggtttcctgcagggattcctgagaagtatggaaagagtaagcatctttcatcaggaattcgcgggaacgcatgacgccgaaacgcggacgcacttcgtcgcggaacttggtctggatctgatagaagttcagcggcagctgtttgtaagagctcagctcgttacgaatcaggtctgtaatcacttcttcatgagttgggccgagtacgaacggacggtcaccacggtcagcaatacgcagcaattccgggccatactgttcccaacgaccactctcttgccacagttcagatggctgaaccaccggcattaacacctcgatcgcaccggcgttgttcatctcttcacgcacgatgttttcgacttttttcagaacgcgcacgccggtcggcagccaggtatataacccggaggccagcttgcggatcatcccggcgcgcagcatcagctgatggctgatcacctcggcgtcggcaggtgtctccttgagagtggagagcaggtattggctagtacgcatgttgttacggttccagttggaaggtagaacaggctcaaggcgagcctgggacaaaaaaagtgatttagtttaccagtgcaaaagaaatgtcaaaagagaagggcgtgaatttaacgcggttccagcgcaaagacttcaaaacctgcgtcggtgacgcgccagcgaacgttaaaatcatgcagccagacggcataggttttgcccgtttcctcacctttacgataggccgggcgcgggtcctgcgccagtacttcgcggataaacagcgttaactgcggataacgcttctccagcgtcaaaagctgcttttcgacctctgcggtaaaacacaccgccatttctgccgctggcgcactttgcgcatagctggcactggcatcgggaagcgattcagcaaaggggagatacggtttgatatccactaccggcgtaccatcgacgagatccagactgccgagcttcagaatcacgctatctttatggcaaacaacctctttcagctctaccagcgacataccaattgggttagggcgaaaagtggagcgcgtagcgaaaacacccattctggcattaccgccgagacgaggcggacgcacagtcggacgccagccgccttccatcgtttgatgaaagacgaaaaggatccataaatggctgaatgcttccaggccgcgaacggcgtcggcctggttgtagggagcaatgagatgtagttcgccgttggcgctttttaccagacctggctggcgcggaacggcgaatttttctttatagggcgagcgaataacgcctatttgctcgaactggaaactgctcatttcgccgtgatgttaagcgcagaacctatacatacagcctgacgatagcaacctggcgtaccgctggtgacttcgcagctatgcagtaataccgcattggctttcattttcgaggcgttgatttgcatccgcttacgtgcggttggaatgctcggcggagagtcctgattagaggcctggcaagagtcgccactgacttcaccgagatcgcggaacggtttgccgactaattcttctgcattggtataaattcggaccggcgtggcgcgcggcgctttcggttttgcaggctccgctttcggctggggtgcagtgctttgaacgggttcgacaggggatctgcttaacatggaacagccgcttagcatgagtgctactaaacagatcggtaaagcacgcatagtatttcctcaatgtatgatcaaaacgtcaatattgaatcaggcgcttgtaaaaatgacaagacgggcaagcgcccgtcctgaatgatattacaaattgtggaaacagcctaaatattaccagcctttaacagcgccgccgttaaacactttgtttgctgcttcgtaaacttcgtcagactgataagcctgaacgaatttcttcacgttttcggcgtctttgttgtcttcacgcgttacgatcaggtttacgtacggggactctttatcttcgacaaagataccgtctttcgctggagtcaggccaatctggctggcataggtggtattgataactgccagagcgatttgcgcgtcgtccagagagcgcggcagctgcggtgcttccagttcaacaattttcagattttttgggttctcaacaacatcaagaacggtcggcagcaggccaacgccatctttcagtttgatcaagcccactttttgcagcagcagcagtgaacgaccaaggttagttgggtcgtttggcacggcaacctgcgaaccatcctgcagttcatccagtgatttgattttcttggagtaaccagcaatcggataaacaaatgtgttgcctactgcgaccagtttgtagccacgatctttcagttgctgatcaaggtacggtttatgctggaaggcgttggcgtcgatatcgcctttgctcaatgcttcgtttggcagaacatagtcgttgaaggttaccagctcaacgtccaggccatatttgtctttcgcaactttctgcgcgacttctgcaacctgctgttcggcaccaacaatcacgccgactttaatgtggtttggatctttttcatcctgaccgcagcctaccagtgccagtgatccaatcagggctcccactgccgcaaaggttttgaatttgaacgccataccttattccttcttcaattatttatgttgtgttgaacgttacttgcgagtgacagcccggacgatgcggtcgcctgcgaactgaattaaataaaccagaatgaccagcaataccagtaccgtattcatcaccgtcgcgttgtagccgatgtagccatactgatagccaatctgacctaaaccaccggcaccgactgcaccacccatcgcggaataaccaaccagggtaatcagggtgatagttgccgcattcaccagacccggcaacgcttccggtaacagcactttacggacgatctgcattggcgtggcccccattgcgcgggaagcttcaattaacccggttgggatctccagcagagcgttctcgaccatacgggcaataaacggtgctgcaccaacggttaacggaacaatcgctgcctgcaatccaatcgatgtaccgacaataacgcgggtaaacggaatcatccataccagcaagataatgaacgggatggaacggaaaatgttcacaatcgcagaaatggtacgatacaacttcgcgttagcaataatttgccccggacgcgtgacataaagcagaacgccaaccggcagaccaatcacaaagccaaaaaaaccggatacgaaggtcattgccagtgtttcccatacgccacgaaccagcagccatatcatcggctcagacataacccagtacctctacttttacatggtgttcctgaagccaggcaatggcggcttgcgtatcttgttgtgtgccgtgcatttcagtcagcataatgccgaacttaacgccaccggcgtaatccatctgcgcgctaataatgttgttgttgacgttgaaacgacgcgcggtttcagaaagcagtggggcatcgaccgattgaccggtaaactccagacgcagcatcggcacgcagtcagtaaatggctccgcttgcagacgttcctggtaatcttccgggatatccagatgcagggtcgactgaataaacttctgcgccagcggcgttttcggatgcgagaacacttcacttaccgtgtcctgctcgatcagttcgccattgctgatgaccgccacgcaatcacaaatgcgcttcacaacgtccatttcgtgagtgatcaacagaatcgtcaaacccagacggcggttgatgtctttcagcagttcgagaatagaacgtgtcgttgccgggtccagcgcgctggtggcttcatcacacagcaatactttgggattgctggctaatgcacgggcaatcgccacacgttgtttctgcccaccggaaagattcgacgggtagctatcatgcttatcgccaagaccaaccaatgacagcaattccgtcacgcgacgtttgatctcgtctttcggtgtgttgtccagctccagcggcagagccacgttgccaaaaacagtacgcgaagagagcaggttaaaatgctggaaaatcataccaatctggcgacgagctttggtcaactcggattctgacagcgtggtcagttcctggccatcgaccagcacgctaccctcggttgggcgctccagcaggtttacacaacgtataagcgtactcttacccgcgcctgaggcaccgataacgccataaatttgtccagctggcacatgcaggctgacgttgttcaacgcctggatggtgcgggtgccctggtggaacactttggtgatattcgaaagttttatcattgattatttattatcgtcattaagttagtcgtggcatttcgaatgcctggaacgggcaacgccgtcaatgaaatggatgttaaggcatccagacgtctaaatcaatcaggtttatgcgaagagcactttcttgcaggtcgaaacatgcgatactagcgtcacatgccttattaaggagctataaaaggtggcgaagagcgtacccgcaatttttcttgaccgtgatggcaccattaatgtcgatcacggttatgtccatgagatcgacaactttgaatttatcgacggtgttattgacgccatgcgcgagctaaaaaaaatg

SEQ ID NO: 10021 - DNA, 53523 bp, Escherichia coli
tattgctgggactggcgctgtttttgaccttttttattatgtcgccggtgatcgataaaatttatgtcgatgcgtaccagccattcaacgaagagaaaatatcaatgcaggaggcgctggaaaaaggggagcagccgctgcgtgagtttatgctgcgtcagacccgtgaggcggatttagggttgtttgccagactggcgaatactggcccgttgcagggacctgaagctgtgccgatgcgcattttgctcccggcctacgtgaccagcgagttgaaaaccgcatttcagataggcttcacgattttcattccttttttgattatcgacctggtgattgccagcgtgttgatggcattggggatgatgatggttcccccagccacaattgctctgccctttaaactgatgctgtttgtactggtggatggctggcaattgctggtcggttcgctggcgcagagcttttacagctagtgaggcaaaatgacacctgaatcggtcatgatgatggggactgaagcgatgaaagtcgcgctggcactggctgccccactgttgctggtggcgctggtcacgggtcttatcatcagtattttgcaggccgccacccagattaacgaaatgacgttgtcgtttattccgaaaatcatcgccgtatttatcgccattattattgccggaccgtggatgctcaatctgttgctggattacgtccgcaccttgttcactaacctgccgtatatcatcgggtaggccgtacaatgatgcaggtaacaagcgatcaatggctttcctggttaagcctgtacttctggccgttactgcgcgtgctggcgctcatttctaccgcaccaattctgagcgaacgcagcgtgccgaaacgggtaaaactgggtctggcaatgatgatcacgttcgctattgccccatcattacctgccaacgatgttcctgttttttcgttctttgctctgtggctggccgtgcagcagatcctgatcggcattgcgcttggttttaccatgcaatttgcctttgccgctgtgcgaaccgctggtgaaattatcggtctgcaaatggggctgtcatttgcgacgtttgtcgatccggccagccatctcaatatgcccgttttagcgcgtatcatggatatgctggcgttactgctgttcctgacatttaacggtcatttatggttgatttcactgctggtcgatacctttcacaccctgccaattggtggcgaaccgttgaacagcaatgcgtttctggcactcaccaaagcagggagtttgattttccttaacgggctgatgctggcattaccgctcattactctgctgctgaccctgaatctggcattaggcttacttaatcgtatggccccacaattatccatttttgttattggatttccattaactctgactgtcggtatctctttaatggcggcattaatgccgttaattgcgcctttttgcgaacatttattcagtgagatgtttaatttgctggctgatattattagtgaattgccattaatataattccgtaacgtttatcatgttatcctaaggattatccgaaaaataatacctacgaacatcttccaggatactcctgcggcgaaatatttgttttaagctcactcacatatcgcaacatttactttactttaagacaattccaggcaaattatacaacactttacgggatagtaagtccgcctgaaaaatcgcgagagtggcgcattaggtgacccatgttgttccgtttagtcatgatgaaatattcaggtaaggggaattatcgttacgcattgagtgagggtatgccatgtcaacgattattatggatttatgtagttacacccgactaggtttaaccgggtatctgttgagtagaggggttaaaaaaagagaaatcaacgacattgaaaccgttgatgaccttgccatagcttgtgattcacagcgcccttcagtggtgtttattaatgaggactgtttcatccacgatgcttctaacagtcagcgtatcaagctcatcattaatcaacatcccaatacgttatttatcgtttttatggcaattgccaatgttcattttgatgaatatctattggtcagaaaaaatttattgatcagttctaaatcgattaaaccggaatctctcgacgatatccttggcgatattctgaaaaaagagacaacgataacctcgtttttaaatatgccgacgttatcattgagccgaaccgaatcgagtatgttgcgaatgtggatggcaggtcagggaaccattcaaatctctgaccaaatgaatatcaaagccaagaccgtttcatcgcataaaggtaatattaaacgtaagatcaaaacgcataataaacaggttatctaccatgtcgtccgactgacggataatgtgactaatggtatttttgtcaacatgcgctaacacattctgactggtggtttcccaccagtcaggctgaattagattactctgctttctccacaaagataccgtcctgatgccctgcttcattaaagaaccagatgccgagcgggtagtcttccagcgaaaccaggtacattgtgccttcactaaactcctcaactgccagtaccacgccaggacgacgcggaccgccatccgttttgactgttacccgatcattcaccttcatcgttttcctcctgtggctttgtgccagtgtagaacaatttcgtttttctggcagcgccaggcgcgcgcgagtgttgattttctcgacggtctatacttaaaagatgccaggcggacttaacgactggcggcaacaacagagtaacggttgcgaggaaagatgatgaaaaccgcaaaagagtacagcgataccgcaaaacgtgaggtcagcgtcgatgtcgatgccctgctggcggcgatcaatgaaattagcgaaagcgaagttcatcgcagccagaacgattctgaacacgttagcgtcgatggacgtgaatatcatacatggcgtgaattggcggatgccttcgaactggatattcatgacttcagcgtctctgaagtgaatcgttgaatgcacaataaaaaaatcccgaccctgagggggtcgggatgaaacttgcttaagcaagaagcacttaaaaaattcgttacaccaggaaatctgatgtgttcatcaccttatccgcaatttttttcgctgacaagaaaatattcgtgatatgaatgattaacgctacttatgaatagaaatgtgacgcgcgtcaccccttggtggctctggcgtcaacgggatcgctcccgaaaaaatcatctttgataatttgtgctgttttgagaatcatcctggtaaggggagtactgcgcaaccatgctttcaattcaacaaccactactggtttttagcgatcttgatggcaccctgctggacagtcatagttatgactggcaaccagctgccccctggctcagccgtttacgcgaagcgaatgttcccgtcattctctgtagcagtaagacatcagccgaaatgctgtacttgcaaaaaacgttggggctacaaggtttaccgctgattgccgaaaatggcgcagtgatccagcttgctgagcaatggcaggatatagacggttttccacgcatcatctcaggtattagccatggcgaaatcagccaggttttaaatacgctacgcgagaaagaacattttaaattcacgacttttgatgatgtcgacgatgcaaccatcgccgaatggacgggattaagccgtagccaggcggcgctgacgcagctacatgaggcgtcggtaacgctaatctggcgcgacagtgacgagcgtatggcacaatttaccgctcgtctgaacgaactgggcttgcagtttatgcagggtgcgcgcttctggcacgtcctggatgcctctgccggaaaagatcaggctgccaactggattatcgcgacctatcaacaatcgtcaggcaaacgcccaaccacacttggcctgggcgatgggccaaacgatgcgcccttactggaggtaatggattacgcggtgattgtgaaagggttaaaccgtgaaggggtgcatctgcatgatgaggatccgacccgcgtctggcgaacgcagcgtgaaggaccggaaggctggcgtgaagggctggaccattttttctccgcccgttaagcgttatcgctcgcgcatacccgattgcgcccggcctgtttagcgagataaagccgacggtcggccagtgactggagttgttcaaaatcataatcaccggtttcctcgctgctgcttacccccagcgaggcactaatgcgtatcgtcgtactcttggcgatcaacatctctttttcatttagcttcaggcgaatacgttctgcaacctccgcagcctgcgtcagactcgcgccgggcagaatcacacaaaactcctcaccaccgacccgcccggcaacgtcctgcgcacgcaaggaactgctaattaatccggcagcatgagaaagaacacggtcgcccgcctgatgaccaaagcggtcattaatcgctttaaaatggtcaaggtcgacctgaatgacagaaaaaggatgttggtgcgtctgacacaatttagcgagcggacgggctttttcgaacagtgcgccacggttatataaacgcgttaaggtgtcgtgccacgcctgccactgcaacgagctttgcaaaacatacatgttgctaaccatccggcgaatcacataccaggagatgagtaacatggtggtaaagagcgcccacagcagagttaatgcaatgctgatactgccgaaatcaccacgcacgccttcgcttagcgtatggacgcgcaccagcacaccgtcgaaatggtccagacgttcccagctaacataacgactgttcatacgaatgccgccccgcgtgtcatgttccattgcctgcgccagcaaggccagttcacgaggatcaaaaatattccctgttggatggtcaggattggaagaggtcaaaaatctcagcttactgtcatagagctgatactcaccatcgaggtttttatcgatggcgtttcttaaaaattgctgcatagtacgcacgggaatactcatccccagcacgccataccagtagttattactgtctaccggaacactgacggtaacctgcggttcagtattgctggcgtgttccggttgcgaagtgaaccagcgtaccgcgcggtgacgattttctcgttgcgaatggccgataaaccagggttgggtgacatagccgtaataacgcgttggtacattgcgcgtaaacaaggtcggctgcgtcgaaacgtaaaatccagcacgcgagacatacatcgcctgttcaaccatcgacgaggagttgtgcgccagtcgcagcaagtaaccaacttccagtgcagcggtaatttcattgtcgaggctttcattttcgcgagacaggagattcccctcgctgactaatgcatccgatacgccattgactggcagggtgcgccgtcggttgagttcgatttgccaggcgtgctcgtcgcgatgctgttcgaactcggttacggcattacgcagagaggtgaaatccagtggcgccacgagagctttcgcgcatgccattacgcaaaaagatcagtttgtcgacgttatactgcaaatgcttatcgagcgcgttggctacgttttccagatgattacgctggctggagatataggcatcttccgcatcttccagcaccaccacttcacgccaggtgagcaaggtggaaaaaagcaataccacgataaagcagagattaacgatatgaccaggccccaggcggcgtgcgagttttttcaaccagctctggttttccatttttgtctcgtgctgcaccctgacgactcccaacctgcttttttatgattctggcataacccggcgatagcgtaccgcaaaacagcgataattttataatggtggcatgataagacgcgactatcattcattgcaggcattgggacaccaggccggatgtgatccggcctggtgttaatgataccctttcaaacttcttccgcagaacgactcccctcccccggaacaagatcggtttcatgaaaagcttcccgcttgaccccgtaaccgtcatatcaacgacactcaaccataccgctggagtatccagtgacaatcatccgcgggccgccctctttaaccgtaacttcctcactaaccataaagctcatactcgcctccttttttcgagtgaaacttgttcaccttagttgaagatggcaaattttgcataatagccagtgcgagtattaatgtgcctgaccgcgcattttcgctactgctttcactcccagcaccacgatgccgccgatgataaatccaagaatcagatttaaaacagtcggtaatatcatcgccaccactgcactttgctgcccggcgaaatgttcaatggcgtgatgcagcggcgcaataccatgtaccacaatcccgccgccgacgaggaacatcgccagcgtgccgacaatcgataatgctttcatcagccagggcgcgataatcaataaccctttacctaatgcctgcatcagcgcgctggatttttccgccagccaataccccaggtcatcaatcttaacgataacccctaccagaccgtagacgcccacggtcactaccagcgcgatgcctgaaagcaccagcacctgattaagcaacggcgcctctgccacaatccccagcgtgatggcgacgatttccgcagacaaaataaaatcggtacgaatcgcccctttaattttgtccttttcaaacttcagcggatcctgcgccgccagcttctccagacgctgctggctctgcgctggatcttctttatgtttacgcgcctccagcatatgcagcactttctctaccccttcaaagcagagaaacgcgccaccaatcatcaacagtggcgtaatcgcccacgggataaacgcactgatgatcaacgccagcggcaccagaatcactttattgatcagcgatcctttcgccacgccccagaccacgggaagttcccggttggcccgcacgcctgaaacttgttgcgcattgagcgataaatcatcccctaatacaccggcggttttcttcgccgccagtttgcccatcacggagatatcgtccagcagtgtggcgatatcatcgagcaacgtcagtaaactactcccggccaaaagcattccctctcatttttattgttgaagggtgtaagtatgaagcaaaaacggcagctctgatacttgcttcacaggtcaacatttatttaacaatcaagtgcaattatatctctcgccagcagaatgattttcacgtttactatgaaccacctttttatttccgccgtgagggattatgcgtttccgccagttgttaccgctttttggcgcgctgtttgcgttgtatatcatttggggctcaacctattttgtcattcggattggcgtggaaagctggcctccgttaatgatggcgggcgttcgattcctggcagccggtattttattgctggcatttttgctactgcgcggacacaaacttcccccgctacgtccgctgctcaatgccgcgctgattggcctgttattgctggctgtcggtaatggcatggtgacggttgccgaacatcaaaatgttccttccggcatcgccgccgtagtggttgcaaccgtgcccctctttaccctgtgcttcagccgcctgtttggcattaaaacgcgcaaactggaatgggtgggtatcgccattgggcttgccggaatcatcatgctcaatagcggtggaaatttaagcggcaatccgtggggcgcgattctgattttaatcggctcgattagctgggcgtttggctcagtttatggctcgcgcattaccttacctgtagggatgatggcgggtgcgattgagatgctggcggcaggcgtggtgttaatgatcgcatcgatgattgcgggtgaaaaactgacggcgctcccttccctgtcaggcttccttgcggtcggctatctggcgctgtttggttcgattatcgccattaacgcttatatgtatttaatccgtaatgtcagtccggctctcgccaccagctacgcctacgttaacccggtggtcgcggtcttgctgggtacgggactgggtggcgaaacgctgtcgaaaattgaatggctggcgctcggcgtaattgttttcgcggtggtactggtcacgttgggaaaatatctcttcccggccaaacccgttgtcgcgccagttattcaggatgcatcaagcgagtaaatgaatcccctgcgtgtcgatctgcgcgctggcaccttcgccgcagatccactcttccagacgctcggtaagcgccgcatccgtcagcttctcgcgcccacgtaacgcacactcccagacaatcagtacgcgccagccgagctcctgcaagcgactgatatcgcggcgatcgcgttcaacatttttacctatcttctccagccagaactcggttcgggtcgcaggcactttaaacagatagcagtgatgatgatgccagaagcagccgtgggtaaatatcacgcagcgatattcatcaacgacaaaatccgggcgtccgggcagactggcgtcctgaacgcgaaacgcaaggccctgcccggttaacaaactggcgaggcgcttctcaatcgccgtatcacgcgtggcaatcgcgcgcatatttttgctgcgggtggccttatcgtgaacgtcgaccatgttgtgcctcttgctgacgcaacgccaccgcctgtttgatttttggctcaagcagttttgccaccgcggcaaagaccggcacgaccaccgagttaccgaactggcgataggcctgagtgtccgaaaccggaatgcggaatttcgcttctcccggcgcttcaaaacccattaagcgcgcgcattcacgaggtgttaaccgacgtggacgatgttgctgattcagcggatcgtcaaagtctttctcacccgtggccatatcccagccgcggtcgattaaaatttccgcgccatccttgtaataacgagcagacagcgtacgggtgacgctttgcggattgttcggataaaccattccataaccgaagccgttaccgcgcgcctgatgttttttcgcatatcgatagaggtacttccacagcaccggcgtcaggatatatttcgcctcaaccatcgggtccagcagctgcgccagcgtcactcgctgtgcagggaaacattcgctgatatcacgcagagtaaaatcggctttcagattcagatcgcgacgaaaacccaccagcacgatgcgttcacggtgctgcggcaggaaatgtttgccatcgatgattttcggatcgtccggcccgttatcttctgcatcagccacgtcatagcccagttcgtccagcgtctgcatgatgatgcggaacgttttaccctggtcgtgacttttcaggtttttgacgttttcgagcacaaacatcgccggacgacgcgcgtcgataatgcgcaccacatcaaagaacagcgtgccctgggtatcgcaggcaaaaccgtgcgcccgcccgagcgagttctttttcgatacgccagccagcgaaaatggctgacaaggaaaacccgccagtaatacatcgtgttcaggaatgtgttgacgaatatgttccgccgccgcctcatcactcacgccttctttatggctgagggtgatgtcgcggatatcttcattaaaatgatgcgtcgccgggtcgcaataatgattggctttataagtgcgtaccgcatgtttgttccattcgctggtaaacacgcactgtccgccaatcgattcaaaaccgcgacggatgccgccaattccggcaaatagatcgataaagcgaaacgcataatgcggatgatgtgccggtggtttgggtaacaacgtttgcagatgggcgaactctttctcacttaaacggtgccataccgagtcattcgccagcgcacgttttaaaattgccgcgctccagtgattctcacccacaccattaagctgcgccaccagcgttttaacatcataaatttgcagcagtttctccagcattgcctgtgcggcattcccggtgctgtatgaatcggttactgatatattttcctgcatagatttaaccggccatctgagatggccgacaggttaacataattacagccatttagggccacgcgctcagcccgcgggtgaaaacgcatctatcaccttgtgatcgacaccttcattctcccccgccagttcggcactgagcttcgccataaactcgactaaaaattgcgcgttgtgctgcgccagctgcttgcctcttgcggtttgcatggtttgcggtagcttcagcaacttagtctggaaatgatccagcgcgtagcgtttatcatcaagcggacgatgctgtgcgaacggatcttcaccatcaaacagcgccacgcccaatgcccctgaaacggcaaacacgcgcgccaggccaatcgcccccagggcttccagccgatccgcatcctggacgattttagcttccgttgttaagggggcgatttgcgcgctgaaactgtgagcggcaatggcatgacaaacggcctcgattttctccgccggaaattgcacgaactcttcacggagcaggcgacgcgtctcttctgccgccaggattgaagaacgctgccgttgtggatgatctttcgccaggctcacaatatcgtgaaaataacaggcggttaaaatcaccagcatatcgacatcgtcatctgccgccagcttctgtgccgtagcccagacgcggcgaaaatgacatacgtcatgggccgcgtcctggtgctggtgatggttttttaaccagttttcgaactgtgcctgccagtgttgtaagtccatacgcgctccgttgccaaagagtcgcaaccttagcagtttttattcatagcgtctgctgcgtgcgggacgaggtcgggtgtaccaggctatgctgcctaacaatgccccgaccagagccataaataaaaatccgaccagtgcccctaaccactttcccgcggtagatcctaaatcgctttcaaatcccgacaccggggcatcagggatccgactcatcacccagatgtaacgcgccattgcccagacgaaatagccacaccatgtatagaatgcccacaaagccaatttgccgccagggctgcgagagagtctctcttccatctttgtcgaaccgtattccattttgagataacccggaaaattcagacttagaaccattatgtgataaaaatcacatttttccacattggatgagccagtcaagactcaatcattttttgaacaaatagataaattttgcgcaacggcagtgaatacaggaaaaatcgttttgagcgattttatttatctttgatatcggctttattaattcatttaatcaatatattagcactgattacaattatacctttttattattctgtgtcatgatgcttccgttattagccttttatcgtcttgtttatattttttgggccggcatgatgccggctttttttatgccttcattaatgtgcgcgagatcacgccagccgtttagcgcaacaatcattgacactccctatcttttcaatcaactcataacatattgatatacatacataatattcatgaatatttatattcggaattcataactatgaattatattaaatagattagaaacattttgaaatcttttaaatacatttgttacatgtaatctttaaaataaaatgaacttcatagaatagtatccaaatgtgcttttttttggataacggcacttattgatatattcatgaagattataatcacaagggaatacataatgaaaagaaaagttctggcaatgctggtcccggcgttattagttgctggcgcagcaaatgcggctgaaatttataataaagatggcaataaagttgatttctacggcaagatggttggcgaacgcatctggtcaaatactgatgataataacagcgaaaacgaagatacctcctatgctcgtttcggtgttaaaggtgaaacccaaatcaccagcgaactgactggtttcggtcagtttgaatacaacctcgacgccagcaaacctgaaggtgaaaaccaggaaaaaacccgtttaaccttcgccggtttgaaatataacgagttaggatcatttgactatggccgtaactacggtgttgcttatgatgccgcagcttataccgatatgttagttgaatggggtggcgattcctgggcttccgctgacaacttcatgaatggtcgtaccaacggtgttgcaacctaccgtaactatgatttctttggcctggttgatggtcttgattttgcgattcagtaccaaggcaaaaacagcaaccgtagcactaagaaacaaaatggtgacggctatgcgttgtctgtagactataacatcaatggttttggtatcgttggtgcatatagcaaatctgatcgcaccaacgatcaagttgccgatggaaacggttcaaatgctgaactgtggtcattggctgcaaagtatgacgcgaacaatgtctacgcagttgtaatgtacggtgaaactcgtaatatgactccgggttctattgatacaggtgttgccgatcgagaaggcaatacaataatgcgtgatcaacttatcaatgaaacccagaactttgaagcggttgttcagtatcaattcgactttggtctgcgtccgtccttaggttatgtgtattctaaaggtaaagatatcaaaggtgtacctggacatagatatgttgacgctgaccgtgtgaactacattgaagttggtacctggtactacttcaataagaacatgaacgtttatactgcatacaaattcaacatgctggataaagatgacgccgccattactggcgcagcagctgatgaccagtttgcagttggtatcgtctaccagttctaatcagccaacgcgccgcggcgtgttactgtaaaacttaacactagcctgagttcgtccctcatcgaactcaggcttttttattggcatttcatctcgatctgcggcacacgcaattgccaaagcatatcgatacagcaccttaccccgcccccccccctggctcaataaaatctaccagcgtctcttccagccaacacccaaatgcatttctttataaatttaatctgtaacaaaaccgcttcccatatagaaatatttgcaaaaatagtgcattaaaaaagctttttccctaccaatccgggatataaatattcatcagcaccataatattccacataactaaatctctccctgccgccccgtacctctgataatggtctaaaatcattgaggccacttgcgacggcgttgctcaataaggaaaatttggcgtgaataatattcaacaccagtgcagcatcatcattacatacttacgcccgccgactaccgctttcgatatattgactcaattttccagcctggttaaaaatagcggccagctcagtcgcaaatatagtgactaccctaactaagcaacaataaggaatacactatgactgttcaaaaaagtaaaaatccacaggtcgatattgctgaagataatgcattcttcccttcagaatattcgcttagccaatatacgagtcccgtctctgatcttgatggcgtggactatccaaaaccgtatcgcggtaaacataaaattctggtgatcgccgctgatgaacgctatttgccgactgataacggcaaactcttctcaacgggcaatcatccgattgaaacgttgctgccgttgtatcatctccatgctgcaggtttcgaattcgaagtggcgaccatttccggtctgatgaccaagtttgaatactgggctatgccgcacaaagatgaaaaagtaatgccattctttgagcagcataaatcgttgttccgcaatccgaagaaattagcggatgttgtcgccagcctgaacgcagacagcgaatatgcagcgatctttgttcccggtggtcatggtgcactcatcggtttgccagaaagtgaagacgtagccgccgctctgcagtgggctattgaaaatgaccgttttgttatctccctatgccatggtccggctgcttttctggcgcttcgccacggcgataacccactgaacggttattccatttgtgcattcccggacgccgcagacaaacaaacgccagagataggctatatgccgggtcatctcacctggtacttcggcgaagagctgaagaaaatgggcatgaacatcattaatgacgacatcaccgggcgagtacataaggaccgtaaagttctcaccggcgacagtcctttcgcagcgaatgcgttgggtaaactggcggcacaggaaatgctggcagcttacgcgggttaatccctgttacgtttgaatgtaagcgcataatcaatcgcagccgcgttagtactcacgacgtggctgcgtttttcacggttaatttatggcgtactgaagccctatgttaatttctttgcggtaacgtaatccggaacacattatgcttactgagatagtgatacgtagcacttcccccatgtaattcggcaatcgctttgactaaagaaagaccaagtccctgacctacggaatgacgcgaattatctccccgccaaaatctacggaagagtttttcaggctcatgaattttcgttccaggactggcgatatcaatattaagagaaccgttggtatcaagaaaactggttatctgaatacgcgatttttctggcgaatatcgaatagcgttaacaataagattcgataacattcgttgtagtaaaattttatccgcaaagatgtgctgattgcactcgaccttaaagcaaatctctttctcgtctgaaaggtattcaagatagtccaacaaattttcgacttcattattgagagaaagcgagtccagtttcaccaaaacattatttttatctgccctggcaagaaacagtatgttctctgttaatcgcgaaatattttccagctcttcaatgtttccggcaattgttttttgatattcagcgatacttctggtttgactgagcgtaacctgattctgacccagtaatgcattaattggcgttctaagttcatgagcgagatcgtcagcaaactgacttagacgttcaaaatctttgactaaagcttggtgcattttattcaacgcctgcccaagaggttttagttctctcggtaatgcgctaacctcaacaggctctcggctatcgttataattcagcgcttccgttacaccactcaactttttgatctctcgtaaccccgttctgattaacaacggacttaatactgagcacagtataatggcgacaatgcaaattataatgctattaattttatactgttcaagcatgttatgtctggctgaagccaatttagccacagtaaccgttaatgatggcgaaacttcatcaatattaattcgtaaagcatctatctctgtgtcattaataatgcttctgtaaatgccagctgcgctgattgtctcactagcaggtatgttatttaacatgccattactgacatttgtccggttaacaattttattgatgccatcaccatgaatgatcaagatatcctgactaacatccatcatccggttaaagtacacaggtaacgtatctggatttaccccatcaattaacaactgcttgatctgcgctgtccggttaatgagtgttgtatcatcgcgccatttcaactcacttgccaggccattatagagagtccagacaattccagcgccagcaacaaacagcagcaatataaaaagcaaggttaaacggacggttatagataatcttttcattatttttttaccgctacgaatgaatagcccatcccccggattgtggagattagcttttcaggaaaaggatcatcaacttttgcgcggagcctgcgaatggcgacgtccaccgtattggtatcactatcaaagttgattccccaaatttcactcgcaataaccgttctggggataatctcgccagctctggaggccagtagccaaagtaactgaaactccttgcgcgtcagtgtaatactgatattgtccctgctcacactttgactgacagagtccattcttaagccgctgatttctaatgatgaattcagagcgtgatgttgccttaattgtgcccgaacccttgccagcaactcagaaaatgaaaaaggttttaccagataatcatttgccccactgtccagccctctgactctgtcatcgacagaatcccttgcagtaaggcaaataacaggggtttgctttgctgttcttaacgtttgtaagatctgccagccatccatacccggaagcataatatccagaatgatcaatgcataatcatccttcagcgcaagataaagcccatctctgccatctgaaacggcatcaatgacataacccgcttcggaaagcccctgcgttacccattcctgggtcctttgattatcttcaataagtagaatcttcatgaaaataatatgccataaatcatatgttatagaaacagcctggttcattacaaaattgtaatgctgctgtaaggttaccctggacgttttttcgctatcctcaaaactcattcacatgacaaggatataaacatgttaaagcgttatttagtactctccgtagtaacggctgcattttcattaccttctttggtctatgctgcacaacaaaacattcttagcgtgcacattttgaaccagcaaacaggaaaacccgctgccgacgtgacagtcactcttgaaaagaaagcggataacggctggttacaacttaataccgccaaaacagataaggatggacgaattaaggcactgtggcccgagcaaactgcgactactggcgattaccgtgtcgtatttaaaaccggggactatttcaagaaacaaaatcttgaaagtttcttccctgagatccccgttgaatttcatattaataaagtgaacgagcattatcatgtgcctttgttactcagccaatatgggtattcaacctatcgtggcagttaatgcgtaaatatgtaaaagctgatctctgctactgttagggaggtgactccctgacagattaacagtaaacggctcttgttggctaacgacaaaaaagtgtgatggcttatgaaaaagaatcaatttttaaaagaatcagatgttacggccgagtcggtattctttatgaagcgtcggcaggtgttaaaagcactgggcatcagcgcggctgcactttctttgcctcacgctgcgcatgccgatctgcttagctggtttaaagggaacgatcgcccacccgcccccgccggaaaagcgctggagttcagcaagcctgcagcctggcaaaataacctgccactgacgccagcagataaagtttccggttataacaacttctatgaattcgggttggataaagccgatcccgccgctaatgctggtagcctgaaaaccgatccatggacactgaaaatcagcggcgaagtggcaaaaccattgaccctcgatcacgatgatttaacccgtcgcttcccgctggaagagcgtatttatcgtatgcgctgcgtagaagcatggtcgatggtggtgccgtggattggttttccgctgcacaaattgctggcgcttgccgaacccaccagcaatgcgaagtatgtcgctttcgaaacaatttatgcaccggaacagatgccaggccagcaggaccgctttatcggcggcgggctgaaatatccttatgtcgaaggattgcgtctcgacgaagcaatgcatccgctcacactgatgaccgtaggtgtttatggcaaggcgttaccaccgcaaaatggcgcgccggtgcgactgattgtgccgtggaaatatggctttaaagggattaaatcgatagtcagtattaagctgacccgcgagcgtccgccaaccacctggaatctggcagcgcctgacgaatacggtttttacgccaacgttaatccgcatgttgatcacccgcgctggtcacaggctaccgaacgatttattggttcaggcggcatcctcaatgtacagcgccagccaacgctactgtttaatggttacgccgagcaggtggcatcgctgtatcgtggcctggatttgcgggagaatttctaaatgcgtctgacagcaaaacaggtgacatggctgaaagtttgcctgcatcttgccggattgttgccgtttctctggctggcctgggcgatcaatcacggtggactgggtgccgatccggtgaaagatattcagcattttaccggtcgcactgcactgaaatttttgctggcgaccttgttaatcacacctctggcacgctacgcaaaacagccgttattgatacgcactcgccgcctgttaggcttatggtgctttgcctgggcgacactgcatttaaccagttacgcattgctggagctgggcgtgaataatctggcgttattaggtaaggagttaattacccggccttatttaacgttaggtattatcagctgggtaattttgcttgcgttagcgttcacttcaacccaggcgatgcagcgaaaactcggcaaacactggcaacagttgcataacttcgtctatcttgtcgcgatcctggccccaatacattatttgtggtcagtgaagattatttcaccgcagccactcatctacgctgggctggcggtactgcttttagccttacggtataagaagttgctttcccttttcaaccagttacgcaagcaggttcacaacaaattatctctataacttcatattgccaacaaagtacgcgttatcccggccggatgcggcgcgagcgccctatccggcccacacagatcgcatcaagttatgcttcgtttgtcatcaacctttcatcaccagaataatttattttatttcaataagataggaaaatacacctgagaaaactatgctctcgtttcctaagagttattgcatttcgccatatgttacaatataacattacacatcatgtacattaactctggaggaaactgttttggcgattcgtcttcataaactggctgttgctttaggcgtctttattgttagcgctcctgccttttcgcatggtcatcactcacacggcaaacccttaacagaggtcgaacaaaaagctgctaatggtgtttttgatgataccaatgtacaaaaccgaacactcagtgactgggatggagtctggcaatccgtttatcctttactgcaaagtggcaaacttgaccccgtctttcagaagaaagcggatgcagataaaaccaaaacatttgctgaaattaaagattattatcgcaaaggttatgtgacagatatcgagatgattggcattgaggacggcattgttgaattccatagacataatgaaacaacatcctgtaaatatgattacgatggatacaaaatactcacctataaatcaggcaagaaaggcgttcgttacttattcgaatgtaaagatcctgaaagcaaagcccctaaatatattcaatttagcgatcatataattgcaccacgaaaatcatctcattttcacatttttatgggtaatgatacccaacagtctttattgaatgaaatggaaaactggccaacgtattatccatatcagttgagtagcaaagaagtggtcgaggagatgatgtctcattgatttttttgcgctgacttcaattatttaacagaacagtgcctggtagtaacgacaataatttaccaagacaaataaataagacaaactcagacacgctcatgcttgagacgtgtcttttttattatgtctgtagaaaaaaactgagaaaacggcgaacaataaatacacaactcaccaatacagactggctgcgccaatgtctccaggagcaagtcatctgtcatggtaaagctaaccagaaatataggttaattttggtatttaaaccttttttacttgttagtatgatacaaaggctttcaaaaaagctgggaaattcaacaactcttggaaattatggactttgtcccgcggctttaatctgacggccgcgttccttttttggctcaattattgaccccttctctacgcaacttcagttcccgccagcaactttgcggcagtttcataggatcaatgtctaaaagaataatggtgaccgataagaaaacgactgaataactgtagattttcgctcgaaaccttcctgtcagacccatagcgaatcaagtgctgaatgtcacagtatcgaacagaaaacagtgacgatctaacccttcaagaatattctacgattgttctgtttaggaaaagcaaggcgggaagtcgggagataagtcattgataaagtggcggagagagggggatttgaacccccggtagagttgcccctactccggttttcgagaccgatgatacagagtcgaaaaatcaaagagttaaaaatttttcttggaataaatgccttaaaatcgtacacgaaaaatcaataaattacataacattaaagaagaatattccaagccttcttgaggccaccacctgttttcaggcgtcattcagacgtgatttgcccctgattgggaaagcacgcttttttctcagcttattccgttttgcctgtgtgttgaataattccactgcagttatataaaatcggtaacggctggaaatcattcaatactcgcactatcgaaaagtttaccagccaaccgcggcaagttgcatacaacgtgccgcgttttccagatcagctcgttaatggagacattattgccggagataatggtggattcagcatccagagtaaccccggcggcaccgtatcaaaaggacgcccaagatcatcaacacatttttttaatctgaaatctgtaatgctctctccattccctaggcattgaccgcttcctattgacttgatttgcacagccccagtatcactggttataaatgtaaacaatgcgttacggtcactttcagagcactgcttagccactgccaattgcccgtttagaatagcaaagcattcattgccatcaggatttttaatctgaacatgccctcccggtgccgatatcaaatccaaatcattagtctttacttcagatataacccaattatttacattaaagtcactgccaacaggatttcggattatcccccctgtaagaacgtttctgatattaaccaatactggactgggttcagggtctacaggggcattgttgccgacaaactgagtaagaagattacgctgatttgcaggttcagcagcacaacctgtcagcagtaaaacaaaaagtactataactgttttcatcttcttgctcctcttccaggaataaagccaactggaaagtgatcagaggcaatttgccctcttaataatccgaataacaacgaggccctcaacagaggaagtacaaagctcactgaatttccaactaccgcataatcaagaacaccaccactggcttgcgttggatctggtggagcaataatatttacatgattacgaatccctggttcaagagttgaaaatagtgtagccggtgaacggttaaaatctcctgcaatcatccagttagcggcctgtcttataggatccgtttgtctgttgaagaactcaaaaacactatttacaattgctcctgaatccacgcctcgattcgccaatgcatgggttgagaagaaaacatcattaccaattctaatgccgatgatcggtcgtgatacaacagttggaggaggtaatacaatcacctcatcagctcttctgtttgaaacaatcgcaagatttactctgttagcgaatgcatcaacacgtgagaaatatataaacaactcctgtggacgactattggttccggtattccagatatactcattcatcggaataccgggagtgctaaattctcgctcagtcaacgttgcagaagctggtactgcccctgcctcctgaaccatcacgatatcaacagcaccacttcccgtaacaagttgtcggacatgtgtgttccatttattttctgtcggtgcatttgacccctgcaaattccaggttgcaactttaaaatcgcttaaatctgcaaaagaaatacccggcaaaatcattaacaggaataataattttttcatactccctccattccatcaggtttgtcatgaggtggaattggcaatggtctgaatggtcttaactctggcttaatcagatttggttttgccgctctgacaggtggacttattgcccatagcatttcttgcgtttcttcttttgcaccagggcatttctcaagggtgattgtaaaagcaaacggtgacagtatagttctgcttaaatagtctgctcttatacacgtctgcaaggcactacttcttataagcacattaccattagtagaaggcagtaactgaaactcctgagataacgagttatcatcacaggtattatgtatcaccccgtttttaaaggcctccatgcaagtcccctgggcaacattaacaaatttcactgtgccggcatcttttccatccacaaccttccagttccgattctcaccaaaatttactgaatcaaaaggagtatacccccaaagccagttacgaacaggtctggcccaaatagtaagcagcgccccaccagtgctcattattgaaacttcaggaaactcagtgttgttggctccaagtgttggagttgcaccgtttgaagtcactgcaataccttgtccagggattccaaccaattctacattttttcccggaggggaaggtgaatccccgatcccattcgagcaaccagtaattataagtgtgcacaaaaatgcaattagttttttatccactgtatttcctcctctgcaccacctcttttttataaaaaaaaagaaacaacaaagcaacaaaaatattactggtaagattactgagaaaatgtgaaagcagcacaacaaacaagttcactataacatttgttattgttttttaggttacaaacagcaaactcctatataattctttatattcccaaacactatgcaacatgaccataacgtatacggttcggtagatactcgcctgtctgtttccttacgtaatacacctgtttaggtgtatgcataagaccagccagatataaatgactatattgttttgcataagaagttggttgcataatcaccaattaatataaaatccattatttctccacatttttatgttagaagttgcaaagagaaatatgatgtttctctttgagataattaatcattcctgttgcccacctcactggtgggcttttttatgtaaaaccaactcctgctgtgttcccctgacatgatgactttaccgattaaccaacagccagatcagcagacacgccaccaccggcacagcaaaatccatcagacttgccatatcccacacgcgcgggtcaaaaccaccccaccacggcatattcatacgcttgccatgcccgaacatttcaatccagcgatattctgcctgggtgtgttcacgcgcaatgaagaacgtacaaccggctatcgccccgtaagcccagtttccggtaaaaagaccagccagtacctgcaccgctacggcacaaagcgcatgaagtatcgacgtgatatccatctgctatccttaaaaccactccctgagcgggcgctctggtgtaaccacccactcacggaacacggaatcatcaaatccatcgtcaagaagacggatattaacaaagtacccttcgtttcgcgtgtattctggttctccgtcatcaggaacatctgtctccctgaacgtaaaaccaatctcatcaaccagaacggcattctgcagctcttcgtcctcttcccagttaagtttcctgagaaatgccctgaaatctgctttatcactgaaacgcaacgtgaaatctctcactccacaacctccccaagctgcgcatctgttagctctttatgccagagacgaaaattcctcacatgcccaaataaatggcgtaatcctgctgtagtttgtccaccaatgcgaatggttgctgtactccggatatattcccatgtggtttttgtttcgctggatatacgcccgttacttactgcacatgtagactgatctgactttacacgcatccccataaccatttttttcaacgatgcgttttcgttaacacgcctatttgatccaccaatatcgcaataaggaaatccgtctggcccatctgccgaagatccgaagccaagaataatagccgctccggtttgatgaccgccggtatcaaaaacacgtggcgctgcatttggcgttttataccagttcttatgtacctcacaaagaaccgtaaaaggaagattataaagattattattaattggaactgtaactatatcgcttgcgcgggtagccgccgtcgttcctgagataataaaagatgatgcacacgaaccatcctcaacctgaggggtggccagataaatatagtctccagatacggttgctccgccctgattaggagaatactgtatctgagatcctatttttaactcatcatcaattgccaggattgttgcctctgcaaaaatccatccggtagcttcgtcctttctgactctcgctgtaatccttgaggccgcgccacctgtcatattaatttcaagcgtttgtgtatcaatatatgcatcaccaagaaaagttgttgcactaccgtcatatttatcaaagcggatacgcaaccttacctgtcgttctgttttaaaacgacatgaggttgtcacgtacttgttatcgcctgaaacatcaactgactttgtagcagcaattgatgccatattaatggctgacgtttgcccaatcagagaatcgttacaaacaaactttccataagtaaaaccaaaactatcagttccaacctcagcgacattcatatttgcagatttaccccaagaagctggagttgctgaattcaacatgtagttggttcgctgaccttcaatcaataaaccttctttttcaaatcgtggctcattaatttccgccgttttcagttcgccagatttgttgatatatgttgccgttgatgcgcgactgaaattaacctgtttatcactggcaacctgaaccacattatcaccaatcttcacttttttataacccggagaatagcccgtaatcatatccagcgaatcattaaagggtatccacacatccggcagcggctgtaaaacatatctgtacggctctgctgtctggtttgcgtattctctggcagcatcttcacttgcttttgctgccgtctggcttgctgccgatgctttcgccgagttcgccgccgctgtttcgctcacctttgcgttggcttcactgtctttggcattcgtctcactggttttcgctgccgtctggctggattttgcgtttttttcgctggcctttgtggctgtctcgctatttttcgcgttggtttctgattttttggctgctgtcgcggagtttgccgatgcagtctgcgaggccgctgccgcctgtgcgctgttagctgcattcgtttctgaggttttcgccgcattcttcgatgaggctgctgccgtttcggatttctttgccgccgctgcactctgtgatgacgctccggcatgacgtgccacttcattcaccatcagctcaaaacggcgcagtgcctccggacgaacatcatcctccgtcatggcaccgagaaaatcattcagcgtacctggtctggaaccttcatagacggtaatggtcccggcatgtgaaggcggaaaaccttcaaccagcaggatgacgctgtactggccatactcaacatccatgctgtaacgcccggcttcatccggattttcagaggccaccgtgttcaccagtaccgtggtgctgttacgctttgccttcaactgaatagtgcagttctgtattggttttcccgcaccatctttcagcacacctgagatttttactgctgccatatccactccacaaaaaagcccgcctgaaccggcgggctgtcataacactgtgttacctggctaatcagaatttataaccgacacccacgatgaaaccgtcagtgcgccagtcaccactgccggaaccttcataagcaaggtcaatggccacggattcggtcgggttaaactgcacgccagctccccacgccagagacgtgttgctgtggcgatcgtcatcacttccggtcagcacatcgtgcgttttccccttgctgtcagttacacggagataatccccggaaaaagtcgacacacggctgtaagtcacaccagcgatcacatacgcgctgaaccattcattcacgcgcacagatggccccgccatcacgctgaaccagcggttacgcacagaatcctcatgccagcgggtatcgctgtagtgcgtttttttctcatcttcagcattggcataactgaaggacgtaatcagccccagcgtgtccgtaaactcataacggtatttcacgttaatcccgttcagattatcgctgccgggagcgttcgtacgggcatgaagataccctgtgctcagtgtggactgatgttcagacgcccatgcaggcgcaccggatacggacagacagatggctgcggacaaaatggctgcacaaactttacgcataattacctctcgcttttctgcaataaaaaaggcaccatttctggcgcccgtattggggttataaaattcagctaatcgtgatgcctgcagtggctttcttcatcacaacaaccagcaaatcgctgatacttgctgtgggataccagccatttacccaccatgctgatacagaaaactccagcgtcatgtgaccgcgaccagcaggcatatcaataacaccactgtaaaccagcgtattatccagcgcggtacggttataaatttcagcaccgtttttcttcactatcaggcggcatgacgaataagtatcgctgttctcccgctcatgtctggcaccgctgaaagccaccgccggaataacaatctgccggttaaacggctgatcgtcataaaccctgacggtaatggttcctgatggccaacgcttcggtgcacgggagtcacgggggaaagccttacccactgttttaacgagatcgccttcaatctggtttgcagacagtttccctctgatgacacagttctcgttaatggtgacattattgagcgtgccggtattcgccgtgatggctccactgatatccgcattgcgggctgtcagcctgccatccggcgtcagggaaaacgtcggaggattgccggatgacgtgatgctcaccgcaaacagtcgcttcaggaacacgtcgttcatgaacagctgattcccctgcgccacaaacagcggcgtggtgttgccgttctccggggtaatcatcgcaatgcgatcggcctgcagcagaatgttactcagggtctgatcatcaacatcctcaatccccgcgccaatcccggccacatagggaataccgttttttgttttctgcaccttcagcatatacatggcattcagctcattgcgcgtgtctgactgaacccgctggatttgctgtatggtcacggcctggtcacccagctttttatccgtggtcgaggtaatttcactcccttttttatccacgtactggcggacctgtgctatctgtcgggcgttttctgactgcccctggctgacagtctgtgagatttcactgctcacccggtccactttctggctcacctgcgcgatggccagtgtctggtcctcattctttttcgcaaccagctgcgtgaggctgttttccgccttcccgattttccgggtcacttctgcgatatccgtgtccatccgctgacggatatcttcttccagttgcgtgacctccgtacgcagcgctgaagcatcaatgcgctctttcagtgcctgacccagaagcgtctcatctatcagcccccggaaaatttccagatacccttcaccatcattgctgggctgcccgctggcttccacaaaagcagatttccccaccaggttgacgctgcgcacgtaaaaccagaaatccgtccccggcttaatccggctcccctggacagtccactgactgccggtccccagataacgggcagatttttccacctgtgctgtgttcgtgatgcgtttttctgagaaccagaattcaaactgtaccgtcgggtcatacaccgcaagacgcgggaccgccgttatctgaaaataccccggcgtcagctcaatccgagacggcgctgccggtgcggcaatccggaacgataccgatgccggatcgccctgctgcccccacgcatttactgcccggactgtcagcgtgtaccgccccagcgccagttgcgtgaagcggtatgtggtttccgtcgtccgggccgtgctgaccagccgctcactgccgtcatccgctgccacggtcaggcgaagcataaagctcacgcccttcaccaccttcggcgtgtcccagcgcgccagcacctgatattccccgctgtctgcggtaacttcggcggtcaggtgctgcaccgctggcggcgtgacaccattcaccgtgccgctctggtcgccgtcaaagtgcgccccgttatccacgatggcctcttttgccggtacatgctgtacggcggtgatggcatacgtaccgtcgtcattctcacggatactcacacagcggaacaggcgctggcgcagcgtcggcagcttcagcccccacacgctgtatccggcaacgccgtcaggaacacggctcactttcaccttcacaccgtcggtgacggactggacctccacgctcaccggattaccctgcccgtcaaccaggcttatcagcgtggtgccggaggatggcagcgtgatttcacggtcgagcgtcagcgtccgggtctggctgtttaccgccagcacgcgcccgccggtgctgataccggcatagtcatcatcgcagatttcaatgacatcgcccggtacatggcgaagcccttcggcacccacgctgaagtccacggtctgcgtttccagcagttccgttttaatcagccacagcccggcgcggtgcgcctgcccccggctggtacagccaaaggcatccatcttcgtgacgttacgaccgtaacgggcaatggcctgcgtatcttcaacaagctctgtcgccgtctcccagccgttatccgggtcaatccagttcacctcaacggcattatggcggtccttcaggggcgctgaagctgtagcggaacggcgcgccatcatccggcatcaccacattactgcggttataggtccacaccttatccgacggtcggtcctgcacgaacgtcagcgtctgcccgttccataccggcatacagcgcatcgccgagcagaaatcactgagcacatcccacgccttgcgctgtgtggtcagccaggcattacaggtgatgcgcggctccgtgccaccaaagccatccggcaccgactggtcgcaattctggccgatgacatacagcgcccatttatccacatccgccgcaccaagacgtttccccatgccgtagcgcggatgggtcagcatatcccacagacaccaggccatgttgttgctgtatgctggcttaaacgttccgtcccagataccgctgtattgccgcgtctgcgggttatagttcgacggcacctgcagaatgcgcccgcgaagatgataattacggctcacctgctggctgccgactgctccgagtccactgcacgccgaccagtgccgtgttcgggtagcactgtttcacatcgatgatttcggtgtatgacgaccagagcgttttgttctgcagctggtctgtggtgctgtcccggcgtcatcctgcgcatccgkatattgaacgggcgcggcggcaggttaccccaccaccacccgaggccagatactgcgaggtggttttgcccttaatggtgatgtctttttccgtcacccagccaccrttacgctgtatctgaaccagcagrcggacttccgacggattccggtccccctttgaggtggtttccaccagtgcctgcacaccgaaggtaaagcgcagacggtcaatgtttgccgacgtgatggtccgggtgatcggcgtgtcatatttcacttccgtacccagcaccgtctcggagccggaggattcaaatccctccggcggagtctgctcctgctcacctgcccggaacaccaccgttacgccggagatgttggtattcccctcactgtccagcaccggtgtactgttcagcagcacgctttttaagccatccaccggaccttcaaccggcccttcactgatggcatcgatcacactcagcaactgcgtggacttcagattgtccttcgcttcgcgcggggtatgccccttactgctgcctttacccattcgtcatgctccataaacgacaaaaccgcccggaggcggtttcacataaaatattttgcatcatcgaccaatcatcacaacctgaccaccatccccttcgtctgccgtgctgatctcctgagataccacgcgtgaccccacgcgcatttcaccgtacagaacgggcagaacattcccctgggcaaccatgttatccagtgaggagaaatacgtgttctgtttgccgttatccgttgtctgtgtgcggggagttctggctttcggtgccagcatctgcgccacaccgcccaggatcatactggcccctgccgcatacatacccgatacagccgcggcacccagccagcccacagggttccaccatgccaccgcaatcagcgcagcccccagcactgcctgaaaaacaccgccacttttggcacccgccagacgcggtacgatgtggatcacggcaccatttgccagcggctcattaagacgggcagataattcgttttcgcctgcatcacgcccggcaatgcgcacctgataccagccctcattcagtttctgacgaaacgccgggagctgcgtggccagcgcccggatagcttcggctcccgttttcacacgaaggtcgatgcggtggccaaatcgttgcaaatccccgtaaaggcagatgcgtgccatgcccggtgacgccagagggagtgtgtgcgtcgctgccatttgtcggtatacctctctcgtttgctcagttgttcaggaatatggtgcagcagctcgccgtcgccgcagtaaatggcggcatgattcggcaccgatgaaccaaagcagcacagcagcacatcgcccggttgtgctgatgacaacggcacctgatacagccctgtggcctccagattatccagatagagattctgaccgtgacgccaccagtcatcctcacgatgaaaatccggcatctcaatccccgccagatgataagcatcccggaacagcgtgtaacagtccgtcaccccgtgctcaaagcgccgcccggtaagatgcggcacacagcggaacttatgaatcgccccccggcagaccagccaccacggcaaatcactctgcacctgcagccgcctgtcagcctcactcagccagggcagaccaccggggtgactgtggaccagcgccacaatctcaccctgcattttggcctgcagccagtcctccggcgacatccggaaataatcttccggctcaccggagatattcacgcaggggaaatatctttccccctccggcgttctcaccacgaagccgcacgactccgctggcgcacatcgccgggcgtgcgccagaatcgctgattctgtctctgtcatgggatttactgcgaaagtttgttgatggaaaggtagccgccaaagttgccgacgttattgcgaaacttacagccactcaggcatttgctgcatttatctttcgtgatatcggacgtcggctggtcatattcatccgcgacagccggaccgctataaccgcactcatcaccgcgataggtccaggtacaggtgttggccagcatgatgcgccccggaaaaaccgcaccatccgtttccgtcggcgtggacagtacaaaagaagcactgaccgcactcagttcgctgcactgctcgatgcgccagcggctgatcacctcctgctccgggtcggcgtcactgtttccgttgacgaagttcaccgcatccagaaaacgggcgtaaaccttacgcctgaccaccgttccgccgaccagactctgcaggtcttccgccatcccggtgaccatgccgtacagattagagactttaagcgttggccttgcactggctcctttgccgttcatctcaaatccacttccctgaatgggataggcctgatactgccgccgctgccaggtgactggttcacctttttcgttctgctcattacagaagaaataacgatctccgccgacctctgtcagatcaatttcccagagcacgatcagcgcggattgctccgttttagtgcactcattgagtgtttcctgctgtatatcctgcatcagtgagtgacctcttcaaaggtacagttaaaatcggtatacatggcattatccgaaatgctccactccctgcagacaacccggacagtcctgttgtgttttggcggacgccacaaaaaagcacgaatcccggcatgacgggataaaaaactgtccagcgcggcacgggaatattcatctgtgacacgaaataccggtttaaacgttttcagatccgcattcagaccaccagcccgtctctgttcatatccgtcaccaaactttaccgtaataactgatggctttcgtgtcgtctccatcccctcacgggggatccagttaaaaacttcaggctcaggcactgtacaatcctccatcccgacgcgatgactgcataattgacacaaccctgctgtcgatcagatccaccagtcccctggctgagcgcgcatctatctcgccattgctcccttgattctgaatgctgatgtgatacacgggagaataaacaacccccccgccactattcacattgccaatggctctgaccccaagagagccgtccgctgcccgtgtcagtggcatgatagcttcaggcccggcctcgcccatcagcccggcacctttcgcaaaagcaaaatacgtcggtgtatccacaatagtgttactgtaagcactcagatttgccgatgtgtaaacaccaccttttgcgtttgccaccgcccccgaaatccatccgccgaccgtaccaagccaccctccggcaccggagagtgacttcagtccgttaacaatggccgcattcatcagaatttttgaaacttcctggagaattgaactcccccagtttctccagtccacaacatttccggccagcgcatcggaaatatttgataccagcccgtccatagtggaaacgacagcatctgccgcctgcgaagcataatcggtggcactgtctgcccagttggtcagcccctcctggagtcctgcattccagttattacgtaaagcatcggcctttgcataataatcctgctgatcgctgagacgctcttccagatattttttattcagttctttctcctgtttccacagggcttcttcaatttctccggcctgatactgtctcagcagctcgttatttttctgctcaaactcatgccggatactccacatttcctggagtcgttcacgcatccgtgagccttcaccatatcccagtaactgcgcgtcgttagacgcccgggtactggcattactgtccgccaggctgctttcatacgcagcaagctgctcacgaatctttttctggtcgatgagtgctgcattctgcaaaagcgtttttttctgcgcttctgacagggttgataattcgccctgactgacctgatatttcatcttagccagttcagtattctgccctgccagtgctatctgttctttttgctgtttaatcagccgtttataaatatcttctgttttttccgcttcggtctttttatgcgctttgggtttatttgcctggttatttcgccaggcatccagtgagttattgatataattctgtctggctgtctgatacgcctctcccacaaagccgagatcatccgcagcatagcccagtcgggcacgctcacgcgcttcccccttaaggcgggacagagccagttcgcgcttgctgttattcagtgcggtctgctgtttatcatccagggttgcctgtggtagccgtaacggtacattcaccagcccctgtcgctgctgaagtaattcattaccaagcccaagaaggcgattaaactcggtatgctgcccattcatgatcaacagggactgatacgctttgttttgttccgccgcctgttgacggatcaacgcaacccgccgctcctccagcccggcaagcacatcctgaatggattgcgctttgccctgcatttgtgtgagacgggactgttcaactgccagttgatttgttgcttctgcaagcccttctgtgactgtttttaccgacgtcatgtggttaatcataaaaccgttatcggttgtccagcccgggtttgccagcacatactgatagccagcaattttttcctgtaaggatttaatcttacttttctgctcgtcaattaacctgttttgctcatcaagtgcctgccgcgtcttttcctcattatctgacgcttcaggaagcgacattgccgacgttttctggcgaatttcgtcgattgttgcggcatactggcgtgcagattctctggcctgctcctgattctgatacatcgtgtaccaggccgcggcccccagcatgacaagccccggcaccccaccaaccagtcccagtgctccacttaacagacgacttcccactgacgtgacagtattcagcgttgtctgtgctgctgttctggccgcaatattacgggtaagtgatgcctgggcagcagccagtttcgcttctgcggctgcctgcctttcggtaccgcgagcagcaacaaccgcctgttgcgcacgataaaccgccgcacgcgccctggctgttgctatctgtgtcccccggagctgcgcttccgcaagagccacttcgtttctggctgcagtaattaatccggcagttgcagatccagcagaagacgccatattgccaaaatatcgggctaccccgacggcaaccagagcaccggcagcggttgccacagtgtcaatattgcctgcaataccattcagcacaccggagagcgtcttcgtcactccgcttgcctcgttcgcaccaccaacccaggccataaaggcgttttcaactttggttgcagaggatgaaaccgtatcaggcattgccgcatattcatcacgtaatgccccaagctgactaatcagtgcaggaacaaccttatcggcggtcaactttccgttatccgccatggccttcagatccttacgggcaacccccattcccgcagccagcgcacgaataacacgatcgccgttctcattcaccgagttaaactcttcaccgcgcagcactccctgcgccagtgcctgactgaactgcgtgatcaccgaactggcttctgctgtactggcaccggataatttcaggcccgtggagatcgcctcggtgactttcagtacctcctcagaactgtaaccatactcccgcatggaagctgcagaacgggcaaaaaggctggcgttatcagaaaacgccgtccccgttctctggctgatcgccattaattcacgctgtgatgcctgaaaatcatcactggactgtgaggcctgcttcagacgggcatttactgaattccactcatcggcgaaagaaataagatgaccggtagcaaaagccccggcaaatgcccccgccatattcagtgccgaagatttagctgtatttatctgatccgtcacttctgccagtgcacgccgcatttcacgggatgcagcagcggactgccggcctccgttctgcatggtacggtagtaatcctgccccatacgcgaagcccgggagatctctgactggaatgaccgggaatttgccgagattttaataatcagttcacgtaatgtcgccacactcattctccggacgaaaaaaaaccgccgaagcggttatgttgactcactgagacactattaaaagcgcgttttccagtccggcaaatggatctgatacgccttctgtctgctccttctcccactgaagaagcgcatcattcagtggcactttgaccccctgcgcaccgtaaacagctgaaacaatctgggcagcccggatatcagcccgttcgtcccccagcgggctgaacctgtcaaattctgcccacatcatgatttctgatgcggacatttcccggcgtaactctgacaatgtgcgccccatcctgagcgccagcatcatcagaaaacgcatccccggaagcgctacttttttttaacctcgccggcatcactgatcagttccagagactgccgaagaagccgcgcatgcaccgggccatacacggcaatcacctgttcacgatcatcctctgaaaatacgggttgcagtccggtatcacacagaacatcaatgaacagttcaacatctgcctccagatttcggcgggcgcgctccgcaacggataacggtgtctcatcatcttttgctttaacgatctcctgccagcgcaaccaggcttctgcagaaggttcccgtaacacaaccgttgctccctcccattcaggcacatcaacggttttatggcgaaaccccgacatcgttgccagtgccagattacggatatttttagtcatcacatccatcctcattaactgacggttacagtgcaggaagtggaggtcactttgttaaccgggcttgctgaatcagaaatctcgcaggtatatgcacccgcatcaccggatactaccaatgccttactgaacgttgccgccgtctgtccggaaacaggagaaccacctttcttccagacataagaataaggcggcacaccacccgcagcctcaaccgccatttcaagtttcgctccggaagcaacccgcagcgtgctttttaaatcggccttcactttcagcggctctgtcgtcagcacaggtttacctttcaggcgcaaggaaaacgttgcagccacaacaccattggttcctgcagaccaggtatgctgacgcacctctgccataaaggtaaatccgttgcctgacggaaaaataactttaaagccatacgtggtgtcattgtcataggcactgcgcaacgcgttctgggcagcattcagataaaagttgcctgacatggaaatctctgaagcagccccaaggccgttaatattttcctgctcaacagaacacagcgtggtgacatcaatatcctgcttttgtcctgcggtaaactgcacctctttgattgtacagctcaggccaagatagctggcagaatccagggtttctgctgttaccggtgcagacgaaatcataattttcgtcagttgcgaacgctcaaaattagaggacatactcgtctcctgaaaataaaaaaacccgccagcggcgggtgggtaaaatcattaatgacctcaggctattacttggaattcaagcgtggctctgctcagacgggagtcaggatcataaccctgcgttttagaaataacggagggtgccagttttcttaccgcatcaagcgcctgctcacgaatattatctgcgtcatcaggtactgtcgcccagacatcgatctgcacggtaattctggattcagcctgcccatcaagcacatcagatgccgtgtcagacaccacagaaaacaccagccacggcggagataccgcaggctttccctccgtcagtgggaccacataaggataaacctgtcctccggccagctgagacaacagggaatacagtgtggcctctctcatttacttaagacctcatcaatagcctgattcattcgctgtatagcaatccgtgctgccagttcctctgtcgtatcgaaagccgggcgaatgaatggatgcgcgggcatgtttatcgttcccagctccacaaagcgccagtaaaatgcatttcggggatcgctggctttcatgctgttatcactgtttccggttcgcaggttccgtccgcgaatgtggacacccgagataatttccccccgacgctttgaacgctgagtgagaacaaccacatttttcttcagtttcccggttcgctccggcgcacgttcaacaactgcatcccgcataacttcagcaccggcacgggtggcatcgcgcagaaccttattgttttctgccctgctgagcgtctccaaatcccgtgcaatatccgccaggccggaaaaatcaagactgaaatccatcacacattccccttcaggctgcagagtatttcaagccgggtagcgcgtgcatccggtattggtggaccttctatacccagaatggcccctttaaatgcaccggtcagcactttcagacgtgaagtcgctgtcacatcgcgccggaatctcatccagactctgaccgtagcctgagcggtttctgctccgcctgagattatctccctcccgctgatacccttaacttctgcccatacggtagctccctccgtcaccgtctccaccggatgccctgacggagagcgggcggtggtgacattcagaataattacgcgatcacgtaatctgcccgcctgcatgtctcctcctacaaaggaataaaacgataaggctccagcagagaagaaaaaccaaacgggactggtgccttgctgacatctgaggaattttcccggttttcgtaccagtgcccgaccagcaacatgagcgccagcaaaacatcatcagctataagcaccccttcaggatcaccttccggcaccgtctcctcataaagcttacggttgataaaattttctgccttgcggcaggcagcccggaaatacagcatcagtaactcatcatcagttgcatcatctgtatcaatacggcactgcgccctgagtttttccactattgctgccatcagaaactcctgcccgcaacactgtgcgggcataaaaaaaccgcgtcggcgcggtctgtaactgaacaacgagtggttatttgccagtgagcgccttgatggctgccacatcttccagcacacagtcaaaacgatggaaagccagaaatgccacctgatcaaactcagcataacgctcaaccagacgtttcagttccatataagtaacgcggcgaatgataaagcggttgaaatcccccaggaaaatgaatttttttccggtaccaatcccgtcaatagcctgatcaataacataagggatccccagcacagtagccggcgtaccgcctgcaatatccggcagccataacgggcgtttctgtccatcctccatctcttcaatagtctgcaatgtggcatcattgaatgcccagcggtatttcggcccaccacgatatgccggatcaatggcatgtttcagggcattcatttctttccaggtgaaagcggcagaggctgcagtctggatgattcccgtcaccgacgctgccagcccttttggctgtaacggtgatcccgttccggtcccctgaaccagatatttcgcctctccacgaccaatacgctgggcaatacggtttgccagataagattcaatatccaccccactgtcctggagcagctcattggacacacgaattatttttgatgacagctttttagcccccagaatagcggtcccgaacgtcacatcctgttccgttgcggctgtattttccgccagcagttcgccctcttcagtcgtgccatcagacgttgaccaggtgatatcctgcccggttgatgtggtcagaagttgcgcaacactggcaatcccgccataagccttcatggtgtcaatgattttgttacgcatctgcgtgggcaccgtatatccgccctgagaatccgttgttacactctgagcccgcagttcacgcatcagattacgctcttcagcattcagttctgcaaatccggcacgcagaaaacggttaaatgccgcagcgcgcttctcttccaccgcctttttcccgttctccgcctcattattctggcgctcttccggcccggactcatccacatatgcctgatcctgacggcgcaactcttcttcacgggcgatttgctcatccagcgcatccagctcagctttcgccctgttccactctgcccgttgctcatcagtccatgcgttatcaccaattttttcatgcagtgcacgcatatcctttgcaatggtgtttcgtttttgcttcatctcatgaagtttcatcgtcagtagtatccttatgcattaagaagggtcaaaagacgctcacgcgccattcgttcgttaacagctttcttcagcgcaccactcgcccgcgcttcctgccaggctttcattgagcggacaccagagtctgcgtcctgataggccggatatgtcaccgggctgacgtcatacagacgagaaatgcgcgtgatttcccggataacaatcccctcgtcgtcttcataccagctctctccatcacgagcgacgcgaaacgcgaacgaggactgattaatgtcaccacgcaacattggtgacagcaccaggtcacaaatcgtcggcgtatccggtgcaacaatgtcgtaacgcaaaccacgttcatccactgataatgacaacgtgccggcagaacttcgtccgagaatgaaattaggatcatgattaaacaatccacgtacatcatcattcagcacgtcgtcaaaagcccccggcttgatgatttcacgaaatccccacagaggttctgaacgactgttaaataccgagccataccccaaaatatgagtcggggcattatcatattgttctgcccgcacttccccgctgtaacagcgcgtttcacggtcattcatcgttcttttcctctttgcctttcgtatctttaaaatcattcaacggatttgctgcatttacgctgaccagcatttcatccagaccatcaaccgggttcatgtcctcaaatgccctcgcttcattccggctcatccagccatctgtaatggcaaagtgataaaactgcgcacgctcctgtggagtcccgcggagcaatcctgtaaggttgaaacgaacgtaatacccggcagcccgttctgtgcgggtaaacaggcgacggttaagctcctgctcccagttcgcaacccagggcatcatcgtgtagcgaacaaactgaatcgcctgctgtgtaatattcgaaaatgtggctttttccaggtcattaatcatgtgcgccgggacattaaaaattccggcaatcatcgaccggttcagcttggtcatatcaatgatctgagcatccaccggagaaactgtcagggcacggtaatccagttgcgcaggcagcagcatggttttattttcctgactgcgaagcgctgtcaccgcccgctgccacatattcttgagcctgctccaactctgttcgttcagttcatttttcacagaaataatcccggcaggacgggcattaccgttaaaaaaagcactggtatactgctgaccactcattcccataccaatggtttcagcatgctgcatgatcggactcagtcccattttctgattgtttcccagcgccctgatatggatcatgtcgtccggacttaccgcaaatgcaccctcttcgttatacacaccgtaggtatgacgccctccagtgttaagtaacgtggtttcccatggcatacagcattcaagactggtaacctcgccacgacgattacgtttcacccacgtataaccattgccccaccccagcacatgacgctgcttcagttcccgccacttatagctggtctgccaggcattcggttcatcatgaacgagccagaacaacgggtgatcgcgtgccggctgaacatgctcattcgtttttcgcatcacatgcaggggcatctgagccacactggatgaaataacataaatacaggcatagacagcagccagcctcatggacgtttccggactgacatacacatcccgggcaaaaatattatccgtctcagcggcctctccggttaccggaaccgagggattttccagaggctcactgcgaaacagagcatcaagaagcatgttttctcctcatggacaccaccagtgcataaagcagcaacaaacagccagacagcatcagagacgctggcagacctgcatacagataaacgccagcagtgagcagaccgaaaccgatcagcccggtcatatcagtaataagctgtttcacagaattaacaggtcctcatcaggatcaagcgtggacagaaagtcattcacgcccccgccatttaccagaaagcggctcatggctgtaaaaagcgcaacagggccgtcgattttggcttccggcgtggatttattcgggaagatgttgtcgtttttgtccggttttacagtaacgttagacatcatccagttcatgaccggatgattgctgtgatggaaacgcccggcataaaccagtgattccgtttccttcatggcctctgacagattgcggaccgtctgcggaacctccaccagcggtatcccttcttcagccagtgccagactgaactgcattgcgctccacgggtcaaatcccagttccctgaggttttcaccgccaatccattccagtaagtcactttttatctgagcatgatcgataacatcaccatccgtcaggatgagcttatccatctccgcccacttccggtaaagttctgcctgctgccgcgagcatcgttccagccgtccttccggaagccagaatttaaaatcagcatgaacatgtccgttatcggttcgccagagttttgccgccgcacagatatcaatcttatgagcaaggtcgacgccgacccacatgggatatgttttcagctcatgttgtggagcaatgtattcgcacttctcccacttaatcatatccatccaggcagattcggcagtgacccacacattcatgtgtttggtaaaaaaattcacccgcgcagagacctgctccttcgcttttttcgccagacgacgcagatcatcccagcgtttacagatgcccaggccaggattcgctttctgccagaccgtttcatcaaacggatcatctccctcatcgagcgtgtaaatgatcgcaaagtaagagtcgtcttttacagcgccctccacgtcgctgttatagcctcgcaataccttgatggcgtaatcacgctgctcgtaacaaatcccttccttgttaaagccagccgtggtgataccaaataacagggactgcagacgggcaccggttgccgtttccagaacgtcccacacgtcgcgggttttatgtgcatgcagctcatcaataatggcgcagtggatgttcagaccgtccaggttgtttgcatccgaggaaagcggttcaaattttgatgcgctctgctcctggtaaatcgccagcttgttgaaatcaaacaaccgcccgagtgtcgaccgggcttttctgaccatatttttggcgtcttcaaacacgattctggcctggtcacgcgtggttgcggctgaatacacctcagctccgccttcactatctgcccccgtcatatacaggccgatacccgatgacagggttgattttgcgtttttacgggcgacttcgttgtacgccgtccggaaccggcgcaccatcaccggacgtccgctgccatcgctgcgcatgacaacttccccggtttcttcattgaccagcggaatgacaaaaccaaaaatattaatgaggataaatacatgccagtccatcaactcaatgggctggcctgccagtgccccttttacatgaggcacaaatttgtagaaattcaggatgtgctgcgcacggggttcactgaaataaatcccccgcttttcgccgtacttcagatcatcaagaaaacgctggcaggccaggcggacaaattcgccagcaacaatttctcctgcaacaacacgttcggcgtagcggatcccgtcagccacttttgccatcagtctctcgcttttaaaagctctgccagcggatcaacattatccggtccggcggtatttacttttgcccggcttgccggtgacataccaaattctgcaagcatcgcccggatccgcttccaggcatcagccttcatcgcagcagccgggtgtgccttgatcagcacatcgccattctgcgttttcgtgcggtaggtataaccctcaacatcgagtatttcgcagtgatgccggtattcggtgtaggcttccaccagtaactcgagcgcacgtgcatcgagctgagaaatgatcccttccgcattcagctcttccgccattcgcctgaaccagtacttcccctgcgcccctaaatgttgcggaattttagggagacctttttcatcctttttagcggtttttttggagtctttaactggccgctttgaggggttacctcgtatcaaatgcaggcgtggcggggttttcgggggtccagacataatcggttttacctatcaatcatttaatcacattccaaaaaaaagttttcgaacctgcggcgatgcgaggaaaggtcaggcggcggtactgagcagccagggttgcagagatttgacccgcccctcccctacagatgggaactgttatcaattgatgcgttcgcgcgctgtttttgctttatgacagggccagcacagactctgcaggttactgtctgcatccgtgccaccatgagctttcggaatgatgtggtccacagttctggcttcaacggctctcccattgcgcaggcagttctgacacagatgattatcacgcttcagtatgcgcgcacgtatggcatcccatttcgagccatagccacgctggtggcggctcagtccgcgttgatgctgtacccatccttcgccacgatgtttatcgcagtaaccagaactgtctgtggttgtacctacacatccacgcttacggcaggcgcgtgggattcgtgatggcataaatacctcataccctgcgaaatgtttaccacgataaaaaggctacttaatgcactgagtgcggatatactcctgtgccccttccagttgcatctgcatcgtcatcagccgctctctgagggtgaaataatcccgttcagcggtgtctgccagtcgggggctggttgcattatccacgccggaggcggtggtggcttcacgcactgactgacagactgctttgatgtgcaaccgacgacgaccagcggcaacatcagcgcgcagagtttcattttcagctttcgcattggctaattctctcgagtactttgcatcgagcgcagcaacatcacgctgacgctgctgcatgtcagcgatggtggcgatcgcctgcttcagctcactgacttttttatcacgctgttctttgtaggcgatggcgttatcacggtaatgattgaccgcccacgacaggcagacgatgatgcaaataaccagagcataaataatcgcggcgactctgctcactgatctatcccccaacaggctaatgcgctttcctggtcacgacgaataacctgtccatagcagttatttgaacgtatgcggcaatcgcgcccaccatcttttatccaccagcgaatcgcctcgcatgcgcccttacgatcaccggcattcagccgcttataaaacgtcgacggaaaacacttaccggggccaatgttatagggacagaatgacgcgatacccgctttttgtggttcggtcattggtactttaatattgcgctccacccatgccagcgccttatcacgctcaatggcgttgacctggtcgcatttttccttcgacagtttcataccgggaaaaacgggttttccatccaccatcgtggcaccccgacagatggtccagatgccggccccatcgcggtatgccgttgtgtggttaccttctttttcatccagaaactggtcaagtatttgaggagcagacgcacctgcagcaatcagcgccagaaccgcagctgacaggccgtatttgatttttgcgctcatggatatttatcaggatgctaccaatgaaagatactggaaagccaactgcaaaaagctaacaacctgtaatcgagttatcagaactgttaatttttatggtataccgcgcctctgaacaggggcgcgtttctggcaacagctcgtccccttcacataacccggcagcaacatctaggaagacctgtctgatgctccttctggctgctgcctcataaaactccagcgcggcaccttcaacacggtccagcgagatgtccaggtcaaaaatttcaccgtcaaagcgttttttgtcccgtaacgctaaagttaccgtaactttattctcaaaattgcggatccctttcacaatcagttcatagttttgagtcattgaattactctccccgtgcagccttacgcttgtcttctctgattttgaagtacagatttgtcagataagtcaggaagcccagaaccagactccccagaacaccaatcgcagcccactgtgacggactgacctgatcaagccactgtaaaaaccagtagccagcactgcctgcggaggtgccgtaggcaatgcccgttgaaattttgtccatggatttcatagcctcacctccgcaaataacggatggcgtagttttacactgagaaatgaaagggatttgaaaagaaaaacccgcaaaagcgggcgaaacgatatatacagaaaggaaagcactctatccaacaaaccacccacagttgatcggaataaaagcagagtgcttatgaatgatcgcctgcccgaaggttagtatttctgcacagcaattttgcaaaaaaaggcgatcattcataacttaaacgtctttcagtcactccgggatttcccatcatcgcagactgaaagactctgactggagcgggcagcgggaatcgaacccgcatcatcagcttggaaggctgaggtaatagccattatacgatgcccgcatatggtgccgactaccggaatcgaactggtgacctactgattacaagtcagttgctctacctactgagctaagtcggcactggaccgccaccggggactcgaacctcgcactctcaacttaaagggttgacgctctttcctgatgagctagtggcggttggtggcccttgctggatttgaaccagcgacctggcgattatgagtcgctcgctctcaccactgagctaaagggccatatgcggaataatacttatgccagtttagctctgcaataccctaccctgattaaatcctgcatattggcctacacatgataaaagaatctgagcggtcaacagaaagttactcaggcaatattaacgaactctgactacattaatttcaaagtcatcaatctgcccgctattaagtataacgaatgcagaactcccattactgtacgatttcgataaaaccagacgatcatcatagcgtgcaagaacgtaataccaagtattctcatagtggatcgtctgatattccctcttaaactggggtttataccaaccggcaataagagagaatgtccagaaataaatcatgaatccagccataataaactcaattcggtgatggcgaataaaagacacttccgaaaaacatttgactgaaataagtcttcttcctgacctgacaaaaagcgtaattgtaaaggcagcaataacacaaaaaaacagcacatctggctcaacgtgctgatgaattaccgaaaactccagaacaggcggaataaaaagcagcaatattgccagaaaaagtctgataaaactcaaattctgtatattgtttttttgttttatgcctaaaaagaaaacaatacctactccccatccagtaaggaatataacgataacgctcacagcataaaacaaacttcgggccacatcatcaacgccaaccccgacgatccaccatggaaagccatagtaaaaggaagtcccccatccatagaaataagcgcttccccatccaagacagcccatataagcaataaaaagtgaagagttcctcagcagagtgctgtcatccatacccatctctctaacaattttaaaacatcaactcatcttacataacaaaggagattccatgcagtcaagagacttcagagcaggagaaactcattgcgcaatcgccatcacgtttaacgttatgcaccgctttccagatataaaaaacccgctcgatggcgggctgtaaaaatccttctaacgtcaggcataaaacgcccatcgttagagcaaatttaccacagattcgggaaaaatcaacaacactatcgcgttaccctctttaactgccgctccgcccatgcctcttcaatgtcaaaccgaaccaccaacgtatcgtaaaagcgtttcactgattttttccacgtatcaagcgtgatagcactcgtcactttgcgtatggcattaaatgcctccgttgatggtagtctttcatagccccgaccgccacaacgctggcagttcctgattacaggcataccccgtttttccgactcttcacgatgaatggcaacaccacgcccacggcagtctttacaggcagtggaaatctcccccttccctttacattcaggacaagaaactttcaccacctcccggatttttttccattcttcccagtaagacggatacacacctttcgtacactttgcccatactggcggcttgccatccggatactgaaccttgtttgtaaaaacttcgctttcaataaatttttcccctcggcaacaggggcactgctttttactcgctgcgctgcgggcataatcctcaaaagcatacgaagccataatgcgcatcactgccggttttatttctgccggaagttttcttaacgccgccacgcgatcgcactgacttaatgcataatctgccagtaattctgttgcccgcgccctgtcattcatactaatacccattttccccaggaacgcagaaaatcccatctcagcccggttttgtgtcataccctgcgcagccatcacatcagtgatgctcagcgcatcttttgacgtcgagacggatgcatcagtcaggcctggcgattttggggaatagtatttcggtaaatcttccagtctcatttttggacctgcccgtcatgcattatttcgtaaatcttcacgcccaaccgaccaccaggaacgagctgaccgcgcacaatattgatttcatcaaactgctcgtcgtctataagtagtccggcatgcgtcagcgcatccagtggtgctttcaggatattgtccaggtcacgacggcgcttatccggtggctctgcaatcacctttatcgccagccttccggacaggtttgattttaaccgctgccggcgaacaattagcgccacatcacggcgataacgctcaccgacttttgatacaaaatatgtgttgccacgacgtcgccagtaagtattcaccgtcggcggataaggcaaaacaaactcaatacgcatcaataacctcttttacccaagcacgccggttgcaaaggcgtgatcaagaaaacgaaaaattaaatcaacctgggaaccatgcttttcttcgaacgccagcggatccgcatgaagttcgttgtgatgttcccggcacaacggtagcgtgaaaatatcgtgggcctttgttcccatccctccctgaccgtgaccaatcaggtgatggggatcgtcggctggctgaccacaacacgcacacggctgtgtcttcacccagcgcgtatatttctcatttacccaacggcgacgtttaggtcgcctcatgaaagattccggagagtccggatcaacggcaatgctgaccaccgccttttccagtggtgggttctgttgctggtggaagtgaggcaacggcgcaagattttttgtgcgctgctttagtatgctggtggcggtctgctctcccggtacgatgtcgctttcgcggtacaccgcgcggattttttccgcacgtaaccccagagaacgacgtaatactgcctccggaagcgcgtccgccacttgattgcagaccgcccaccaggataattcagccagcgataactcccgctcctgcgtgccattcattgcatggcgtatgacgtcaatcatccatgctgccaggttttgttgagcaagttgctcaagtgattcggatgtctggtcacgcagctggttatcgcagtgccagcacaacaccatcgcgccggtgccgtaacgatgtatgacggtttcactgtgatgatagtcaccatgaggccactggcaggatttgacatgacgcaacagccagtcagacagtgcaccagcgccgccagcagcacgaatcacacgctcattgctgaaaaaccgcagtaatgatttatcctccgccagcggctggcgaacggcagggacgatgccggacggcagaccacgcatgcttttcggttccggctccaccagcactcgagggttatggaatacctgcatggattcacggcctggtttaaggaccaccagcccaagttccggtaccggaacaggtcgaagtaatacccgcacgttacctccagatgcgttgctggaatgtgcgggacggacgcggtgggcgctcggagtacggcagcctgacgtagattatccagtgacgataatcgaggctgagggctttcttaacctcgtatccacgcctgcggtaacactgaattatccattcagcctgctcttcagtgcatggaggatgctggaaccagtctgatttgaatgcgtgaaaacgccgtccgcacctgctggcaaagacggcagaatcattagaattgtgtaatttggtatcgtgcgccatcggttgtctctgctggcgcagcaggtgccagttgttcaggctggcgtgcgaattgtaaaccagaatgccaggaaaaaacaaaacccgccgaagcgggttaagtgcgggtgcgttgaggatgcctgacacatcagaggtggcgagggatttctcccccgcctggtctcttactcctcaggttcgtaagctgtgaagacagcgacctccgtctggccggttcggattcgtacctcgcagaggtctttcctcgttaccagtgccgtcactatgacggttaaacagatgacgatcagggcgattaacatcgccttttgctgcttcatagcctgcttctccttgcctttcggcacgtaagaggctaacctacatgtgttcagcatggattgagcctcagattaatgttaagcgtcttgcaggacgcgtaatgttaactggggcttttctctatctgccttttggtgttcatgcctgaggcagatagcctcaagcacccgcagcaattctacttaactcacgtcacctcgccaatatgaaatcaatcagaaaggtgatccataaaatcactccttctcttcttttccgtagtggagttggccaattttgataagagggcgcccctgagatttgcggtgtagattggtatcgcgcagagaatacacacagccacaatattcctgctgatagaatttttcgcgcttgctgatttcaatcatacgggacgagccgccctgcttgcgccagttataatcccagtacaccatacccggataatgcgcaacagctcgccgcccacactcgttaacctgctgcatatttttccagcgtgaaatgcccagtgaactgctgatcacactgaaaccattttcagcagcgtacaacgctgtccgctcaaaacgcatgtcaaaacacatggtacaacggatccccctctcaggctcccattccattcctttggcacgttcaaaccagttgtcggtgtcgtaatcagcatcgataaacggcacgccgtgttgttcagcaaagcgaatattttcatccttacgaattaaatactctttctgaggatgaatgttcgggttgtagaaaaagatggtgtagtcgattcccgaggcctgaagcgcctccatcacttcaccggaacatggagcacagcaagagtgcagtagtagtttgtttgccccgtttgggagctccaatttaggccgtttgaaatcagcaatagtcataaatatttttattggggtcatgaaaatagcacagagtgtagcatcagagcagggctatcgggaatatatgtctaaatctggtaatatctggttttgacgcaaagcggacaaccacgctggctctaccctgcgccatgaaaatgtcaattcacatctgaactaatgctctttaatctagtaacgtctaaaatacctaacatttccttgataaaatgccagtacacgctgcatagcttcgctcttccggcactcgcgacagattatattcaggcgcctgtcgtagcggcgtatttcgccgtctggtaacgaccagataaggtccggatcaaccgcagatggtttattcagctttgcccttgagagctttttacgggcattttgccagtccttacgcgcctgttcagacgggaataacccgtaaccagagttgtatacatcgccactggcaaccagctctctggccagaacgctcatcagatatcttgttgccccagttttagcttccagttgtcgtaacgtctcgcgcccactctggcgtacgagttcaagaacctgccctttaattttttcccgctcttcttgtgtaaaaacttttgccacaagccctcctgaaaattacctcatgaccagaaattaacacttaccccctgaagcccggcggaatttcgttatccggttcagaaatatgattcacacaacgctggttgttcgtgccgcttaccgggagcaaccaggggttttcaaaattccggtccggtccaaaaaacgtcgtcgctcgctgaacaaattccgttcccgttttcccggtagccgccaggtatcttgcgtaacgcctcacaccatccagcatggcctctggtggcaccccctcgcgtaatctggccttccaggcactgaaagcggatttcttcgggtttgccccagcacgcaacgggtattcccgccagacctgttcgaacacatccggataatccactcgtcccacaggctgcccggtgttttccgggactacccgatcggcttcccgctgaatggcggaatcggcttcaggctgctgcagttggtgtgattgctccggccttgcggtcatcacctgctgcacagcgcccgaatcggctttcagcgcatacgctgaatcggcttccggtgtcgtgcctgctggctgaccaagattgacggtctgaacatcccctgcctggttcgtggcgttttttacgccatggaccatagtgttttgatcttcttgatctgtatctttatctgtatctttatctgtcgtgactcgtcgtgacatgtgcgtg

SEQ ID NO: 10022 - DNA, 52796 bp, Escherichia coli
gagaattatcagtccattcacttactgtgatgatggagagcatgtcggtgcctttatccgtgaagtcaatggtaggtatttagttagtgacagatgcgatgccttaatgaatatggaggcaagagggatctcgcttaccaaaaaacgacttgatgagatacgacaattactgcttaaagaaggcgcagaactcaatgctcgaggagaaatcattgcttgggcaacagaaaaggatgtcggtgcgattacatcgaacataattagagctggtatactcgcatcaactttgtcgttagactggtatcagccagttcaagctgaaaagtttgaaagtatggttattgattatctatatcacacagagcttagagacgcactttctcttcgtgaaaacgtatatggcttgagtggacatcaaattaccgtccctgtaacaataaaaaccgacatacctaaatacgtttttacatcaagcgtgaaacacggaggaagctggaatagtgcttactcattgcttgggaaactaattgatcttaaagcttcaagtgaggagtataacaacagatttgttgttatagacagcgaagcaattggtgatcaaatgcaacaactctccttactcttccatgaatcaagccaagttctaccattctccaaaagagagacttgggttaagagacttgcagcataatacaacccggcctcagcgccgggttttctttgcctcacgttcgcccacctaaaaacacataaccaattatatttattgaaaaataaatagatgcaacccactaaaccacgcaattctgatctctccttacatcgccgaggcaatacatccacgctaaaaaacaacactattaaatacaaagcgttataaaaaaccacgccaacttacaacaaattgtattgatcttgtaaagtacatatcgtactatttaaccgtcagcaggacgctggaagccaaatggaacagactggcaggctctttaaacaacgtcgactctcgactacgtggctgaaaagccagatcacccaaccacataagctgtgggatgcaatgccgaagcaaccgtctcaggaggagcttcgagattgcatcgccaaagtttattcgggaggaatccatgtccagaaaaacagaatttaaaggcaccgcagcttctcgccgtagagctcgtcgcgcaaatctgcaaagtcaggaggcgatcagctccgacaagctacacaggccaaccccttcacgagtggtcttgcaatgcaagctcaaaccagcaatgagagcagaagtgataactctgacaacgttgaccagaaaatatgaaggttcaacttgtcttccgaacgtagctctttacgcggcaggctaccggaaatcaaaacaactgacggcgagatgataaattcatttgctaattacttgtttttgccatgcttatcctgagcgataagttcatccataaggctgtctgccttcccggcaaacctaatgtagcactcatgtctatagctttcagggataacgaaacggtcggtatcaggatatccaacagcaggaggccttcgaacgaggagtccttttttgagcaatgaaattgattcatgagcgcccttttccgtttgtagctggttattagcggctacagcgaatgccaaatacgctctttctccaagagttaacgaatcaaacaaatcttgcacatatttttcttctttagatttgcgcttctgagcagcgaatacctcaattctttcagtcacagcgtgataagcggaattaacaacgccgttaagcacatagctaacgcaaaacaacaggatgtaatacatccagtaatgaggaaggatttctggattatgcaggtttatccattcttttacgcttaccggcataacaataatcaatatgatcaggatgattagcatatgaatcaactgtttaagtgtcattccttgcaggaaaaaatgcattagttcctgccaccatgagttgttcatcggcgtttctcttttgctctctgtaggggtgaatagagtttatccgatttctcgttgtaggggtacacgagaaccaccgagcctgatgtggttaaaagacaggcacaatctttactaccgcaatccactatttaaggtgatatatggaagaagaatttgaagagttcgaagagcatcctcaagatgtgatggaacaataccaggactatccgtatgactacgactattgatacaaatcaatggtgtggacaattcaaacgatgcaatggatgcaagctgcaatcggaatgcatggttaagcctgaagaaatgtttcctgtaatggaagatgggaaatatgtcgataaatgggcaatacgaacgacggcaatgattgccagagaacttggtaaacagaacaacaaagctgcctgatagtggcctttatttttggcataaataacagaataaacactgcactgtgtattcattccaacgagtgaatacacggagcaatgtcgctcgtaactaaacaggagccgacttgttctgattattggaaatcttctttgccctccagtgtgagggcgattttttatctatgaggatatgaatagatgtcaaacatcaaaaaatacatcattgattacgactggaaagcatcaatagaaattgaaattgaccatgacgtaatgacagaggaaaaacttcaccagattaataatttctggtcagactctgaataccgactcaataaacacggctctgtattaaatgctgtattaatcatgctggcgcaacatgctctgcttatagcaatttcaagcgacttaaatgcatatggtgttgtgtgtgagttcgactggaatgatggaaatggtcaggaaggatggcctccaatggatggtagtgaaggaataagaattaccgatatcgatacatcaggaatatttgattcagatgatatgactatcaaggccgcctgagcgcggcgttaccgcataccaattacgcttcactcgaggcgtttttcgttatgtataaataaggagcacaccatgcaatatgccattgcagggtggcctgttgctggctgcccttccgaatctttacttgaacgaatcacccgtaaattacgtgacggatggaaacgccttatcgacatacttaatcagccaggagtcccaaaaaatggatcaaacaattatggctatccagactaaattcactatcgccacttttattggcgatgaaaagatgtttcgtgaggccgtcgacgcttataaaaaatggatattaatactgaaactgagatcaagcaaaagcattcactaaccccctttcctgttttcctaatcagcctggcatttcgcgggcgatattttcacagccattttcaggagttcagccatgaacgcttattacattcaggatcgtcttgaggctcagagctgggcgcgtcactaccagcagatcgcccgtgaagagaaagaggcagaactggcagacgacatggaaaaaggcctgccccagcacctgtttgaatcgctatgcatcgatcatttacaacgccacggggccagcaaaaaagccattacccgtgcgtttgatgacgatgttgagtttcaggagcgcatggcagaacacatccggtacatagttgaaaccattgctcaccatcaggctgatattgattcagaggtataaaacggatgagtacagcactcgcaacgctggcagggaagctggctgaacgtgtcggcatggattctgtcgacccacaggaactgatcaccactcttcgccagacggcatttaaaggtgatgccagcgatgcgcagttcatcgcattgttgatcgtcgccaaccagtacggccttaatccgtggacgaaagaaatttacgccttccctgataagcagaacggcattgttccggtggtgggcgttgatggctggtcccgcatcatcaatgaaaaccagcagtttgatggtatggactttgagcaggacaatgaatcatgtacatgccggatttaccgcaaagaccgcaatcatccgatctgcgttaccgagtggatggatgaatgccgccgcgaaccattcaaaacccgcgaaggcagagaaatcacggggccgtggcagtcgcatcccaaacggatgttacggcataaagccatgattcagtgtgcccgtctggccttcggatttgctggtatctatgacaaggatgaagccgagcgcattgtcgaaaataccgcatacactgcagaacgtcagccggaacgcgacatcactccggttaacgatgaaaccatgcaggagattaacactctgctgattgccctggacaaaacatgggatgacgacttattgccgctctgttcccagatatttcgccgcgacattcgcgcatcgtcagaactgacacaggccgaagcagtgaaagctcttggattcctgaaacagaaagccactgagcagaaggtggcagcatgacaccggacattatcctgcagcgtaccgggatcgacgtgagagctgtcgaacagggggatgatgcatggcacaaattacggctcggcgtcatcaccgcttcagaagttcacaacgtgatagcaaagccccgctcaggaaagaagtggcctgacatgaaaatgtcctacttccacaccctgctggctgaggtttgcaccggtgtggctccggaagttaatgctaaggcgctggcgtggggaaaacagtacgagaacgacgccagaaccctgtttgaattcacttccggcgtgaatgttactgaatccccgatcatctatcgcgacgaaagtatgcgcaccgcctgctctcccgatggtttatgcagtgacggcaatggccttgagctgaaatgcccgtttacctcccgggatttcatgaagttccggctcggtggtttcgaggccataaagtcggcttacatggcccaggtgcagtacagcatgtgggtgacacgaaaagatgcctggtactttgccaactatgacccacgaatgaagcgtgaaggcctgcattatgtcgtggttgagcgggatgaaaagtacatggcgagttttgacgagatggtgccggagttcatcgaaaaaatggacgaagcactggctgaaattggttttgtatttggagagcaatggcgatgacccatcctcacgataatatccgggtaggcgcgatcactttcgtctactccgttacaaagcgaggctgggtatttcacggtctttctgttatccgaaatccgctgaaagcccagcggctggctgaggagataaataataaacggggggcggtatgcacaaagcatctcctgttgagttaagaacgagtattgatttggcacatagccttgctcaaattggagtcaggtttgtgccaataccagcagaaacagacgaagaatttcatacgttagccacatccctttcacaaaagctggaaatgatggtggcgaaagcagaagcagatgagagagaccaggtatgacaaccactgaatgcatttttctggcagcgggcttcatattctgtgtgcttatgcttgccgacatggggcttgttcagtgacacctcagcaagaaaacgcccttcgcagcattgcccgtcaggctaattctgaaatcaaaaaagtcagacagcagtttccaaaaacgtcaatgacatttgccgtagcgtactgaagaagcaccgcgaaacggtaacgctgaagggattcacaccgactcatttaagcctggcaatcggcatgttaaacggcgtctttaaggaacgatgaacatgaaaagcaaaattatcagggagctacaggctccttttttattgttcgcattcaccctcaagcgtattaaccaacagttcagggattaatgaaagatggcagacatcattgattcagcatcagaaatagaagaattacagcgcaacacagcaataaaaatgcgccgcctgaactacctggctgtatctgccactcattgttgtgagtgtggcgatccgatagatgaacgaagacgcctggccgttcagggttgtcggacttgcgccagttgccagcaagatctggagcttatccgcaaacaaagggggattaagtgatggctaacctgcaacttgctgttaaaagtgaatacttcgatgccatgattcgcggagagaaaacggaagagtatcgcttgtgtaatgactactggaataagcgaattatgttccgggaatatgaccgcctgattatcacaaagggatatccgaagcgcgacgattccagtcgcagaattgatgttccgtatgacggatatgaagtgaagacaatcacacatccgcactttggcgataaaccggtaaaggtgttcgctataaaggtgaatatcagcactgaatatcaatccgcacaacacaaggtcaagaatgttcagagtgattgaccctaacacctggtacgtcgaccaccacggcactccctgcaaaatcctgcgttctacccacaacaaagttcactacatccgaaaaggcagaacatgtatcgccagcatgttccgctttaatcatgactttgaacctgtgaataaagctgatgcagatcggatagcagaagagatcgaaacggcagaacacattaagaagttacgtgacatgcgcaggaaatagaaaaattgataaattcaatactgcatttctcagcattaaatttatctctatgaccagtcaagagatgtacctgccatgagcttaatatcatgtcagatatatcggtcacaaactccctcagcagctaagaggaggacaaatgtctcgactaatcactttacaggactgggctaaagaagaatttggggacttagcaccaagtgagcgagttctgaaaaaatacgcgcaagggaaaatgatggccccacccgctataaaagttggtcgctactggatgattgaccgaaattcccgttttgtaggaacgcttgcagaaccgcaactcccaataaacgcaaacccaaaactccaaaggataatcgctgatggctgctagaccccgatctcacaaaatctctatacccaatttatattgcaaattagataagcgaaccggaaaggtatattggcaatacaaacatccactatccggtcgttttcatagcttaggaactgatgagaatgaagcaaaacaagttgctactgaagcaaataccattattgctgaacaacgtaccagacaaatattaagcgtcaatgagcgtctggaaagaatgaaaggcaggcgctcagacattacggtgacagaatggcttgataaatatatttctatccaagaggacaggctgcaacataatgaactaagacccaactcctatcggcaaaaaggcaaacccattcgtcttttccgtgagcattgtggaatgcaacacctcaaggatattaccgcacttgatattgccgaaataattgatgctgtaaaggctgaaggtcataacaggatggcgcaagtcgtgagaatggtgttgatcgacgtcttcaaagaagcacaacacgcaggacatgttccgccaggatttaacccagcgcaggcaacaaaacaaccgcgaaatcgagtaaaccgccaaagattgtcactgcccgaatggcaggcaatatttgacagcgtaagcagacggcagccctatttaaaatgcggcatgctacttgctcttgttactggacaacgtttaggcgatatctgcaatttgaaattctctgatatatgggacgacatgttgcacattactcaggaaaaaaccggttcaaaacttgctattccgcttaacctgaaatgcgatgctctgaatattacccttcgtgaagttatatctcagtgcagggatgctgttgttagtaaatatctggtccattaccgtcacactacctctcaagcaaacagaggagaccaggtttctgcgaatactctgacaacggcttttaaaaaggcccgggaaaaatgtggcataaaatgggagcaaggaactgcgcccacatttcatgagcagcgatctctgtcagaacggttatatcgggaacagggtctggatacgcaaaagttgttaggccataaatccagaaaaatgaccgaccgatacaatgatgatcgtggtaaagactggattatcgtagatatcaaaacagcatagaaaatagccagttttggggaagggttttggggaaagttttggggaagattttacatcatcataaaacaacgggcgtgttatacgcccgtttcaatatttaacacatgtagtgattacatattcttgatgatcgcgtcaccaaactctgaacatttcagcagtttagcgccttccatcagacgttcgaagtcataggttacggtcttggcattgattgcgccttccatacctttaacaatcaggtcagccgcttcagtccaacccatatggcgcagcatcatctcagcggagagaataatagagcctgggtttactttgtcctgtccggcatatttcggcgcagtaccgtgggtggcttcaaacagggcgcattcgtcaccgatgtttgcgccaggggcgataccgataccaccaacctgcgctgccagggcgtcagaaatgtagtcaccgttcaggttcatacaggcgataacatcatattcagccggacgcagcaggatctgttgcaggaatgcatcagcaatcacgtctttaatgacgatctctttgccggtattcgggtttttaactttcagccacgggccgccgtcgatcagttcaccgccaaattcttcacgcgccagttggtagccccagtctttaaacgcgccttcggtgaacttcatgatgttgcctttgtgcaccagggtcacagagtcacgatcgttagcaattgcgtattcgatcgctgcacgaaccagacgtttggtgccttcttccgaacacggcttaataccgataccgcaatgttccgggaagcgaattttcttcacgcccatctcttcacgcaggaatttaatcactttctcagcgtcggcagagtctgctttccattcgatacccgcataaatgtcttccgagttttcacggaagataaccatatcggtcagttcagggtgtttaaccgggcttggagtgccctgatagtaacgtaccggacgcaggcagatgtagagatccagttcctggcgcagggcaacgttcagagagcgaataccgccaccaaccggagtggtcagcgggcctttaatggcaacgcgatattcacgaatcagatcaagggtttcagcaggcaaccagacgtcctgaccataaacctgtgtggatttttcaccggtgtaaatttccatccaggagattttacgctcgcctttataggctttctcaactgcagcgtcgaccactttcagcatggctggggttacatctacaccgattccatcaccttcaatgtaagggataatcggattttcaggaacgttgagtttgccgttttgcagggtgatcttcttgccttgtgccggaacaactactttactttccattcacctctccttcgagcgctactggtttgctcgtctaccaccacgttgcatatgcgtttgcgtcctgcgatacggatgctttagagcaattttttgttaatgatttgtaattggcttgtcaatactaccctattgtttgccgtcatgaaagatgcgcgttattaggctataatgcggcaattcataatctctgaaaataccatgcaaaaaacttcttttagaaatcaccaggttaagcgattcagctcgcaacgttctaccaggcgtaaacctgaaaaccagcccacgcgtgtgatcctgttcaataaaccctacgatgttcttccgcagttcaccgatgaagccggacgcaaaacattaaaagaattcatcccggttcagggggtgtatgcggcaggtcgtctcgaccgcgacagcgaagggttactggtgctgaccaataacggcgcgttgcaggcgcgtttaacccagccgggtaaacgcaccggaaaaatctattatgtgcaggtggaaggtattcccacacaagacgcacttgaagccttgcgcaatggcgtaaccttaaatgatggccctaccctgcccgcaggcgcggagctggttgaagaacccgcgtggttatggccgcggaatccaccaattcgtgagcgcaaaagtattcccaccagctggctgaagatcaccttatatgagggacgtaatcgccaggtgcgccgcatgaccgcccatgttggtttccccacgctgcgactgattcgctatgcgatgggggattactctttggataatcttgccaatggcgaatggcgagacgcgacagattaaggatgcaaaatgtttaaaccgcacgttaccgttgcctgcgtggtgcacgcagaaggcaaatttttagtcgttgaagagacgattaatggtaaagcgttatggaaccaacctgccgggcacctggaagccgatgaaaccttagtggaagccgccgcccgtgagctgtgggaagaaaccggcattagcgcgcagccgcaacactttattcgtatgcatcagtggattgcgccggataaaacgccgtttttgcgtttcctctttgccattgagcttgagcaaatatgcccgacgcagcctcatgacagcgatatcgactgctgccgttgggtcagcgccgaagaaattttacaggcgtcaaatcttcgttcgccgctggtggcggaaagtattcgttgttatcaaagcgggcaacgctatccgctggagatgattggcgattttaactggccttttacaaagggtgtcatctaaaaggctgcgtgatagaatacgccgccttgaagttcaatgtcgtgagtgatccaatgtctgaaaccgcaaaaaaagtaatcgtcggcatgtccggcggtgtcgattcctccgtttctgcctggctgttgcaacaacagggatatcaggtcgaaggcctgtttatgaagaactgggaagaagacgacggtgaggaatattgcacagcggcagcggatctggctgatgcccaggctgtctgcgacaagctcggcattgaactgcacaccgttaactttgctgccgagtactgggacaacgtcttcgaactgttccttgccgaatataaagccggtcgcacgccaaatccggatattctgtgcaacaaagagatcaaatttaaagctttcctcgaatttgccgccgaagatttaggtgccgattatatcgctaccggtcattacgtacgtcgggcagatgtcgatggcaagagccgcctgctgcgtggcctggacagcaataaagaccagagctacttcctttatacgctcagccatgagcaaattgcgcaaagcctgttcccggtcggcgaactggaaaaaccgcaggtgcgtaagattgctgaagatctcggtctggtcaccgcgaagaaaaaagactctaccggtatctgctttatcggcgagcgtaaattccgcgagttcctgggccgttatctcccggcgcaaccgggcaaaatcattaccgtcgatggcgatgaaattggtgagcaccaggggctgatgtatcacaccctcggtcagcgtaaaggtctgggtatcggtggcaccaaagacggcaccgaagaaccgtggtatgtggtcgataaagacgtcgaaaacaacattctgattgttgcgcaaggccatgaacacccgcgtctgatgtctgtcggtctgattgcccagcagctgcactgggtcgatcgcgagccgttcaccggtactatgcgttgcacagtaaaaacccgctatcgccagaccgacatcccgtgcaccgtcaaggcgctggacgctgatcgcattgaagtgattttcgatgagccggttgccgccgtgacgccgggccagtctgccgttttctataacggtgaagtgtgcctcggtggcggtattattgagcagcgtctgccgctgccggtctgattattatctttacttaaaacaaggaagcagtgaacgtggcaaagaattactatgacatcaccctcgcccttgccggtatttgtcagtcggcacgcctggtgcaacaactcgctcaccaggggcattgtgatggcgatgcgctacacgtctcactcaacagtattatcgatatgaaccccagctcaacgctggcggtttttggcggtagcgaagccaacctgcgcgtcgggctggaaaccttgctcggcgtactcaatgccagcagtcgccagggcttaaacgccgaattaacccgctacacactcagtctgatggtgcttgagcgcaaactctcctcagcgaaaggtgcgctcgacactctgggcaaccggatcaacggcctgcaacgccagctcgaacacttcgatttacagtccgaaacgctgatgagcgcgatggctgccatctatgttgatgttatcagcccgcttggcccgcgcattcaggtcactggttcccctgctgtactgcaaagcccacaggtgcaggcgaaagttcgcgcaaccctgctggcaggcattcgcgccgccgtgctctggcaccaggtcggcggcggtcgtctgcaactgatgttttctcgtaatcgcctgaccactcaggcaaaacaaattcttgctcatttaaccccggagttgtgatctatggaattatcctcactgaccgccgtttcccctgtcgatggacgctacggcgataaagtcagcgcgctgcgcgggattttcagcgaatacggtttgctgaaattccgtgtacaagttgaagtacgttggctgcaaaaactggccgcgcacgcagcgatcaaggaagttcctgcttttgctgccgacgcaatcggttaccttgatgcaattgtcgccagtttcagcgaagaagatgcagcacgcatcaaaaccatcgagcgtaccactaaccacgacgttaaagcggttgagtatttcctgaaagaaaaagtggcggatatcccggaactgcacgcggtttctgaattcatccactttgcctgtacttcggaagatatcaataacctctcccacgcattaatgctgaaaaccgcgcgtgatgaagtgatcctgccgtactggcgtcaactgattgatggcattaaagatctcgccgttcagtatcgcgatatcccgctgctgtctcgtacccacggtcagccagccacgccgtcaaccatcggtaaagagatggctaatgtcgcctaccgtatggagcgccagtaccgccagcttaatcaggtggagatcctcggcaaaatcaacggcgctgtcggtaactacaacgcccacatcgccgcttacccggaagttgactggcatcagttcagcgaagagttcgtcacctcgctgggtattcagtggaacccgtacaccacccagatcgaaccgcacgactacattgccgaactgtttgattgcgttgcgcgcttcaacaccattctgatcgactttgaccgtgacgtctggggttatatcgcccttaaccacttcaaacagaaaaccattgctggtgagattggttcttccaccatgccgcataaagttaacccgatcgacttcgaaaactccgaagggaacctgggcctttccaacgcggtattgcagcacctggcaagcaaactgccagtttcccgctggcagcgtgacctgaccgactccaccgtgctgcgtaacctcggcgtgggtatcggttatgcgctgattgcgtatcaatccaccctgaaaggcgtgagcaaactggaagtgaaccgtgaccatctactggatgaactggatcacaactgggaagtgctggctgaaccaatccagacagttatgcgtcgctatggcatcgaaaaaccgtacgagaagctgaaagagctgactcgcggtaagcgcgttgacgccgaaggcatgaagcagtttatcgatggtctggcgttgccagaagaagagaaagcccgcctgaaagcgatgacgccggctaactacattggtcgcgccatcaccatggttgatgagctgaaataagcctcaaaacagtgccggatggcgatgctgtccggcctgcttattaagattatccactttttgttttttcactttacctcccctccccgctggtttatttaatgtttacccccataaccacataatcgcgttacactattttaataattaagacagggagaaataaaaatgcgcgtactggttgttgaagacaatgcgttgttacgtcaccatcttaaagttcagatacaggatgctggtcatcaggtcgatgacgcagaagatgccaaagaagccgattattatctcaatgaacatttacctgatattgcgattgtcgatctcggattgcctgacgaggatggtctgtcactgattcgccgctggcgtagcaatgatgtttcactgccgattctggtattaaccgcccgtgagagctggcaggacaaagtcgaagtattaagtgccggtgctgatgattacgtgactaaaccgtttcatattgaagaggtgatggcgcgaatgcaggcattaatgcggcgtaatagcggtctggcttcacaggtcatttcgctaccaccgtttcaggttgatctctcccgccgtgaattatctattaatgacgaagtgatcaaactgaccgcgttcgaatacaccattatggaaacgttgatacgcaataatggcaaagtggtgagcaaagattcgttaatgctccaactctatccggatgcggagctgcgggaaagtcataccatagatgtactgatgggacgtctgcgcaaaaaaatacaggcacaatatccgcaagaagtgattaccaccgttcgcggccagggctatctgttcgaattgcgctgatgaaaaaattactgcatctttttttcccgctctcgctgcgggtacgttttctgttagcaacggcagcagtagtattggtgctttcgcttgcctacggaatggttgcgctgatcggttatagcgtcagtttcgataaaaccacgtttcggctgttacgtggcgagagcaatctgttctatacccttgcgaagtgggaaaacaataagttgcatgtcgagttacccgaaaatatcgacaagcaaagccccacgatgacactaatttatgatgagaacgggcagcttttatgggcgcaacgtgacgtgccctggctgatgaagatgatccagcctgactggctgaaatcgaatggttttcatgaaattgaagcggatgttaacgataccagcctcttgctgagtggagatcattcgatacagcaacagttgcaggaagtgcgggaagatgatgacgacgcggagatgacccactcggtggcggtaaacgtctacccggcaacatcgcggatgccaaagttaaccattgtggtggtggataccattccggtggagctaaaaagttcctatatggtctggagctggtttatctatgtgctctcagccaatctgctgttagtgatcccgctgctgtgggtcgccgcctggtggagtttacgccccatcgaagccctggcaaaagaagtccgcgaactggaagaacataaccgtgaattgctcaatccagccacaacgcgagaactgaccagtctggtacgaaacctgaaccgactgttaaaaagtgaacgcgaacgttacgacaaatatcgtacaacgctcaccgacctgacccatagtctgaaaacgccactggcggtgctgcaaagtacgctgcgttctctgcgtagtgagaagatgagcgtcagtgatgctgagccggtaatgctggagcaaatcagccgcatttcacagcaaattggctactacctgcatcgtgccagtatgcgcggcgggacattgcttagccgcgagctgcatccggtcgcgccactgttggacaatctcacctcggcgctgaacaaagtgtatcaacgcaaaggtgtcaatatctctctcgatatctcgccagaaatcagctttgttggtgagcagaatgattttgtcgaagtgatgggcaacgtgctggataacgcctgtaaatattgcctcgagtttgtcgaaatttctgcaaggcaaaccgacgagcatctctatattgtggtcgaggatgatggccccggtattccattaagcaagcgagaggtcattttcgaccgtggtcaacgggttgatactttacgccctgggcaaggtgtggggctggcggtagcccgcgaaatcaccgagcaatatgagggtaaaatcgtcgccggagagagcatgctgggcggtgcgcggatggaggtgatttttggtcgccagcattctgcgccgaaagatgaataaatatgtccatacttcacgcattacgttaagcatccgttataatcggttgcagataccagcctgtggatgcttaacatggaataccaactcactcttaactggcccgattttcttgaacgtcactggcagaaacgcccggtggtgttaaaacgcggctttaataattttattgacccgatctctccagacgagttggcgggtctggcgatggaaagcgaagtcgacagtcgactggtcagtcatcaggatggcaaatggcaggtcagccacggtccattcgaaagctacgatcatctcggtgaaactaactggtcattgttagtgcaagcagtgaaccactggcatgagccgaccgctgcgctaatgcgaccgttccgtgaactaccggactggcgtattgatgatctgatgatctctttttctgtaccgggcggcggcgtcggcccgcatctcgatcagtacgacgtgtttatcattcagggtaccggtcgtcgtcgctggcgagtgggcgaaaagctgcaaatgaaacagcactgcccgcacccggacctgttacaggtcgatccgttcgaagccatcatcgatgaagagctggagcctggcgatattctttatattccgccaggattcccgcatgaaggctacgcgctggaaaatgcgatgaactattccgtgggttttcgcgcgccaaatacgcgggaactgattagcggatttgccgattatgtgctgcaacgtgaactgggcggcaactactacagcgatcctgatgttccacctcgcgctcatcctgcggacgttctgccgcaagagatggataaactgcgtgagatgatgctcgaattgatcaaccagccggaacactttaaacaatggtttggcgagtttatatcccagtcacgtcatgaactggacatcgcgccgccagagccgccttatcagccggatgaaatctacgatgcgctgaaacaaggtgatgtgctggtgcgcctggggggtctgcgcgtattgcgcattggcgacgacgtgtatgccaatggtgagaagatcgattccccgcaccgtccggcactggatgcgctcgccagcaacattgcgctgaccgcggagaattttggcgatgcgctggaagatccgtcattcctcgcgatgctcgcggcgctggtcaatagcggatactggttcttcgaagggtaagtttggatttaagccggatgcggcatcacatgccgcatcccttttcgcttacttccgttgcgccgtcaactcggcaatacggacgatcacctgcaccgctttttccataccttccagagtcacaaactcatgcttaccatgatagttgtaaccgccagtgaacaggttcgggcacggtaatcccataaacgacaactgcgcgccgtcggtaccgccgcggatcggtttcagttccggttcaatatcgcagtcacgcatcgcctgctgggcgatatcgagaatatgcggatgctcaaccactttctcgcgcatattgtagtaactgtcttcaatcaccagttcaatgtagcaatcaggatgtaaccctttgcccacttttttggcgatctccatcattttacgtttacgcgcttcaaactgtttacggtcgaaatcacggatgatgtagtgcatatcggcccgttcaacggtgcctttcatgctcgccaggtgatagaaaccttcatagccttctgtcatttccgggctttcatccgccggaacttccgcatgaatacgtgccgccagcgacagcgcatttaccatcactcctttcgccgtgcccgggtgaacattgttaccgacaattttgatattgaccgacgcggcgttgaagttttcaaactccagttcgccgacgccaccaccatcaacggtgtatgcccagcgggcatcgaaggcgtcaacatcaaaatgcttcgcccctttgcccacttcttcatccggggtaaaggcgacgcgaatatcaccatgcggaatgtttttttgttgcaataccgccagcgcggtcatgatttctgcaatacctgctttgtcatcggcacctaacaaggttttaccatcggtggtaatcagcgtctgacccagtagctgatgcagcaccgggaacataaccggtgataaaacttcatcgccgatacccagcgcaatatcgccaccgcgatagttttcaacaatttgcggattcacatttttgccgctgcaatccggtgaggtatccacatgagaaataaagccaatcgccgggatatcgccagggacgttagccggtaacgtcgccatcaaagtgcccttctcacttaaggtcacattgataagccccatctcttcgagctgctctttcagcagatgcaataacttccattggccttccgtgctgggaacctgtctcacccctgcctttgattgggtatccagagacacgtagttcaaaaatcgctcaagtagtttatccatgtagtcaccctcactttttgtgacaacattattaagaagcaagaaaagacaaatattgcgtcaggtcacttttagccctgcaagcgggaatatttatcagcattaccttaatgaatataaagctaagccagtaattcacaacaaagattggcgattcaagcggtttgccgtagaattaccgccctcattaagagtcaccaaggtggttaaccacaaaccccgcatcggtaagccatccgttgcgtttacatgggacagagtaaaaaattgaataaacaaccgaattcgctttcaccgctggtgcaattggcgggaattcgcaaatgctttgatggtaaagaggtcattccccagctggatctgactatcaacaatggcgagttcctcacgctgcttggcccttctggctgcggtaaaacaaccgttcttcgcctgattgcaggtctggaaactgttgattccggacgcatcatgctggataacgaggacatcacccacgttccggcggaaaaccgctatgtgaacactgttttccaaagctacgcacttttcccccacatgaccgtgttcgaaaatgtggcctttgggttgcgcatgcaaaaaacccccgctgctgaaattacgccccgcgtgatggaagccctgcggatggtgcagctggaaaccttcgctcaacgcaaaccgcatcagctctctggtggtcaacagcaacgcgtcgccattgctcgcgcggtggttaacaagcctcgtctgttgttgctggatgagtcgctctcagcgctggattacaaactgcgcaagcaaatgcagaacgagctgaaagcgttacagcgtaagcttggcattacattcgtgttcgtaactcacgaccaggaagaagcacttaccatgtcggacaggatcgtggtgatgcgcgatggtcgcattgagcaagacggcacgccgcgtgaaatctacgaagagccgaaaaacctgtttgttgccgggtttattggcgaaatcaatatgtttaacgccactgtcatcgaacgtctcgacgagcagcgcgtacgcgccaacgttgaaggccgcgaatgtaatatctacgttaacttcgccgttgaaccggggcaaaaactgcatgttctgctgcgcccggaagacttacgtgttgaagagattaacgacgacaaccacgccgaagggctgattggttacgttcgcgagcgtaactacaaaggcatgacgctggagtcggttgttgagctggaaaatggcaagatggtgatggtcagcgaattcttcaatgaagacgatcctgactttgaccactctctcgaccaaaaaatggccattaattgggtagaaagctgggaggtcgtactggctgatgaagaacacaagtaagttccagaatgtagtgattgtcactattgtcggttggcttgtgttgtttgtctttctgcccaacctgatgatcattggcaccagctttttgacccgcgacgacgccagtttcgtcaaaatggtctttacgctggataactacacgcgtctgctcgatccgctctattttgaagtgctattgcactcgctgaatatggcgctgatcgccaccctcgcctgcctggtgctgggctatccttttgcctggtttctggcgaagctgccacacaaggtgcgtccgctgctgctgtttctgctgattgttccgttctggaccaactcattgattcgtatttacgggctgaaaattttcctcagcaccaaaggctatctcaacgagtttttgctctggctgggcgttatcgatacaccaattcgcatcatgttcacgcctagtgcggtgattatcggtctggtttacattctgctgccgtttatggtgatgccgctgtactccagtatcgaaaaactggataagccgttgcttgaggcggcgcgcgatctcggtgccagcaagttgcagacctttatccgcatcattatcccactaacgatgccgggaattattgccggatgtctgctggtgatgctgccagcgatgggcctgttctatgtgtccgacctgatgggcggtgcgaaaaacctgctgatcggtaacgtcatcaaggtacagttcctcaatattcgtgactggccgtttggtgcagccaccagcattacgctgactatcgtaatgggcctgatgttgctggtttactggcgcgcttctcgtctgctgaataagaaggtggaactcgaatgatcggtcgactgcttcgcggcggttttatgaccgctatctacgcgtacctgtatatcccaatcattattttgattgtgaactcctttaacagctcgcgctttggcatcaactggcagggttttaccaccaaatggtatagcctgctgatgaacaacgacagcctgttacaggcagcgcagcattcactaacaatggcggtgttttcggcgacgtttgctacgcttatcggttcactgacggcagttgcgctgtaccgttatcgctttcgtggtaaaccgttcgttagcggaatgctgtttgtggtgatgatgtcaccagatatcgtgatggcgatttcgctgctggtgctgtttatgctgctgggtattcagcttggcttctggtcgctgctgttctcgcatatcaccttctgcctgccatttgtggtggtgacagtgtattcgcgcctgaaaggttttgacgtgcgaatgctggaagcggcgaaagatctcggtgccagcgaatttaccattctgcgaaaaatcattctgcctctggcaatgccagcggtagcggcgggctgggtgttaagctttaccctgtcgatggacgacgtggtggtttcttcgtttgtcaccgggccgagttatgaaattctgccgttaaaaatttattcgatggtcaaagtcggcgtatcgccggaagttaacgcgctggcaaccatattactggtgctgtcgctggtgatggtaattgccagccagcttattgctcgtgataaaacgaaaggtaacacaggggacgttaaatgaaaaaatggtcacgccacctgctcgcggcgggtgctctggcactgggcatgagcgccgctcacgccgatgacaacaacacgctgtatttctacaactggaccgagtacgtgccgccaggactgcttgaacagttcaccaaagaaaccggtattaaggttatctattcgacttacgagtcgaacgaaaccatgtacgcgaagctgaaaacgtacaaagacggtgcctatgacctggtggttccttcaacctattacgtcgataaaatgcgtaaagaagggatgatccagaagatcgacaagtcgaagttaagcaatttcagcaacctcgatccagacatgctcaacaagccgtttgacccgaataacgactattccattccgtatatctggggtgcaacggcgattggcgttaacggtgatgcggtggatccgaaatctgtcaccagctgggccgatctgtggaaacctgagtacaagggcagcctgctgctgaccgacgatgcccgtgaagtgttccagatggcgctgcgtaagctgggctactccggtaacaccaccgatccgaaagagattgaagctgcatacaacgagctgaaaaaactgatgccaaacgtcgcggcgtttaactccgataaccccgctaacccgtatatggaaggcgaagttaacctcggcatgatctggaacggttctgctttcgttgcacgccaggcgggtacgccaattgatgtggtatggccgaaagaaggcggcattttctggatggacagcctggcgatcccggcaaatgccaaaaacaaagaaggcgcgctgaaattgatcaacttcctgctgcgcccggatgtggcaaaacaggttgctgaaactatcggttatccaacgccaaaccttgcggcgcgtaagctgttaagtccggaagtggcgaacgataaaacgctctacccggatgctgaaaccattaaaaatggtgaatggcaaaatgacgtaggctccgccagcagcatttatgaagagtattatcagaagctgaaagcaggacgttaattcagcaagtgggcggtggtattaccgcccgttttttatttagcaaggatgtggctaatgagccaggacagtagagttttctttcgtatattcttcggtatcggtctggtactgatcctcatttctgttgttatcttttataaccagttcacctatagcaaagacgcgattcatactgaaggcgtcattgttgataccgtctggcactccagtcattctcatcgcacgggtaaaaatggttcgtggtatcccgtcgttgtctttcgtccgacgccagattacacgctaattttcaattcgagtattggcagcgatttttatgaagacagcgaaggcgataaagttaatgtttattattctccaggacatcctgaaaaggctgagataaataacccgtgggttaatttttttaaatgggggtttatcggcattatgggcgttatttttatcgccgtcggtttattaatcagtatgccctcctcaaaaaagacacgcaggaaacggaagtcccgcccatgaaaaaaatcataatattgctcagtttactgatactcctgcctctaacggcgaccagtaatccattgattccaataatgaagactctttttacagatgttaccggtactgtaccagatgctgaagagatcgcgcataaagccgagctttttcgccaacaaaccggagttgcaccgtttattgtggttttacccgacattaataatgaagccagtctcaggcaaaatggcaaagcgatgctggcgcatgcggcatcttcaatgagtaatgtaaaaggcagcgtcctgttactctttactacccgcgagccacggttaattatgataaccaacggccaggtcgaaagcagtatggacgataaacatctcggccttctggtagaaaatcacacgctggcttatttacatgcggatctctggtatcagggtatcaataatgcattggctgttttacaagcacaaatattaaaacaaccgacgccaccactgacatattatccgcatcccggacaacagcatgaaaatgatccacccggcagtaccacgacattaggcctttttgcctgggcagttgcattcatcgtctttgctgcattttttaactacacaacgcgcctttattatgcgttaaaatttgcagtggcgatggctgttgccaatatgggttatcaggctttatgtttgtatatcgataacagctttgcgattaccagaatatcgccactctgggcagggctgattggtgtctgtacgtttattgccgcgttactatggacgagtaaacggtaaaagaggcagtaaagttcgcatgtattatgccggatgcggcgcgaacgccttatccggcccacaaaacccgcaaattcaattgattgcgccccttcacaggcctgacaagcgtagcgcatcaggcaatttttcccgctttataatcccttcagcaacttttcaacaaactctggcaccacctggcttgccggaccgtaatatttctcggcaaattcattaccaacctgactcggttcaagattcagttccacggtgtgcgcgccatgcagtttcgcttcgtgaacaaacccagccgccggataaacatgccccgaagtaccaatggcaatgaaaatatcggccatcgacaacgccatataaatttcatccataccgagtggcatttcgccaaaccacactacgtgcgggcgcaagggtgccgggaactggcaacaatggcatttatcttctggcgtaacgtctccggtccagtcgaggacctggccactttgcgaacaacgtactttcagcagttccccatgcatatgaatgacattggtattacctgcgcgttcatgcagattgtcgatattctgcgtcaccagcaaaaagcgatcgccgagagcatcttgcagtttagccagcgcaagatgtgcagcgttaggctgaatttctggctgctgcagctgtcgacgacgggcgttataaaacgtttgcaccagttcaggatcgcgatcaaaaccttccggcgttgccacatcttcaacccgatgttcttcccacaggccatctgcggcgcgaaaggtacgaatacctgattccgcagaaatccctgcccctgtcagtacgagtactcttggtttttccattgcttccggcaccactttatctctgaaaaaaatacgctgacgcaaacgctcgcgcaggcgacgtttatttttacgaaaacgacttaaccgatgaccccgacgcgacagcatagcaacctctgttgtttaatcggttagatgtaggaaggccgcaccacgcattccccccgcatcaccgtgccgcgcgcgttcaatgcgcggaacacgagctacaggtaagagatgacgaggcaacctttccgccagttgcgttgtgattgccgggaaattcgataagccaccaccaatgacgaccaggtcagggtcaacaatggtcaggatatttcccagacaaaccgctaataaatccagataacgctcaacgtgcgcccttgcctgctcatcgccttgatcataaagcgcaatgatctcaggagcctgcaacggttgatgataatagtgttgatacagccacgcaaaaccgcgaccagacagataattttcaatgcagccatgctgaccacagccgcagcggcgtaacgggaaatccagccccatcatggttaacgcatcaaccggcagacgcatatggccaaactcgccggtaatatagcttttaccggtaatgggtttaccgttgaaaatcagcccgccgccaacgccggtgccgagaatcaaccccatcaccagtggatattgagtaaattcatcatcccatgcttcagaaagggcaaagcagttggcatcgttatcaaggcgtacatcgcgatcaagacgtgcgctcaggtcggcacgcagcggtttaccgctggcagcagggacattggcggcatacagcgtaccatcttctgtttccggcattcccggaataccgatgccgacagaacctttacagccaaaacgccggtcagcttcggctaccagctcgcacactgcatctaaaaatgcgtcatagctgtcacgcggtgtcggcacccgcttttcccactgcaactgccgaccgctatcaaacacgcctagcgcaatttttgttccaccaatatcaaacccgtaatacattgccgctccttgttttaatgtactgcctttactggccgctaaggactcgcgcagggtcaatattactggcgcgccgcgccggataccagcttgccaaaagactcagcaacaatgctgtgaccagtacgtagaagacgtccagccagtgcaattccgatggcaagaagtcaataaaatagatatcgctggagaggaactgatgaccgatcagcttttcaatccactcaataatcggggtaagttgcagtgaaacaactacgccgataatcacaccacacaggctgccgaacagccctgccagcaatccataccagacaaagatggcgcgaattaaaccatctttcgcccccagcgttcttaatactgcgatatcgccactcttgtctttcaccgccatcactaaggtggagacgatgttgaaacaggccacaccaatcaccagtaccatcgccagatacataatggcgcggatcatctggatatcgcgatacatatagccgtaagtaccaatccagcttttaatataaacatagctgttggtcacttcccccgcatcgcgtaccagcttattggcgttgaaaacatccgtcattttaagggcaatacctgacacgctggaacccatatcaagatattgctgagcatcggccagcgggatcatggcaaaactgtgatcgagttggccactcaactgcaaaataccggcaatgtgcaaacgcacacgttttggctgcatcagtttatgctcgggattcgaatttgggatcataatcgacacccaatcgccctgcttcactttcagcgcatccgccacgcctttgccgatgataatttgctgttcgcccgctttaaaattgcgccaggcatccccctgaacaaacgagggtaatgcgctcagacgctgttcctgttgcgggttaacgcccttcacctggattgcgcgcagattcgcgccgctctccaccagcccggtgaaattgatatacggcgcagcggcggcaatgcccggcactttctgcacgttatccagtgcttcctgccagttggtccacggctgatctaccgcctcaatttcaccgtgcggtactaccgccagaatgcggttattcagttcgcgttcaaagccgttcatcgcgcttaagccgacgatcaataccgccacgcccagggcaatgccaatggtagaaatgacggagatcaacgacaccatgccgccgcgtcgccgtccgcggctaaaacgcaggccaatcaataacgataaaggcatcgccattactccgcccccatcaggctcagttccgccgtcaaacgtccatcacgcatttccagttggcggctcatacgtttcgccagttgcaggtcgtgagtaaccaccaggaaggcggtgccctgcaagcgattcaattccccaagcaactggaagatgctgtcggcgttacgtgcatcgaggttaccagtaggttcatccgccagtaccagccgcgggttattgaccagcgcacgggcaatcgccacacgctggcgttcgccgccagaaagttcagatgggcggtgattcgcacgatgctccagccccaccgcttttaacatctccagcgcacggctgttgatttcagcgggctttttcttgccaatcaacagcggcatagccacgttttccagggcggtaaaatccggcaacaggtggtgaaactgataaataaatcccagcttctggttacgcagttccgctttggccgccgacgacagtttgctcatcggttgaccgttaaagatcacatcgccggaggttggcgtatccagcccgcctaacaggtgcagcaaggtgcttttaccggaaccagagctgccgacgatcgccatcatttcaccttcgcccacgctgaaactgacattgtgcagtacatcggtttgcacactgccttcctgatagcgtttgcacaggttgtcgcattgcaacaggatcttattcataacgtaaagcctcagcgggttgagtggcggcagcgcgccaggaagggtaaagcgtagacagcagcgcgatagccatcgccaccagcgcaataacaatgacctgtaaaggctcgatagcgaccggcagcgccgcgccatcaagcaggacgccgattatcggcatcagattattcaactggctggcaagcagtgcgccaagcgccgctccgaggatcgcaccgataatcccagcgctggccccttgcaccataaagaccatcatgatttgacgcggagtcagcccctgagtctgaagaatggccacttcgccctgcttctccatcaccatcagtcccagcgaggtaataatgttaaacgccgcaacggcgacaatcaggctcagcagcaagcccatcatatttttttccatgcgtacggcctggaacagctcgcctttacggtcacgccagtcctgccatttgctgccttcaggcagtttttgctgacttaatgagtcgactttcagcggctcatccagccacaaacgccagccggtaatattgcctgccggataacgcatcagacgcgaggcatcctcaatattcaccagcatttcatagccatcgacttcactgttggcggcgaaagtgccaatcacattgaacaggcgctgacttggaatacgccccatcggcgtgaactggctggcagatggcaccatcacgcggatttgatcaccgcgattgacgcccaactgtgaggcaagctgttcaccgaggatgacattatatttccccggctcgaggtcagtttgtttcacattgaccagatacggcgttagtggatctttttgcgccgggtcgatacccagcatcaccccgaccgccacgctgcgcgcgctttgcagtaccacatcaccggtagtaataggtgcgacgcgattaacgccgtccagtttgactgccgtttccgggagttgctgcgggttaagagagccatgctcagaagagagaattgcctgtggcatcaggccaaggatgttgttttgcagctcgcgctcaaagccgttcatcactgacaatactgtgaccagcgccatcaccccgagggtaatgccgatggtagaaagccaggagacgaaacgaccgaagcgatccgctgcacgcccacgcatgtaacgcaggccaataaatagagcgacaggttggtacatgaaatccgtctggttgctgttagcaaagacacgagtatataagcgaaagcgggatgggtaaacgtctgaactgtaagtgatcgtcagggctaatctgaaaagcaccggcaaatcaatcggctaaagtgcctcattttctcatcggccttgtgggctgagctttatctgaaaaataaccaaatacagacagatacgcattacaccacgcgactcgccccgcaggatcaaccgcatgttaaataaaaagagcgtgttgtcctgatgaaacaaaaagagctatggattaaccagatcaaagggttatgtatttgtctggtggtgatttatcactcggtcattaccttttatccgcatctgaccactttccagcatccgttatcagaagtcctgagcaaatgctggatctatttcaatctttaccttgcaccctttcgtatgccggtttttttctttatctctggctatttgattcgccgctatatcgacagcgtaccgtggggaaattgtctcgataaacgcatctggaacatcttctgggtgctggcgctttggggcgtggtgcagtggctggcgctaagtgcactaaatcagtggctggcacctgagcgcaatttaagcaatgcctccaatgccgcttatgccgattccaccggtgagttcctgcacgggatgatcaccgccagcaccagcttgtggtatctgtatgcgttaattgtctatttcgtgatatgtaaaatttttaaccgcctggccctgccgttatttgttctgtttatactgatgagtgtggctgttaatttcgtacccacaccgtggtggggaatgaacagtgtgagccgcaatttgccttattacagccttggcgcatggtttggcgcaacattaatgacctgtgttaaagcggtaccgttgcgccgccatctgctgatggcttctttgctggccgttctggcggtcggtgcctggttgtttaatatctcgctgctgttgtcgctggtatcgattgtggtgatcatgaagctgttttatcagtacgaacaacgtttcggtatgcgctccaccagcctgctgaatgtgattggttccaacaccattgctatctacaccacccatcgcattctggttgaaatattcagcttaactctgcttgcgcaaatgaacgcagcacgctggtcgccgcaagtcgaactgacactcctgctggtttacccctttgttagtttgttcatctgtactgttgcgggcttgctggtaagaaaactttcacagcgcgcattcagcgatctgttgttctccccgccttctctgcccgcggccgtcagttactcccgctaagccatcgccccagccggggcgattcaatttgctaaaccatgtcgattacggataatgaacagcattgcttatcagagatatgcccccatatgttgaggcatatcctaacgagaatctgacaaccgttatgcctgaacaatatcgttatacgctgcccgtcaaagcgggtgagcagcgtctgctgggcgagttaactggcgctgcctgcgcaacgctggtagcggaaattgccgaacgtcacgccggaccagtggtgcttattgcgccagatatgcaaaatgctctgcgtttgcatgatgaaatcagccagttcaccgatcagatggtgatgaacctggcggactgggaaaccctcccttacgacagtttttcgcctcatcaggacattatctcctcgcgcctttccaccctttaccagctaccgacgatgcagcgtggcgtactgattgttccggtgaatacgcttatgcagcgcgtttgcccgcacagttttctccacggtcatgcgctggtgatgaaaaaaggtcagcgcctgtcacgagatgcattacgaacccaactggacagcgccggttatcgccatgttgaccaggtgatggagcacggcgaatacgccacgcgcggcgcgttgctggatctcttcccgatggggagtgagctgccttatcgtcttgatttctttgatgatgaaatcgacagcctgcgggtgtttgacgtcgatagccagcgcacgctggaggaagtagaagcgatcaatctgcttcccgcgcacgaatttccgaccgataaagcggcaattgaactgttccgcagccagtggcgtgataccttcgaagtgaagcgcgacccggaacatatttatcagcaagtgagtaaaggcacattacctgccgggatcgagtactggcagccgctattcttcagcgaaccgctgccgccactgttcagttatttccctgccaatacgctgttggtgaatactggcgatctggaaaacagtgccgaacgtttccaggctgacacgctggcgcgttttgagaatcgcggcgtcgacccaatgcgcccactgttgccaccacaatcgctctggctgcgggtggatgagctcttttcagagctgaaaaactggccgcgtgtgcagctaaaaactgaacatttaccgacaaaagcagcgaatgccaatttaggtttccagaaactgccagacctggccattcaggcacaacaaaaagcgccgctggatgcgctgcgtaagttcctcgagactttcgacggtccggtggtgttctcggtagaaagtgaaggtcgccgtgaagcgctgggtgaactgctcgcgcgaattaaaattgctccgcaacgcattatgcgtcttgatgaagccagcgaccgtgggcgttatctgatgattggcgctgccgaacatggttttgtcgatacgatgcgtaacctggcgctgatttgcgaaagcgatctgctcggtgaacgcgttgcccgtcgtcgtcaggattctcgccgcgccatcaaccccgatacactgatccgtaaccttgcggagctgcatattggtcagccggtggtccatctggagcacggcgtcggtcgttatgccggaatgaccacgctcgaagctggaggcattactggcgagtatttgatgctcacctatgccaacgacgccaaactgtatgttccggtgtcgtcactgcatctgattagccgttacgcgggtggcgcagaagaaaacgcaccactgcataaacttggtggcgatgcctggtcacgcgcacggcagaaagcggcggaaaaagtgcgtgatgtggcggcggaattgctggatatctacgcgcaacgcgccgccaaagagggcttcgcgtttaaacacgatcgtgagcagtatcagttattctgcgacagcttcccgtttgaaaccacgccggatcaggctcaagccattaatgcggtgcttagcgacatgtgtcagccgctggcaatggatcgtctggtgtgcggcgatgttggctttggtaaaacagaagtggcgatgcgcgccgctttcctggcggtagataaccacaaacaggtggcggtgctggtgcctaccacccttctcgcgcagcagcattacgacaacttccgcgaccgtttcgccaactggccggtacgtatcgaaatgatctcccgtttccgcagcgccaaagagcagacgcaaatccttgcggaagtggcggaagggaaaatcgatattctgatcggtacgcacaaactgctgcaaagtgacgtcaagtttaaagatttaggcctgctgattgtcgatgaagaacaccgcttcggggtgcgtcataaagagcgcattaaagcgatgcgcgcgaacgtggatattctgacgcttaccgcaacgccgatcccacgtacgctgaatatggcaatgagcggaatgcgcgatctgtcgattatcgccacgccgcccgcccgtcgtctggcagttaaaacctttgtccgtgagtatgacagtctggtggtccgggaggcgatcctgcgtgaaattttgcgcggaggacaggtttattatctctacaatgatgtggaaaacatccagaaagccgccgaacggctggcagaactggtacctgaagcgcggattgccatcggtcacgggcaaatgcgtgagcgcgaactggaacgggtgatgaatgatttccatcatcaacgtttcaacgtgctggtttgtaccaccattatcgaaaccgggatcgacattcctaccgccaacaccattatcattgaacgcgcggatcacttcggtctggcacagttgcaccagttgcgcggtcgcgtcgggcgttctcaccaccaggcatatgcatggctactgacgccgcatccaaaagcgatgactaccgatgcgcaaaaacgtcttgaagcgattgcctcgctggaagatctcggtgcaggttttgcgctggcaacgcacgatctggagatccgcggcgcaggtgaactgcttggcgaagaacaaagcggctcaatggaaaccatcggtttctcgctgtatatggagttgctggaaaacgccgtcgatgcgctgaaagccggacgcgagccgtcgctggaagatctcaccagccagcaaacagaagtcgacctgcggatgccgtcgctattgccagatgatttcatccctgacgtgaacacgcgtctgtcgttctacaaacgtattgccagcgccaaaacggaaaacgaactggaagagatcaaagtcgagcttatcgatcgcttcggcctgctaccggatccggcgcgtaccctgctggatattgcccgtctgcgccagcaagcgcagaaactggggatcaggaagctggaaggtaatgagaaaggcggcgtgatcgaatttgccgagaagaatcacgttaatccggcctggttgattggtttgctgcaaaaacagccgcagcattaccgccttgatggtccgacgcgcctgaagtttattcaggatttgagtgagcggaaaacgcgtatcgaatgggtacgccagtttatgcgtgaactggaagagaacgcgatcgcttgatggttagattaggggcgtttctgcgcccccatctgcaacatttacaaattctttgcacttccctgcactatccgacactgtcaccatccataattcaggcttatctgtttattacaataaccttatatttattatggatttttggtgatgatcaaaacgcatttttctcgctggctaacgttttttacgttcgccgctgccgtggcgctggcgctaccggcaaaagccaacacctggccgctgccgcaagcgggcagtcgtctggttggtgaaaacaaatttcatgtggtggaaaatgacggtggctctctggaagcgatcgccaaaaaatataacgtcggctttctcgctctgttacaggctaaccccggcgttgatccttacgtaccgcgcgcgggtagcgtgttaacgatcccgttgcaaaccctacttccagacgcgccgcgcgaaggcattgtgatcaacattgcggagctgcgtctctattactacccgccgggtaaaaattcggtaaccgtgtatcccatcggcattggtcagttaggtggtgacacgctgacgccaacgatggtgactaccgtttcagacaaacgtgcaaacccaacctggacgccaacggcaaacatccgcgcgcggtataaggcacagggaattgagttgcctgcggtagtgccggcaggaccggataacccaatgggccatcatgcgattcgtctggcggcctatggcggcgtttatttgcttcatggtacgaacgccgatttcggcattggcatgcgggtaagttctggctgtattcgtctgcgggatgacgatatcaaaacactctttagccaggtcaccccaggcaccaaagtgaatatcatcaacactccgataaaagtctctgccgaaccaaacggtgcgcgtctggttgaagtacatcagccgctgtctgagaagattgatgacgatccgcagctgctgccaattacgctgaatagcgcaatgcaatcatttaaagatgcagcacaaactgacgctgaagtgatgcaacatgtgatggatgtccgttccgggatgccggtggatgtccgccgtcatcaagtgagcccacaaactctgtaaagctcggataaaaaaatccccgcgacacggcatgtcgcggggaaaaaatcagcagtagcaggcattaatgagggttaatgcttatttataaattactgctgttccatggagggtattcggaccggttacagaagtaatacggaaagattttgcgcccatctcatccgctttttgcgccaactgctcttccagcgatcccagatttgtccccgcgttagcactgatagtaccgactttttgttggccttctggcgtggactgaacttcgacagccgcaaagctggcaaatgacatggagcttaaaatcgccgcagcgatgaggttttttacgtttttcataatagtggccttatgcagatgaatgacgtcgcaagcaattacttaacgatcgataactaaatgatagatgtgatctggatcacatacaagatattttttataacaatcattaattaatttaaaaacctttaaatttcagttaaatataaagcgattatttttatggtttctggactggtgaacggaggtgattatttttataataacctttcattcacagtcaccaggtacaacggcatcatggcaactgactcaacacaatgtgtaaaaaaaagccgtggccgcccaaaagtgttcgacagggatgccgcgcttgataaggccatgaaattgttctggcagcacggttatgaagcgacttctcttgcggacctcgttgaagcgaccggagctaaagcgcccacgctatacgcggaatttaccaacaaagaggggttattccgcgccgtactcgaccgctatatcgatcgttttgccgccaagcatgaagcacagctgttttgtgaagagaaaagcgtggagtctgcgctggctgactattttgctgccatcgccaactgctttaccagcaaagacactccggctggctgcttcatgatcaacaactgcaccaccctctccccggattcaggagatatcgccaatacgctgaaatcacgccatgcgatgcaagagcgcactttgcagcagtttttatgtcaacgacaagcgcgcggggaaatcccgacccactgtgacgtgacgcatctggcagaattccttaattgtattattcaggggatgtcgatcagcgcacgcgaaggtgcatcgctggaaaaactgatgcagattgcccgaacgactttgcgtttatggccggaactgctgaaataggtcgcaaaaaaagcccctcagcttgagcgaatgaggggctaaattgcagagtacaaccttgttatgctttgttattcaaaatcagctgcccgttgctatctagcgggatctgcgtacccggatcgcggtccattcggattttgccctgctgatcgccaatcttataggtcacatcataaccgagcattttttctgacttgtcatacaccgttttacaacgctgttgcgtagtcgtgtaagtatcgctttcctggagagagccctggatctggttacctgcatatccaccccccagcgcccccacaacagtggcgacatctttaccgcgaccaccaccaaactgatgcccaatcacgccgccagcaacagcgccgagcaccgacccggtaatgcgattttcatcctgcaccggtcgacgatgggtcactgtaacgttgcgacactcctgacgcggtgttttaaccgtttccttgattggggttgcagaaacaacctgagcgtattgcgggccacgttcaaacacgttcagactggccactgccgctacgcccagcgcagctgcgacaccaatcccgatacccgccaacattgacttattcacgggaatacctccttctttgctgttatgccaatcatgcaagcgaaggagaaaagcagctatcagacagaagatgaaaagcgcgggaatggctggaaatacttagggattcggaggagtctgaaggaatgcctgatgcgacgcttaacgcgtcttatcaggcctaccgctcgtaccatttgtccagggcggataaggcgtttacgccgcatccgccagtacaagccgattaatgcaacttcaaacgtggacggataacgcggttaatactccccaccagcatcattaatccggttttaaagtaaccatgcagcgcaatctggtgcattcggtacagcgagatgtatacaaagcgcgcaattcgtccttcaatcatcattgagccgcgtgtcaggttacccatcaggctaccgacggtggaaaagttcgacagcgataccagcgaaccgtgatctttatactgataatttttcagcggcttaccgttcatctgcgccagaatgttgttcattgcgcaggttgccatctgatgtgcggcctgagcgcgcggcggaacaaagcccccttccggacgcgggcatgacgcgcagtcgccaatagcgtatatgtctggatcgcgagtggtttgcagcgtcggttccaccaccagctggttgatacggttggtttcaagaccaccgatatctttcaggaagtctggcgctttgatcccggctgcccacaccatcagatcagcctcaatatattcgccatctttagtgtgcaggccgccttcatcagcactggtgaccatggtttgcgtcagcacgcgaacgcctagtttcgttaactcactatgggccgcagcagagatacgtggcggcaatgcaggcaaaatacgttcgcccgcttctaccagcgttacgttcagggcttcgttggtcagacctttataaccgtaactgtgcagttgcttgaccgcgttgtgcaattcagcggagagttctacacccgtcgcgccgccgccgacaatcgcaatgtttactttgccattcgcgcccaggttggcggagtatttcaggaacagattcagcatctcctggtggaagcgacgcgcctggtgcgggttatcgaggaaaatgcagttctctttgacacctggtgtattgaaatcgttagaggtgctacccagcgccattaccagggtgtcataggcgattttacgttccggaaccagcagttcacctttctcgtcgcgcagttctgcaatagtgattgttttcgcttcacgatcaatatcaattacggaacccagctggaactggaaaccatgattgcgcgcatgggccagatagctcaacgcatcgacgccttcatcaagcgagccagtcgccacttcgtgcagcagcggtttccacaggtggctgtggttacgatcgaccagcgtaattttggcttttttcttgcgtcccagcttatgccccagctgtgttgccatttccagcccaccagcaccgccgccgacaatcacaatttttttcaatggcgtagtcaacgtgacccccttaaatttattaaccaattgttaattaatggttattaacatagctcttaattaacaacaggttacagcaatgaaaatgttcttcgctattgagaataacatgaatggtgcattggtcataccaaaattgatgttaatcaagttttgttgctgaaaagataggcgactttaccgggtgagatcaaaaaacagagtttgttgtttattatttgagctgatttgtgagaatgatatagagtgaggtgtgtatggagggcgttcggtaggcctgataagaggcgcatcaggcattgatgctcgactgtcggatgcggcggaacgccttatccaacccacagaatccggagcgcatcaggtaccggcaaggttacctgatgcgacgagggcatttacccgagggttttgaacgctttaatgcgctgtaaatgcggggagatattcttgaatttgtgcgtctgctcttcgtcccagacaatctcgtaataatgatgcaactcttcagatgtccgctggctgttaagcgcttcatcattacgcgacaaaatcaccaggcaacgatcgcgattcttctcacggaagttggtcacacacttagtggcaatatcggcatactcttccgggcgatcaatcttcccttccatgttctcataagggaacaaattggggttgaagatcacctggcggatatcacagagaaaaccaatccgctcagcccaataaccgcccagaccaacaccacaaatgagcgggcgctcgtcgacgttcagttgcaacattttgtccacttctttgagcaaatgctgcatatcatgtttcggatgccgcgtactgtagcttattagccgtacatccgggtcaataaactgcaattgtaagactttctcgtggttacccggactgttagagtcaaaaccgtgcaaatagataatcatcgcttcctcacataagccagggttaatgacctgccttctcttcctgccagcgttcatgtaactgattcagacgggtgctgatcgctttccagcgagccgagtccatcagttcctgtcgcgaaaatgaacctttatgatacaaacgtgtaacacgttctgccttgatcggtgacagattatctaacacgctgacggcccctttacgattattgcagaccaggatcatatcgcaacctgcatccagtgatgcctgtccacgctcggcataactgcccataatcgctgcgccttccatcgataaatcgtcagagaaaatcacgccgtcaaaacccaattcctgacgcaaaacggttttcagccagtagggagaaccgctcgccggacgcggatcaacatcactgtagatcacatgcgcaggcataatggcgtcgagtttattttcgcggattaaggaactgaagaccgacatatctttagcgcgaatctccgcttgcggacgtgggtcgcacggtgtttctttgtgtgagtctgccgttactgcaccgtgacctgggaagtgtttcccggtagttttcattcccgcttcatgcataccatcaataaaacggctggcaattgccagggctttttgtggatcggcatgataagaacgctcgccaatcgccgcgctgatatgcccgacgtccagcactggcgcaaagctgatatcaatatccatagcaatcatttcactggccatcaaccaacctgcctcttgcgccagttttccgccttcttccattcccaacagcgcagcgaatgattgtgccgctggcaagcgggtaaaaccttcacgaaaacgctgcacgcgtccaccttcctgatctaccgccaccaccagatgattgcgcgatgctgcgcggatctggcgcaccagttcacgtaactgggcaggatcatgatagtttcgcgtaaagagaatcagccctcccaccagcggatgcgccagtatttcacgctcttccgcgtccagttcgtaaccttcgacatccaacattactggacccacactgctctccttattgttttattaatagctgccgccacgtgtcatcggccagcctgataaattgttgatcgccggtttgtcgccagcggtactcaaaccaccctgctttgagcatcagcagccagggaaaccatcgcctgacctgacgccataattgcgccggataaatcttcgcgcgagtggcatagtcattgaccaattgccgatgctggtcaatattttccacccacaccgccgccagttccagcgcgatatcaccatctccggcatactcccagtcgatgagttttaaccctgacgcgctatgcactaaatttccggcgtggacatccatatgcaatggacttaagcgtaaaagccgtggttcccgcgctttgcgcagacgttttaacattcgcagccaacccactgtccgccgcgccggatcgctttgctgccagtacagttccagtaacggcaacagcgttattcgccagccaaaacgcggttgttgatgtagataatacagcaagcctgccagttcgttggtatccggcaaatacgtttttacctcgccgggcagatagtcgaccaccatccagtcacggagatataaatgcggcttcggtgcaatgcatgcgggtagttgtgataaagcccgatactggcgcaagaacgcggactgcggcgcatcaggatcgtgcggctgacgcacaacaaaacgctggccctgatgttcaatgagaaaactcccgccactaagcccactattaaacgtcgtgacgggatgaaactgcgggaaaaagcgcgacagcaattcgtcgcgcgtgaggggattattgctgcgaaacggcacctttacctgaccagataatttcgcccgtctgcaccagcatcagctgcatttgtagggtcggagcgttaacgttgccagaggcgctggagtacagcacgtaatgagcgccaacattgcgggcaatgcctatggctttactacgggtgcctaaactgtcctgcggcgacaaacctaattgttgcttagccatcgacagctgctgggcggaaaccagggtaaatttaccgttattagccagcgcatttcgcagcgtttcggtcgcttctgcggcattcaacgaaccattagtacggttgttaacgctatcaaccagcaggacgctacccgcagtcacgccgtcagccccaagcatcttactgaccatcggctgcattgcgccattccagtcataatggcgaatatgcggcgcaggcggtgcagtttgatcttcgtgctcaattgggcctggctgctgcggtatcgtcggcaccgatggcactgtggggacaggctgttgtggctcagcaggttgttccggcgctggtttcacttcttctaccggtgcaggttcacgttgccccacacacccggcaagaaacatcgccagcgcggtaatcaaggcgtagcgactcatttttgtcatcaagattcaccccttacaaatatagataaagtctgactttgtgcgcccccagaaaattggcgctgccgtacagcgtgaccgccgaatgtgcgggaatggtaacgctgcgtggcctttccagaggatgcatctccagccctctggcgtcataccagtaaaaacgataatgaacggtaacgggttcttgcctttcgttataaagcgttgaggatgctgaaggttgaatatcagatgtcgaaaggacgggcttttctgcactgatgcccgcagctaataaagatgactccatcaccagcgattgctcatcattcaccggaatttccggatgtgaacgacagcccaccagcactaacaacgccagagacatcagcccaaagcatccttttctcatcgttacagacctttatgcgccagcattggtcccagcggacagccacccaacaaatgcatatggatgtggtaaacctcttgtccgccatggcggttggtgttcatgatcagacgatagccatcttcggcaataccttcttgctcagcaatttttgccgctacggtgatcatgcgtcccagcgcctgctcatgctcagctgacacgtcgttcacagtcggaatgaggatattcggaatgatcagaatatgcgttggcgcttgcggcgaaatatcgcgaaacgccgttaccagatcatcctggtagacgatatcggaggggatctcacgacgaataattttgctgaatatagtttcttctgccacgacattttcctttttcaaatagccatgcgttgcgccatgctacgccgcgccacactgcgagtatagagtatggtcgagttaaacctgctctttcaaccttaactcacgatttcttaagcaaaaaatcgttttgctgccgtatatatcgccattattcccatttctgcctgcgaatgcgctgaaaagacattctctgtttggtttacacactaaatatgaatgcgtatatttctcatttgcatttacatacaaaattattcgcacactaaatataaccgctcatcaccctgctccggcatgagcctgacgccaacataaaccaagagatttcaaatgctttcgacacaatttaacagggataatcaacatcaagctatcatcaaaccgtcactccttgccggttgcatagcactggcactattaccttccgccgcttttgctgcaccagtcactgaagaaacggtgattgttgagggttcagccacagccccagatgatggcgaaaatgattacaacgtaacgtctacctctgcgggtacaaaaatgcagatgactcaacgtgatattcctcagtcggtcactattgttagccagcagcggatggaagatcagcagttacaaacgctgggcgaagtgatggaaaacacgctggggatcagcaaaagtcaggcggattccgatcgtgctctttattattcccgcggattccagatcgataactatatggttgatggtatccccacctattttgaatcgcgctggaatctgggcgacgcactttctgatatggcactgtttgaacgcgtagaagtagtgcgtggcgcgacaggcctcatgaccgggacgggtaatccatctgcggcaattaatatggttcgaaaacacgcgaccagtcgtgaatttaaaggcgatgtctcggcggaatacggtagctggaacaaagaacggtatgtggcggatttacaaagcccactcaccgaagatggtaaaatccgcgcacgaattgtcggcggctaccagaataacgactcatggctggaccgctacaacagtgaaaagaccttcttctccggcattgtcgatgctgatttaggcgatcttacgatgctttcagccggttacgaatatcagcgtattgatgttaatagcccaacctggggtggtttaccgcgctggaatactgatggcagcagcaacagttacgatcgcgcacgcagtaccgcacctgactgggcgtacaacgataaagagatcaacaaggtctttatgaccctgaagcagcggtttgctgatacctggcaagcgacgctgaatgccacccactctgaagtcgaatttgacagcaaaatgatgtatgtcgatgcctatgtaaacaaagcggatggtatgctggttgggccatacagtaattatggacctggttttgattatgtcggcggcaccggttggaacagcggcaaacgtaaagttgatgcgctggatttgttcgctgacggtagttatgaattgtttggtcgtcagcacaatctaatgtttggtggcagttacagcaaacaaaacaatcgttacttcagttcatgggccaacatcttcccggatgaaattggcagtttctacaactttaatggcaatttcccacaaaccgactggtcaccacagagcctggcgcaggacgataccacacatatgaaatcgttatatgctgccactcgtgtcacccttgccgatccgctgcatctgatcctcggcgcacgttataccaactggcgggttgatacgctgacttacagcatggagaaaaaccacaccacgccttacgctggtctggtgtttgacatcaatgacaactggtcgacctacgccagctatacctctattttccagccgcaaaatgatcgtgacagttcaggcaaatatctgactccaatcaccggtaacaactacgagctgggtctgaaatcggactggatgaatagccgtctgaccaccacgttagccatcttccgtattgagcaggataatgtcgctcagtccaccggtacacctatccccggcagcaacggcgaaaccgcctataaagcggtggatgggacagtcagtaaaggtgtggaatttgaactcaacggcgcaattaccgacaactggcagctgacgtttggcgcaacgcgctatattgcagaagataacgaaggaaacgccgttaatcctaatctgccacgcaccacggttaaaatgttcaccagctaccggttgcctgtcatgccagagttgacggtcggcggtggtgttaactggcaaaatcgcgtgtataccgacaccgtgacaccgtatggcaccttccgcgccgagcaaggtagctacgcgctggtggatctcttcacccgctaccaggtgacgaaaaacttctcgttacaggggaacgtcaataacctgttcgacaaaacctacgataccaacgtggaaggttctatcgtctacggcgcaccgcgtaatttcagcattaccggcacgtatcaattctgaataacacctgtaaaaaaggcagccatctggctgccttagtctccccaacgtcttacggattagtggttacggatgtactcatccatctcggttttcaggttatcggatttagtaccgaaaatcgcctgaacaccagaaccagcaaccactacgcccgctgcgcccagtttcttcaggccagcctgatccactttagacacatcagcaacgctgacgcgcagacgggtaatacatgcgtcgaggttagtaatgttttctttaccaccaaatgcagcaaccagagccggtgccatttcgctggtacctgtcgcttttgcatcttcagtcgcatcttcacgacccggcgttttcagatccagtgctttaatcagcacgcggaagatggtgtagtaaacaatggcataaccgataccgacgatcgggaacagccacagtttgctgctgttaccagacagaacgatgaagtcgatcagaccgtgcgagaacgacgtaccgtcacgcatccccagaagaatacagattgggaatgccaggcctgccagaatcgcgtggatgatgtacaggatcggcgcaacgaacatgaaggagaactcgatcggctcggtgataccggtcaggaacgaggtcagcgccgcggagatcataataccgcccactttcgcgcggttttctggtttagcagagtgccagatagcaattgcggcagctggcagaccgtacattttgaacaggaagccaccagacagtttacccgcagtcgggtcacccgccatataacgcggaatgtcgccgtggaaaacctgacctgctgcgttggtgtattcaccaatctgcatctggaaaggtacgttccagatgtggtgcagaccaaacggtaccaggcaacgttcgatgaaaccgtaaatgccaaacgcaactaccgggttctggtaagcagcccactgagagaaggtctggattgcagaaccaatcggcggccaaatgaaggacagcacaacgccagtaaagatggcagccaggcctgaaatgatcggcacaaagcgtttaccggcaaagaagccaagatactcaggcagcttaatacggtagaaacggttaaacatgtacgctgcgatcgcaccggagataatccccccgagtacgccagtatccgccaggtgtttagaggcgatttcttcagcaggtaaatgcagtaccagtggcgcaaccacggccatggttttaaccatgatgccataggcaacaactgcggccagcgcggatacgccatcgttattggtaaagccgagggcgacaccgatcgcaaaaatcagtggcatgtttgcaaagacggaaccgcctgcttctgccataacatgcgatacaacggcgggcagccagctgaaattcgcggaaccgacgcccagcagaatacctgcgataggcagtacggataccggcagcatcagcgatttaccgaccttttgcaggttagcaaatgcattcttaaacataattgagagtgctcctgagtatgggtgctttttttacgttctcacgcgtggcaaggggggagtgcctcgccgtgtacagggcatctaagcgccctttatttattacacagagtaaaataattcagtgccgatttgtttgacggctatcacgtttcaacttcagatcattggagaagttgcacattttgacaaaacatatgtcacaatatttcaaacgtggttattcaccgcccgattttcggcggtgaactttactcgttttagccattaattacgagctttaaaaaaactcattcaacggatggattgaaggcgggaagcgtcgatgtgaaacagacgggcgaagttatcggtggttacctgcgccagttcttcaacggcaacacctttcaacacagccatgtattctgcaacgtcacgaaccatcgcaggttgattctcttttcctcgatgcggtactggcgcaaggtaaggtgagtcagtttccaccagtaaccgatccagggggacataacgcgcagcatcgcgcagttgctccgcattacggaaggtcacaatgccggaaaaggagatgtaaaatccgagatccagtaatttgcccgccgtttctctgtcctctgtaaaacagtgtagtacgccaccgcaatccgtcactttttcttcgcgcagaattgccagcgtatcggcgcgggcgtcacgggtgtggacgataaccggcttgttcagttcacgaccaatctggatatgatggatgaaggactcttgctgacgtactttagtttccggcgtgtaataataatccagcccggtttcacccagcgctacaacgccctcttctgccgccagacgacgtaaatcttctacatcgtagggatcattctggttgagtggatgcacgccacaagaaaatacgacgttgtcgcgttcgcctaccagatcccgcatgtgtaaataacccggtaatgttgtggcgactgccagacaaaatttcacatcgcgtgcggcggctttcgccagaacgtcatccacgtccttatgcaaagattcataatccagaccatcgagatggcagtgtgagtcgactaaaaacatgatgtctctcttaaagatgaggaaccggtagcacaacgcccggttgcaggtaatgctcaatacgcagtaaaagatcggtgatgagaagctcgcggttgatgcctgtgacagacattaactgttcacgaatgtggcaaacatcccccagtatagcctgcaggcgcgagggagaaagatggtttgccagttcgacgaccaggcccggcacatcaacattggtcacctgcgcagcgccatgatggcgttttagcgcatccatcagcaacgttgccagccagtgtaaacgtgccggagcttgttcatgattaagggccgctagcagcgaataccagtcgcccgattgcacgctatatgccagcgcctgacacaatgtttcacgagcctgccagttatctccctgaaacaacgccagtgccgccccaggcgaaccggcgcttaagcgcaatgcggcaagtagtgcagcctgtgacattgtcacttcgcgtgaaagccaggtcacggcgtactgttccggcggcggcgcaaggtaatgtaaccgacaacgactacgtaatgttgccagtaaacgttctggctcgcgggtagcaaggaaaaaccacgtctctgctggtggctcttcaagcgttttcagcaatgcgttagccgcggcgtcggttagtaaggcagcatcggttacccagacaactttcgcaccacctaagcgtgcgtgctcattcagcttttcggtgacctcacgtaccgcatcaatgcccagcgcatttttccctttttcgggagtcagggtgtagtaatcgggatgtgtgccagcctgcatcaactgacatccacgacagtgaccgcaacttttgtggccctgcggttgttggcagagtaaataacggctcagggcgtagattaaagcatcatcgcccatgcccggtaacgcctgaatgagtagcgcatggtgacctcttccggcctgatagctggctaccagtttttcgaaatcaggtcgtaaccatggataccatctcatgcgtccaactccttcacccagttggtcacggtggtgcggattgcatccatcacggcctccagcggctgggtggcatcaatggtatgaatgcttttatcttgtgctgccagttccagatagcgggcgcgggtgcgattaaagaaatcgaaagattcttgctcaatacgatccagctcgccgcgcgcacgcgcgcgttttaagccaacctccggggtaacatcgagatagagcgttaagtcggggcgaaaccccccgagaacagcatcacgcagtgttgccagcatatgttggtcaatacctcgtcctccaccctgataggcttgagtggagagatcgtggcgatcgccaatcacccaggtgccgttagccagcgcaggtttgatgaccgtttctaccagttgaacgcgcgcggcataaaacatcagaacttcggctttatcggtaatgacttcatcgcctaccgatttgatatccagcacaaggcttcttaacttttcggcaagttgcgtaccgccaggttcccgagtgaaaaccatgtcgcggatacccagttgctcaagcgtctcaaccaccacgttacgcgcggtagttttgcctgcgccttccagcccctcaatgacgatatacttactgcgcatttttttccttaagcactttcagataatcctgcacagacttgttatgactggcaagattggtattaaacgtgtgaccacctttaccatcggccacaaaatagagatacggcgtttttgccggatgcgcagcagccttcagcgaatccgcccccggcgtcgctatcgcacctggcggcagaccggtaatggtataggtgttatacgctgtcggcgtttccaggtctgcacgagaaagtttgccattataacgctctcccatcccgtaaatcacggtcgggtcggtctgcaggcgcataccaatgcgtaaacggttgataaatactgaggcaacctgatcgcgttcactggcaacggcggtttctttttcgataattgatgccatcgtcaccaactggtttttatctttataaggcagaccgtccgcacgcccttcccaggcgctatcgaccgctttcaccattttcttgtgcgctcgcttgagtaacgcgacatcggtggtattggcggtatacatccaggtgtctggccagaaccaaccttcaatccactccgggttttccagttcaagtgcctgcgctacggtggcgtacttatcgtcgctcagcgtgtgcttgatatacggagcctcacgcaattgcttgaggtagtcgctcagacgcatcccttctaccagtcgcagcgggaactgtgcttctttaccgctttccaacaatttcagcatctcgcgcacggtcatctgcggtgtaaagcggtaagtcccggctttaaagtgagaaagatccggttcgatacgcagcaaccattgaaaaacccgtgggcgattgatgatcttatcggcataaagctgttcacctagcgccagacgtccggtccctggcttaagggtaaatatcgtctcttctttgataagcaatttgctgtcggcaagatggcgaaccttccagacgcccacaccagcggcgatacccagtaccaccagcaataacaagattatcaataacacttttttcatgactaattcgggcgctcacaaagtggggctaaatattcatataacgttgctgacgaaaaggagacatcgccacaggcacgtacgggcatcactggcattaacgcattacaaataaccatctcatctgcctgcaacgcctcttccagagaggcttgcacttcgacaagctgataagaggattgtgccagcaaacggatacagaattgtcgcataatgccgttaacacctgcctgatccagtcgcggcgtataaactacgttgcccttccgccagaacaaattagccgcacagcattccgtaacccacccttcgctgtcaaggaccagcgcctcatcagcgtttgtctgctcaagatgagagcggatcaatacttgctcaagccgattaagatgtttaatacctgcaagatgaggattgcgccccagccgcaccgggcttagcgccaacgtcatcccttcgttacgcaaacggtcgtaatgtgcaggataagccgtaacggagagaatccgcgttgccggtccactgttcaatgtgctgtaccctcgcccgccactaccgcgactgatcacgactttcagtacaccattttgctgttctgctgccagcgttttcatctcttgttcaagctgaggccagaagtcacaggaaatcatcaaccgctgacaagcatcctgtagtcgctggatatgcgccgataacaaactgactttaccgtcgataactctggcggtggtaaaacaaccatcaccaaactgcgttgcccgatcgcttactgccagcgattcctgcttatgaccgttaattaagaacataccggctccttatcagagaattgttagtgtggcagcatgttcactacggaacaagtcggaataaaagctaagaaaaaaggcccgcaagcggaccttttataagggtggaaaatgacaacttagatctttttaaagatcaaagaaccattagtgccaccgaagccgaaggagttacacagagtgtattccattccgctaacctgacgcgcttcgtgcggtacgaaatccagatcgcaaccttcatccgggttatccaggttgatggttggcggaacagcctgatcgcgcagcgccaggatggagtagatagattctactgcacccgccgcacctaacaggtgaccggtcatagatttcgtggagcttaccaacacgcggcttgcagcttcaccgaagatggttttcaccgcctgcgcttcagctttatcgccagccggcgtagaagtaccgtgcgcgttaacgtagccaatctgactcgcttcaatgcctgcatcacgcagagcatttgccatcgccagagctgcgcctgcgccattttctggcggtgacgtcatatgataagcatcgctgctcataccaaagccgacgagttcagcgtaaattttcgcaccgcgttttttcgcgtgttcgtactcttcaagtaccagcataccggcaccatcgcccagtacgaaaccatcacgctctttatcccacgggcggctcgccgcttgcgggttatcattgcgggtagataatgcacgtgccgcgccaaaaccaccaacgcccagcggcgtactggctttctctgcgccacctgcaaccatcacgtcagcatcgccatacgcgataatacgcgcagcatggccaatgttgtgcacgccggaagtacaggcggtcgcgatagagatgcttgggccacgcaggccatacatgatagtcagatgacctgccaccatgttcacaatcgttgacggaacgaagaatgggctgatcttacgtggaccaccgttcatcagagatgtgtggttttcttcgatcagtccgaggccgccaatcccggagccaattgcggcaccaatgcgggttgcgttctcttccgttatttcaaggccagaatcctgcatggcctgaacgccagcgacaattccatattgaatgaaggcatccatcttgcgctgttctttgcgcgagataatgtcctcacagttaaaatcctttactaagccagcaaatttcgttgcataggcgctagtatcgaaatggtcgattaggctgatgccactctgaccggcaagcagagctttccaggtagactctacggtattgccgacaggagacaacatgcccagtccggtcacaactacacgacgcttagacacgtttgtcctccagggagggaaaaaatgattctagtgggacaaaagataaaactcaggcggtcgaacgaccg
